United States Patent
Jaffe et al.

(10) Patent No.: US 12,509,381 B2
(45) Date of Patent: Dec. 30, 2025

(54) OXIDANT ENHANCED FEAMMOX ACTIVITY

(71) Applicant: THE TRUSTEES OF PRINCETON UNIVERSITY, Princeton, NJ (US)

(72) Inventors: Peter R. Jaffe, Princeton, NJ (US); Shan Huang, Princeton, NJ (US)

(73) Assignee: THE TRUSTEES OF PRINCETON UNIVERSITY, Princeton, NJ (US)

( * ) Notice: Subject to any disclaimer, the term of this patent is extended or adjusted under 35 U.S.C. 154(b) by 81 days.

(21) Appl. No.: 16/651,737

(22) PCT Filed: Sep. 25, 2018

(86) PCT No.: PCT/US2018/052710
§ 371 (c)(1),
(2) Date: Mar. 27, 2020

(87) PCT Pub. No.: WO2019/067467
PCT Pub. Date: Apr. 4, 2019

(65) Prior Publication Data
US 2020/0277211 A1   Sep. 3, 2020

Related U.S. Application Data

(60) Provisional application No. 62/565,480, filed on Sep. 29, 2017.

(51) Int. Cl.
*C02F 3/34* (2023.01)
*B09C 1/10* (2006.01)
(Continued)

(52) U.S. Cl.
CPC ............... *C02F 3/346* (2013.01); *B09C 1/10* (2013.01); *C02F 3/005* (2013.01); *C02F 3/301* (2013.01);
(Continued)

(58) Field of Classification Search
CPC .......... C02F 3/346; C02F 3/005; C02F 3/301; C02F 3/342; C02F 2101/16; C02F 2305/02; C02F 3/341; B09C 1/10
(Continued)

(56) References Cited

U.S. PATENT DOCUMENTS 4,647,287 A * 3/1987 Audeh ..................... C01B 17/05
  23/313 R
5,051,191 A * 9/1991 Rasmussen .............. C02F 9/00
  210/721

(Continued)

OTHER PUBLICATIONS

International Search Report and Written Opinion corresponding to PCT/US2018/052710, mailed Dec. 12, 2018, 13 pages.
(Continued)

*Primary Examiner* — Ekandra S. Miller-Cruz
(74) *Attorney, Agent, or Firm* — J. Clinton Wimbish; Maynard Nexsen PC

(57) ABSTRACT

In one aspect, oxidant is employed for enhancing Feammox activity. Briefly, a medium comprises an ammonium containing contaminant, an iron component, an oxidant, and a Feammox bacterium and/or enzyme thereof capable of oxidizing ammonium with reduction of Fe(II) to Fe(III), wherein the oxidant regenerates Fe(III) via Fe(II) oxidation. In some embodiments, the medium is soil and/or water.

27 Claims, 36 Drawing Sheets

Specification includes a Sequence Listing.

(51) Int. Cl.
*C02F 3/00* (2023.01)
*C02F 3/30* (2023.01)
*C02F 101/16* (2006.01)

(52) U.S. Cl.
CPC .......... *C02F 3/342* (2013.01); *C02F 2101/16* (2013.01); *C02F 2305/02* (2013.01)

(58) Field of Classification Search
USPC ........................................................ 210/605
See application file for complete search history.

(56) References Cited

U.S. PATENT DOCUMENTS

| | | | | |
|---|---|---|---|---|
| 5,620,893 | A * | 4/1997 | Hogen ...................... | C02F 3/34 435/262.5 |
| 7,329,532 | B2 * | 2/2008 | Perriello ................... | C02F 3/34 435/262 |
| 2015/0321933 | A1 | 11/2015 | Jaffe et al. | |
| 2018/0029909 | A1 | 2/2018 | Jaffe et al. | |

OTHER PUBLICATIONS (Mulopo, J et al.) Biological Regeneration of Ferric (Fe3+) Solution During Desulphurisation of Gaseous Streams: Effect of Nutrients and Support Material. Water Science and Technology. 2015; vol. 71, No. 11; pp. 1672-1678; abstract; p. 1674, col. 1, paragraph 2; DOI: 10.2166/wst.2015.144.

(Rickard, D) Kinetics of Pyrite Formation by the H2S Oxidation of iron (II) Monosulfide in Aqueous Solutions Between 25 and 125C: The Rate Equation. Geochimica et Cosmochimica Acta. Jan. 1, 1997; vol. 61, No. 1; pp. 115-134.; abstract; p. 121, col. 2, paragraph 1.

(Henshaw, PF et al.) Extraction of Elemental Sulfur from an Aqueous Suspension for Analysis by High-Performance Liquid Chromatography. Analytical Chemistry. Aug. 1, 1997; vol. 69, No. 15, pp. 3119-3123; p. 3119, col. 1, paragraph 2.

* cited by examiner

OXIDANT ENHANCED FEAMMOX ACTIVITY

RELATED APPLICATION DATA

This application is a U.S. National Phase of PCT/US2018/052710, filed Sep. 25, 2018, which claims priority pursuant to 35 U.S.C. § 119(e) to U.S. Provisional Patent Application Ser. No. 62/565,480 filed Sep. 29, 2017, each of which are hereby incorporated by reference in their entireties. The Sequence Listing titled "Sequence Listing," having a file size of 2,867,945 bytes, created on Sep. 29, 2017 and filed herewith is incorporated herein by reference as if fully set forth.

GOVERNMENT SUPPORT

This invention was made with government support under Grant No. DE-SC0006847 awarded by the Department of Energy and Grant No. CBET-1433101 awarded by the National Science Foundation. The government has certain rights in this invention.

FIELD

The present application relates compositions and methods for environmental remediation and, in particular, to compositions and methods employing Feammox bacteria and an oxidant.

BACKGROUND

The removal of ammonium and other contaminants from soil and water is an important environmental task. Wastewater treatment plants in the developed world and in many developing countries oxidize $NH_4^+$ to $NO_3^-$ before discharging the treated wastewater. This is done to decrease oxygen demand in the receiving waters. Additionally, nitrogen excess in near shore environments has been identified as a major environmental problem leading to eutrophication and anoxia. Legislations are being implemented requiring the conversion of $NO_3^-$ to $N_2$ in conventional waste water treatment plants. The nitrogen compounds that are present in contaminated water, such as ammonium $NH_4^+$, nitrite $(NO_2^-)$ and nitrate $(NO_3^-)$ will have to be converted to elemental nitrogen $N_2$, which can be released in the gaseous state into an open environment.

Nitrogen removal via nitrification and denitrification can be performed by microrganisms. Numerous studies have focused on the aerobic oxidation of ammonia or $NH_4^+$ to first nitrite ($NO_2$—) and then nitrate ($NO_3$). Oxidation of $NH_4^+$ to $NO_2^-$ is the first and rate limiting biological step in the nitrification, and also a required step prior to anaerobic $NH_4^+$ oxidation (anammox), which is the biological conversion of $NH_4^+$ and $NO_2^-$ to nitrogen gas in the absence of oxygen. Anammox is the most common anaerobic $NH_4^+$ oxidation pathway in soils environments known so far, using $NO_2^-$ as the electron acceptor. Anaerobic $NH_4^+$ oxidation is performed by anammox bacteria. Aerobic $NH_4^+$ oxidation is performed by two groups of organisms, ammonia-oxidizing bacteria (AOB), and ammonia-oxidizing archaea (AOA).

In the wastewater treatment plants, biological ammonium oxidation is conducted by aerobic nitrifying bacteria and requires aeration in the step with the highest energy input. An alternative is the partial nitrification (nitritation) Anammox system, which has been implemented in some treatment plants, with the goal of saving energy costs, since only half of the $NH_4^+$ is converted to $NO_2^-$ aerobically. However, these Anammox based wastewater treatment systems need to operate between 28° C. and 35° C.

An $NH_4^+$ oxidation process coupled to iron (Fe) reduction called Feammox was identified (Clement J C et al. 2005 Soil Biol Biochem 37:2323-2328; Sawayama S. 2006; J Biosci Bioeng 101:70-72; Shrestha J et al. 2009 Soil Sci 174:156-164; Yang W H et al. 2012 Nat Geosc 5: 538-541, all of which are incorporated herein by reference as if fully set forth). Feammox is a process that can be described as the oxidation of $NH_4^+$ in the absence of molecular oxygen, with iron oxides [Ferric iron, Fe(III)] as the electron acceptor. In this reaction Fe(III) is reduced to Ferrous iron Fe(II), while $NH_4^+$ is transformed to $NO_2^-$, nitrogen gas ($N_2$), or other nitrogen forms. Feammox may provide benefits for development of an improved system that does not require aeration or heating of the wastewater in temperate climates.

SUMMARY

In one aspect, media are described herein comprising components for removal of ammonium containing contaminants. Briefly, a medium comprises an ammonium containing contaminant, an iron component, an oxidant, and a Feammox bacterium and/or enzyme thereof capable of oxidizing ammonium with reduction of Fe(III) to Fe(II), wherein the oxidant regenerates Fe(III) via Fe(II) oxidation. In some embodiments, the medium is soil or water. Moreover, the medium can further comprise at least one additional contaminant for removal.

In another aspect, systems for environmental remediation are provided. A system, for example, comprises a reactor including a medium comprising an ammonium containing contaminant, an iron component, an oxidant, and a Feammox bacterium and/or enzyme thereof capable of oxidizing ammonium with reduction of Fe(III) to Fe(II), wherein the oxidant regenerates Fe(III) via Fe(II) oxidation. In some embodiments, the reactor comprises an inlet and outlet for the medium, such as water and/or soil. The reactor, for example, can be operated continuously or in a batch mode. The medium, in some embodiments, can further comprise at least one additional contaminant for removal.

In another aspect, methods of environmental remediation are described herein. A method comprises providing a medium including one or more ammonium containing contaminants and disposing a Feammox bacterium and/or enzyme thereof in the medium. The Feammox bacterium and/or enzyme thereof participates in the oxidation of ammonium coupled with reduction of Fe(III) to Fe(II). An oxidant in the medium subsequently regenerates Fe(III) via Fe(II) oxidation. In some embodiments, oxidation of Fe(II) by the oxidant generates hydrogen ions that are consumed in the ammonium oxidation. Additionally, in some embodiments, the oxidant forms a compound with Fe(II) in the medium.

In another aspect, various compositions are described herein. In some embodiments, a composition comprises an Acidimicrobiaceae Feammox bacterium A6 having Accession Deposit Number PTA-122488, at least one of soil, wastewater, and a carrier, and elemental sulfur. The bacterium is capable of oxidizing ammonium coupled with reduction of Fe(III) to Fe(II). In other embodiments, a composition comprises at least one enzyme capable of oxidizing ammonium into nitrite, at least one of soil, wastewater, and a carrier, and elemental sulfur. The soil or wastewater comprises an ammonium containing contaminant, and the at least one enzyme comprises a sequence with at least 70% identity to the sequence selected from the group consisting of SEQ ID NOS: 29-49.

In another aspect, systems employing the various compositions are provided. In some embodiments, a system comprises a reactor and a composition that includes an Acidimicrobiaceae Feammox bacterium A6 having Accession Deposit Number PTA-122488, at least one of soil, wastewater and a carrier, and elemental sulfur. The bacterium is capable of oxidizing ammonium coupled with reduction of Fe(III) to Fe(II).

In another aspect, processes for reducing a nitrogen contaminant in soil and/or water are described herein. A process, in some embodiments, comprises mixing the wastewater with an Acidimicrobiaceae Feammox bacterium A6 having Accession Deposit Number PTA-122488 to form a mixture. The process also comprises adding elemental sulfur to the mixture. In some embodiments, the water can be wastewater or water from the ground water system.

In a further aspect, various hosts are provided including nucleic acids comprising a sequence with at least 70% identity to a reference sequence selected from the group consisting of SEQ ID NOS: 8-28. Additionally, compositions comprising such hosts are also contemplated. A composition, for example, can comprise one or more hosts, at least one or soil, wastewater, and a carrier and elemental sulfur. The soil or wastewater can comprise an ammonium containing contaminant.

These and other embodiments are described in further detail in the following detailed description.

BRIEF DESCRIPTION OF THE DRAWINGS

FIG. 12A illustrates the total variance in the bacterial abundance and the cumulative variance of the bacteria-environment relationship. FIG. 12B illustrates the total variance in the microbial composition and the cumulative variance of the bacteria-sampling location relationship.

FIG. 19A illustrates growth of the A6 bacterium in the liquid medium. FIG. 19B illustrates A6 growth on the solid inorganic $NH_4^+$-ferric iron medium. FIGS. 19C-19D show rod-shaped A6 cells.

DETAILED DESCRIPTION

Figure 1A:
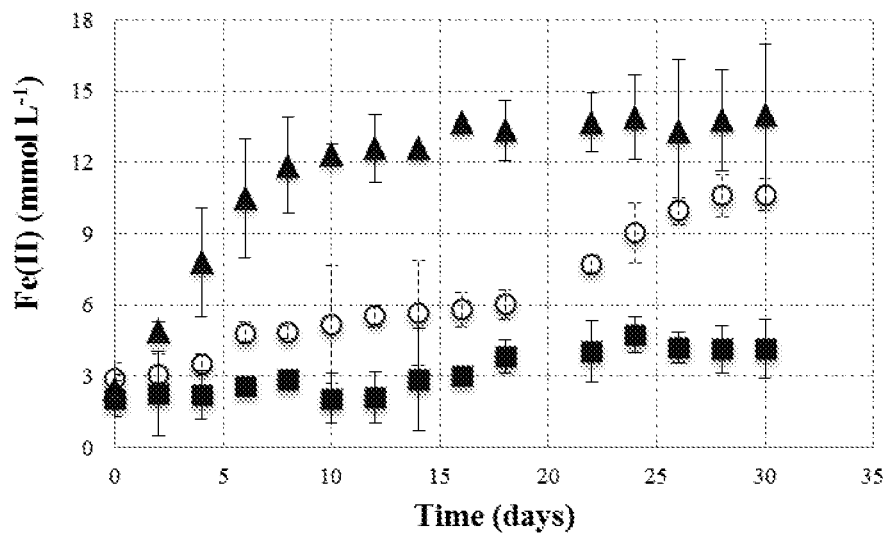
FIGS. 1A-1B illustrate concentration of Fe(II) (FIG. 1A) and $NH_4^+$ (FIG. 1B) in incubation with three different Fe(III) sources: ferrihydrite (open circle), ferric chloride (closed square), and ferric citrate (closed triangle).

Certain terminology is used in the following description for convenience only and is not limiting. The words "right," "left," "top," and "bottom" designate directions in the drawings to which reference is made. The words "a" and "one," as used in the claims and in the corresponding portions of the specification, are defined as including one or more of the referenced item unless specifically stated otherwise. This terminology includes the words above specifically mentioned, derivatives thereof, and words of similar import. The phrase "at least one" followed by a list of two or more items, such as "A, B, or C," means any individual one of A, B or C as well as any combination thereof.

"Synthetic nucleic acid sequence," "synthetic polynucleotide," "synthetic oligonucleotide," "synthetic DNA," or "synthetic RNA" as used herein refers to a nucleic acid, polynucleotide, oligonucleotide, DNA, or RNA that differs from one found in nature by having a different sequence than one found in nature or a chemical modification not found in nature. The definition of synthetic nucleic acid includes but is not limited to a DNA sequence created using biotechnology tools. Such tools include but are not limited to recombinant DNA technology, chemical synthesis, or directed use of nucleases (so called "genome editing" or "gene optimizing" technologies).

Embodiments described herein can be understood more readily by reference to the following detailed description and examples and their previous and following descriptions. Elements and apparatus described herein, however, are not limited to the specific embodiments presented in the detailed description. It should be recognized that these embodiments are merely illustrative of the principles of the present invention. Numerous modifications and adaptations will be readily apparent to those of skill in the art without departing from the spirit and scope of the invention.

In one aspect, media are described herein comprising components for removal of ammonium containing contaminants. A medium comprises an ammonium containing contaminant, an iron component, an oxidant, and a Feammox bacterium and/or enzyme thereof capable of oxidizing ammonium with reduction of Fe(III) to Fe(II), wherein the oxidant regenerates Fe(III) via Fe(II) oxidation. In some embodiments, the medium is soil or water. The medium, for example, is a ground water system or wastewater. Moreover, the medium can further comprise at least one additional contaminant for removal.

Turning now to specific components, the medium comprises one or more ammonium containing contaminants. An ammonium containing contaminant may be, but is not limited to, an industrial, agricultural or human municipal waste. Ammonium containing contaminants, for example, can comprise fertilizers, domestic sewage, or industrial effluents. The ammonium containing contaminant may comprise ammonium chloride and/or any other ammonium salt. The ammonium containing contaminant may also be a nitrogen containing organic compound, wherein nitrogen may be hydrolyzed to ammonium.

The medium also comprises a Feammox bacterium and/or enzyme thereof capable of oxidizing ammonium with reduction of Fe(III) to Fe(II). The Feammox bacterium may be an Acidimicrobiaceae bacterium or a bacterium with a similar genetic composition. The Feammox bacterium may be a bacterial strain that was isolated from wetland soils collected in New Jersey after a series of enrichment incubations. The soil samples were collected at the location identified as 40° 15' N-74° 30' W or within 100 m of the identified location. The Feammox bacterium may be the bacterial strain designated the Acidimicrobiaceae Feammox bacterium A6 and described herein. The Acidimicrobiaceae Feammox bacterium A6 was submitted for deposit with the American Type Culture Collection (ATCC; 10801 University Blvd. Manassas, Virginia 20110-2209, USA) on Apr. 27, 2015, the submission was supplemented on May 7, 2015, and was assigned Accession Deposit Number PTA-122488 on Sep. 17, 2015. The Acidimicrobiaceae Feammox bacterium may have a genome comprising, consisting essentially of, or consisting of a nucleic acid sequence with at least 70, 72, 75, 80, 85, 90, 91, 92, 93, 94, 95, 96, 97, 98, 99, or 100% identity to SEQ ID NO: 1. The Feammox bacterium may have the genome size of 3.3 mega base pairs (Mb) and guanine-cytosine content 52%. The bacterial genome may further include a gene encoding a Feammox Ammonium Monooxygenase. As used herein, the term "Feammox Ammonium Monooxygenase" (FMO) refers to an enzyme that plays a key role in oxidizing ammonium coupled with ferric iron reduction. The FMO also refers to genes encoding clones or different variants of the Feammox Ammonium Monooxygenase. The gene may include a nucleic acid comprising, consisting essentially of, or consisting of a nucleic acid sequence with at least 70, 72, 75, 80, 85, 90, 91, 92, 93, 94, 95, 96, 97, 98, 99, or 100% identity to a sequence selected from the group consisting of: SEQ ID NOS: 8-28. The Feammox Ammonium Monooxygenase may include an amino acid comprising, consisting essentially of, or consisting of a nucleic acid sequence with at least 70, 72, 75, 80, 85, 90, 91, 92, 93, 94, 95, 96, 97, 98, 99, or 100% identity to a sequence selected from the group consisting of: SEQ ID NOS: 29-49. The Feammox bacterium may be live or lyophilized.

Determining percent identity of two nucleic acid sequences may include aligning and comparing the nucleotides at corresponding positions in the two sequences. If all positions in two sequences are occupied by identical nucleotides then the sequences are said to be 100% identical. Percent identity may be measured by the Smith Waterman algorithm (Smith T F, Waterman M S 1981 "Identification of Common Molecular Subsequences," J Mol Biol 147: 195-197, which is incorporated herein by reference as if fully set forth).

As described herein, the medium may comprise one or more enzymes, such as FMO, in addition to the Feammox bacterium for the oxidation of ammonium coupled with reduction of Fe(III) to Fe(II). Alternatively, one or more enzymes, such as FMO, can be present in the medium in the absence of the Feammox bacterium. In such embodiments, the one or more enzymes can be responsible for the ammonium oxidation and/or reduction of Fe(III) to Fe(II). In some embodiments, for example, FMO is isolated from Feammox bacterium and employed in the media. In other embodiments, the one or more enzymes may be fabricated via synthetic chemical techniques.

The medium also comprises an iron component. In some embodiments, the iron component is a natural component of the medium. The iron component can naturally occur in soil, for example. In other embodiments, the iron component is added to the medium. The iron component can be the source of ferric ion, Fe(III), reduced to Fe(II) in conjunction with ammonium oxidation. Any iron component or source consistent with the environmental objectives of the present invention can be employed in the medium. In some embodiments, the iron component comprises iron oxide, a goethite, elemental iron, a nontronite, iron-rich clay or various mixtures thereof. Iron oxide can include hydrated forms, such as ferrihydrite. Ferrihydrite includes a dark brown or yellow brown mineral composed of about 20% ($FeO_4$) and 80% ($FeO_6$) polyhedral. The term "goethite" refers to an iron oxyhydroxide containing ferric iron. The term "nontronite" refers to the Fe(III) rich clay mineral having a typical structural formula $Ca_{0.5}(Si_7Al_{0.8}Fe_{0.2})(Fe_{3.5}Al_{0.4}Mg_{0.1})O_{20}(OH)_4$. The iron component may be scrap metal, or any other source of ferric iron. The iron component can also serve as culture media for the Feammox bacterium in the medium, in some embodiments. For example, the iron component can comprise $NH_4^+$-ferric iron media in liquid or solid form.

The iron component can be present in the medium in any amount to support the oxidation of ammonium, as described herein. In some embodiments, ferric ion is present in the medium at a concentration of 1 mM to 200 mM. The concentration of ferric iron may also be from 1 mM to 2 mM, from 2 mM to 3 mM, from 3 mM to 4 mM, from 4 mM to 5 mM, from 5 mM to 6 mM, from 6 mM to 7 mM, from 7 mM to 8 mM, from 8 mM to 9 mM, from 9 mM to 10 mM, from 10 mM to 20 mM, from 20 mM to 30 mM, from 30 mM to 40 mM, from 40 mM to 50 mM, from 50 mM to 60 mM, from 60 mM to 70 mM, from 70 mM to 80 mM, from 80 mM to 90 mM, from 90 mM to 100 mM, from 100 mM to 150 mM, or from 150 mM to 200 mM.

An oxidant is also present in the medium, wherein the oxidant regenerates Fe(III) via oxidation of Fe(II). As discussed further below, regeneration of Fe(III) by the oxidant can conserve the Fe(III) used in the ammonium oxidation reaction and enhance or accelerate ammonium decomposition in the medium. In this way, iron is recycled in the ammonium decomposition process, and less iron is required for environmental remediation according to processes described herein. Additionally, in some embodiments, oxidation of Fe(II) by the oxidant can produce hydrogen ions. Hydrogen ions produced in the oxidation can be consumed in the ammonium oxidation reaction detailed in Equation 1 below. Accordingly, generation of hydrogen ions in the oxidation of Fe(II) can assist in maintaining a stable pH of the medium during ammonium oxidation. In some embodiments, pH of the medium is 4 to 8 or 5 to 7.

Subsequent to Fe(II) oxidation, the reduced oxidant may react with Fe(II) to provide one or more additional chemical species to the medium. Reaction of the reduced oxidant with Fe(II) can inhibit the accumulation of Fe(II) in the medium. In some embodiments, the reduced oxidant forms a precipitate with Fe(II). Alternatively, the chemical species formed between the reduced oxidant and Fe(II) is fully or partially soluble in aqueous-based media or water.

Any oxidant having the functionality of Fe(II) oxidation without interfering with ammonium oxidation processes can be employed. Suitable oxidant may be in elemental or molecular form. In some embodiments, the oxidant is elemental sulfur, S(0). Elemental sulfur can be present in the medium in any amount consistent with the environmental remediation objectives described herein. For example, elemental sulfur may be present in the medium in an amount in excess of the solubility limit of elemental sulfur in water. The amount of elemental sulfur may be in a range from 1 mg/L to 2 kg/L of the composition. The amount of sulfur may be any amount in a subrange within the range of 1 mg/L to 2 kg/L, where the subrange includes (1) a lower limit selected from 1 mg/L increments from 1 mg/L to 1.999 kg/L, and (2) a higher limit that is higher than the lower limit and selected from 1 mg/L increments from 1 mg/L to 2 Kg/L. For example, the lower limit may be 1 mg/L, 2 mg/L, 3 mg/L . . . 1.999 Kg/L, and the higher limit may be 2 mg/L, 3 mg/L, 4 mg/L . . . 2 Kg/L. The amount of elemental sulfur may be selected from any value within the range or subrange, or an endpoint of the range or subrange.

As described herein, the medium can comprise water, soil or mixtures thereof. The water can be any source of water, including ground water, lakes, streams and/or reservoirs. In some embodiments, the water is wastewater. As used herein, the term "wastewater" refers to any water that has been adversely affected in quality by anthropogenic influence. Wastewater may be municipal wastewater, industrial wastewater, agricultural wastewater, surface runoff, stormwater, or wastewater combining wastewater from multiple sources. Wastewater may be treated in a wastewater treatment plant. Wastewater may include nitrogen contaminants. As used herein, the term "contaminant" refers to compounds that are not occurring in water naturally, pose health or ecological risks or are subject to state and federal regulation.

Nitrogen contaminants may be an ammonium containing contaminant. The ammonium containing contaminant can comprise an industrial, agricultural, or human municipal waste. Ammonium containing contaminants, for example, may include fertilizers, domestic sewage, or industrial effluents. The ammonium containing contaminant may be ammonium chloride or any other ammonium salt. The ammonium containing contaminant may be a nitrogen containing organic compound, wherein nitrogen may be hydrolyzed to ammonium.

Similarly, soil may be any soil that has been adversely affected in quality by anthropogenic influence. The soil may include any nitrogen contaminants described herein. The soil may include groundwater. The groundwater may comprise wastewater described herein. The groundwater may contain any nitrogen contaminant described herein.

Water or soil medium may include at least one additional contaminant. The at least one additional contaminant may be inorganic contaminants. Inorganic contaminants may be but are not limited to heavy metals, radionuclides or trace metals. Inorganic contaminants may be copper, uranium, ferric iron, lead, zinc, arsenic, chromium, mercury or silver. The at least one additional contaminant may be organic contaminant(s). The organic contaminants can comprise chlorinated volatile organic compounds, perchloroethylene (PCE), trichloroethylene (TCE), trichloroethane, dichloroethane, vinyl chloride, polychlorinated biphenyls, fuel constituents, benzene, ethylbenzene, toluene, xylene, phenanthrene, methyl tert butyl ether, tertiary butyl alcohol, polyaromatic hydrocarbons, or ethylene dibromide.

In an embodiment, the ammonium containing contaminant may be added to a composition that would otherwise be low or deficient in ammonium when reactions in addition to or in place of ammonium oxidation are of interest.

In some embodiments, the medium may further comprise a carrier. The carrier may support growth of the Feammox bacterium. The carrier may comprise a filter, beads, agarized medium, or any surface that allows bacterial attachment. The carrier may include media for culturing the Feammox bacterium. The media may be inorganic $NH_4^+$-ferric iron media. The inorganic $NH_4^+$-ferric iron media may be solid media or liquid media. The liquid media may include but not limited to the following components: $NH_4Cl$, $(NH_4)_2SO_4$, $NaHCO_3$, $KHCO_3$, $KH_2PO_4$, 100 mg $MgSO_4 \cdot 7H_2O$, and $CaCl_2 \cdot 2H_2O$. The liquid media may further include ferrihydrite, AQDS, trace element solution or vitamins. Vitamins may be but are not limited to ATCC® vitamins. The liquid media may have a pH in a range from 4.0 to 5.0. The media may include traces of dissolved oxygen. The solid medium may have the same composition as the liquid media but include elements to solidify the mixture. The solid media may be solidified with 0.8% agar. The solid media may include ferrihydrite that is spread on the surface of the medium.

In another aspect, systems for environmental remediation are provided. A system, for example, comprises a reactor including a medium comprising an ammonium containing contaminant, an iron component, an oxidant, and a Feammox bacterium and/or enzyme thereof capable of oxidizing ammonium with reduction of Fe(III) to Fe(II), wherein the oxidant regenerates Fe(III) via Fe(II) oxidation. In some embodiments, the reactor comprises an inlet and outlet for the medium, such as water and/or soil. The reactor, for example, can be operated continuously or in a batch mode. Components of the medium, including the ammonium containing contaminant, iron component, oxidant, and Feammox bacterium and/or enzyme thereof can have any properties and/or compositions described hereinabove. In some embodiments, the medium can comprise at least one additional contaminant. Additional contaminants can have any composition described hereinabove. Moreover, the medium can comprise water and/or soil. Water of the system can be any source of water, including wastewater, ground water, lakes, streams and/or reservoirs.

Figure 11:
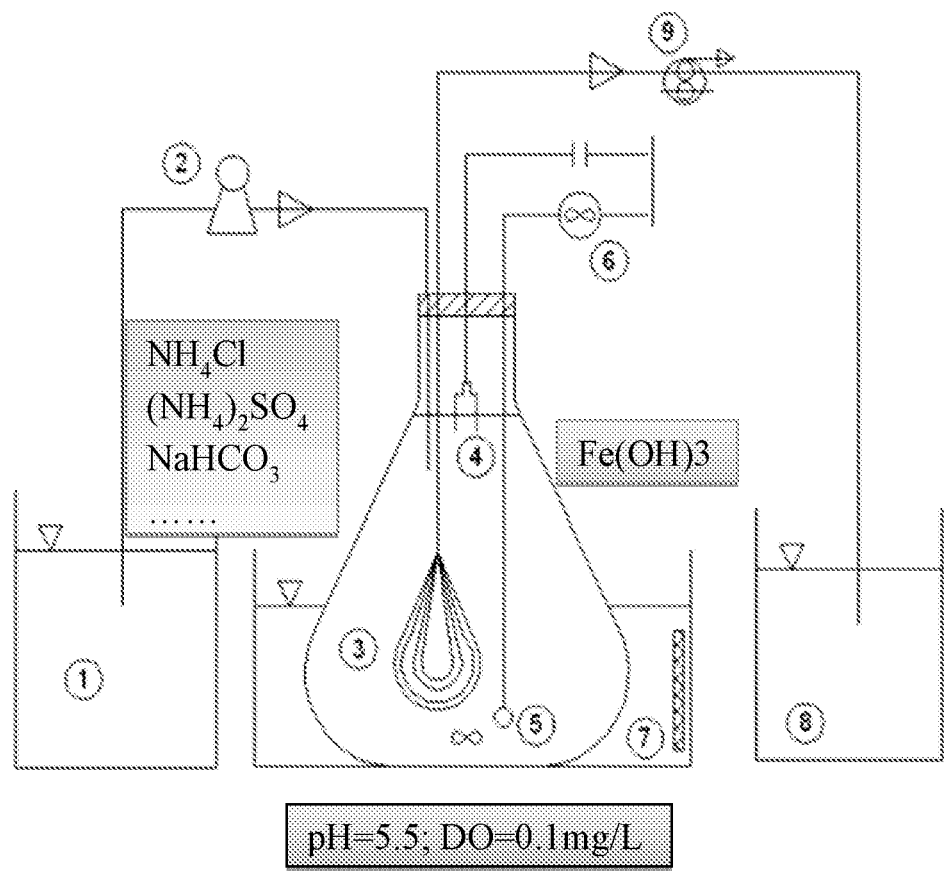
FIG. 11 illustrates a schematic representation of a membrane reactor for $NH_4^+$ oxidation via Feammox.
Figure 29:
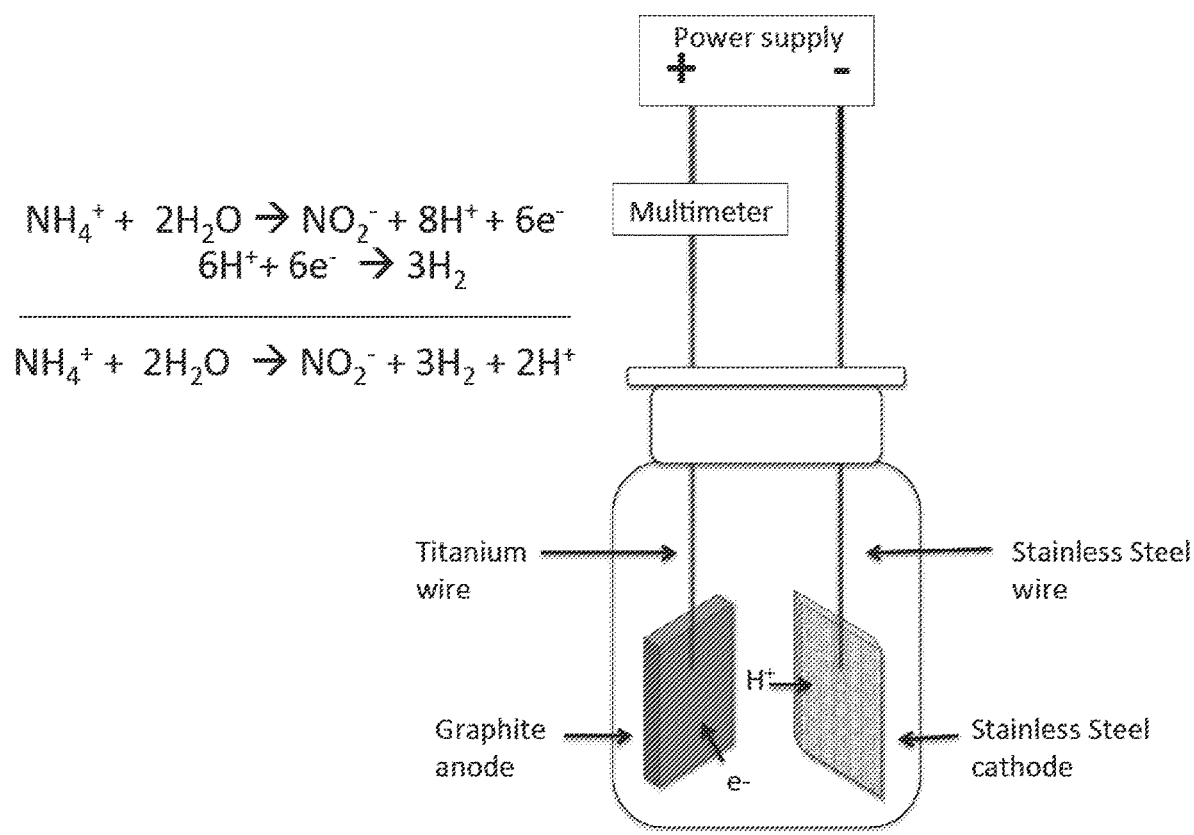
FIG. 29 illustrates a scheme of the electrogenic microbial reactor.

The reactor may be a continuous membrane reactor or a sequential batch reactor. In a non-limiting example the continuous membrane reactor may be a reactor illustrated in FIG. 11. FIG. 11 illustrates a scheme of a membrane reactor for $NH_4^+$ oxidation via Feammox. Referring to FIG. 11, 1 refers to the feed solution, 2 refers to the feed pump, 3 refers to the membrane module, 4 refers to the floater connected to an electrical on/off switch, 5 refers to the ceramic diffuser, 6 refers to the $N_2$ supplier, 7 refers to the water bath, 8 refers to outflow, and 9 refers to the outflow pump. The reactor may be an electrogenic microbial reactor. The electrogenic microbial reactor may be any bioelectrochemical system that extracts energy from a substrate (Call and Logan 2011 *Biosen. Bioelectron.* 26(11): 4526-4531, which is incorporated herein by reference as if fully set forth). The electrogenic microbial reactor may be any bioelectrochemical system that extracts energy from a substrate (Call and Logan 2011 *Biosen. Bioelectron.* 26(11): 4526-4531, which is incorporated herein by reference as if fully set forth). In the bioelectrochemical system, electrons may be harvested biologically, and then transferred to the anode that functions as the terminal electron acceptor for the microorganisms in the system, and $H_2$ is produced at the anode. The electrogenic microbial reactor may be a Microbial Fuel Cell (MFC) or Microbial Electrolysis cell (MEC). A non-limiting example of the electrogenic microbial reactor is illustrated in FIG. 29. Referring to FIG. 29, the reactor includes a tank, a graphite anode connected via titanium wire to the positive terminal of the power supply, a stainless steel cathode connected via stainless steel wire to the negative terminal of the power supply. MECs require a small potential applied from an external power source ($E_{AP}$>0.25 V), resulting in $H_2$ production at the anode (Logan, Hamelers et al. 2006 *Environ. Sci. Technol.* 40(17):5181-5192; Call and Logan 2008 *Environ. Sci. Technol.* 42(9):3401-3406; Call and Logan 2011, all of which are incorporated by reference herein as if fully set forth). In an embodiment, a reactor may be an industrial-type reactor. The reactor may operate within a water treatment plant. The reactor may be a treatment pond or a reservoir. The reactor may be a tank for wastewater storage.

Reactor conditions may include a temperature in a range from 4° C. to 35° C. The temperature may be in a range between any two integer value temperatures selected from 4° C. to 35° C. The temperature may be in a range between and including 4° C. to 10° C., 10° C. to 15° C., 15° C. to 20° C., 20° C. and 25° C., 25° C. and 30° C., 30° C. and 35° C. The temperature may be any one integer value temperature selected from those including and between 4° C. and 35° C. or 15° C. to 35° C. Temperatures between room temperature and 35° C. may be used. The temperature may be any one temperature including and between room temperature and 35° C. Temperatures between 20° C. and 35° C. may be used. The temperature may be any temperature including and between 20° C. and 25° C.

The reactor may be operated for a period of time ranging from 2 hours to 45 days. The time period may be 5 hours, 10 hours, 15 hours, 20 hours, 1 day, 2 days, 3 days, 4 days, 5 days, 10 days, 15 days, 20 days, 25 days, 30 days, 35 days, 40 days or 45 days. The time period may be any one integer value selected from those including and between value points, endpoints inclusive. The time period may be greater than 45 days. The time period may be less than 1 day. In continuous flow reactors or in batches, the process may last from several hours to several months. For continuous flow reactors, the time period may depend on the bacterial concentration in the inoculum. Higher bacterial concentration in the inoculum may result in a shorter remediation time. The time period may depend on hydraulic retention capacity of a continuous flow reactor. Lower retention capacity of the continuous flow reactor may result in a shorter remediation time. Hydraulic residence time for the continuous flow reactors may be from 3 hours to 4 hours, from 3 hours to 5 hours, from 3 hours to 6 hours, from 3 hours to 7 hours, from 3 hours to 8 hours, from 3 hours to 10 hours, from 3 hours to 15 hours, from 3 hours to 20 hours, from 3 hours to 1 day, from 3 hours to 2 days, from 3 hours to 3 days. Hydraulic residence time may be any integer value selected from those including and between value points, endpoints inclusive.

pH of the medium in the reaction can range from 2.0 to 8.0. The pH of the medium may be in a range between and including 2.0 and 3.0, 3.0 and 4.0, 4.0 and 5.0, 5.0 and 6.0, 6.0 to 7.0, 7.0 to 7.5. The pH may be any one integer value pH selected from those including and between 2.0 and 7.5. The pH may be any pH including and between 4.0 and 7.0.

In some embodiments, the reactor and associated processes may have nitrification and denitrification phases. The process may include a nitrification phase followed by a denitrification phase. The nitrification and denitrification phases may be performed in parallel. The parallel performance of nitrification and denitrification phases may occur at low levels of oxygen. The nitrification and denitrification phases may be performed in the same reactor. The reactor utilized in the process may be configured to allow a nitrification phase and a denitrification phase. There may be two separate reactors for each of the nitrification and denitrification phases. The process may further include adding Anammox bacteria to the reactor. The nitrification phase may be performed by the Feammox bacteria. In the nitrification phase, ammonium may be converted to nitrite. The denitrification phase may be performed by denitrifying bacteria. In the denitrification phase, nitrite may be converted to gaseous nitrogen ($N_2$). The denitrification phase may be performed by the Anammox bacteria.

In another aspect, methods of environmental remediation are described herein. A method comprises providing a medium including one or more ammonium containing contaminants and disposing a Feammox bacterium and/or enzyme thereof in the medium. The Feammox bacterium and/or enzyme thereof participates in the oxidation of the ammonium coupled with reduction of Fe(III) to Fe(II). An oxidant in the medium subsequently regenerates Fe(III) via Fe(II) oxidation. In some embodiments, oxidation of Fe(II) by the oxidant generates hydrogen ions that are consumed in the ammonium oxidation. Additionally, in some embodiments, the oxidant forms a compound with Fe(II) in the medium, as described hereinabove. The compound may be a precipitate, in some embodiments. Components of the medium, including the ammonium containing contaminant, iron component, oxidant, and Feammox bacterium and/or enzyme thereof can have any properties and/or compositions described hereinabove. In some embodiments, the medium can comprise at least one additional contaminant. Additional contaminants can have any composition described hereinabove. Moreover, the medium can comprise water and/or soil. Water can be of any source, including wastewater, ground water, lakes, streams and/or reservoirs.

In a non-limiting example, the oxidant can be element sulfur, S(0). Elemental sulfur oxidizes Fe(II) to regenerate Fe(III). The regenerated Fe(III) can subsequently participate in Feammox reactions occurring in the medium. The oxidation of Fe(II) by elemental sulfur can also produce hydrogen ions. The hydrogen ions may be consumed in Feammox reactions occurring in the medium as provided in Equation 1 below. The production of hydrogen ions can assist in maintaining a stable pH of the medium. Additionally, the regeneration of Fe(III) can reduce the iron content required for sufficient ammonium oxidation and/or removal of other contaminants from the medium. In reduced form, the elemental sulfur can be present as sulfide. The sulfide can react with Fe(II) to precipitate iron sulfide (FeS). Reaction of the reduced oxidant with Fe(II) inhibits accumulation of Fe(II) in the media. As shown in the examples below, presence of the oxidant can substantially enhance ammonium decomposition rates. While not wishing to be bound by any theory, the overall reaction scheme involving elemental sulfur oxidant, S(0), is presented in equations (1-4):

Oxidation of ammonium by Feammox bacterium and/or enzyme(s) thereof:

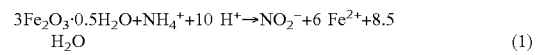

(1)

Oxidation of $Fe^{2+}$ by S(0):

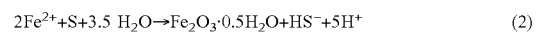

(2)

Precipitation of FeS:

(3)

Overall Reaction:

(4)

Accordingly, with proper oxidant, a redox cycle can be established for enhancing ammonium oxidation and/or decomposition and removal of other contaminants from the media, while conserving Fe(III).

Methods of environmental remediation described herein may occur in low levels of oxygen or in the absence of oxygen. In some embodiments, methods may include removing oxygen. As used herein, "absence of oxygen" may include a complete lack of oxygen, low levels of oxygen or oxygen levels below detection. Absence of oxygen may include low oxygen concentrations that allow for iron reduction. Absence of oxygen fir example, may be 2 mg/l of dissolved oxygen or less. Absence of oxygen may be 0.5 mg/l of dissolved oxygen or less. Low levels of oxygen may be created by organisms degrading organic carbon when oxygen is consumed by organisms degrading organic carbon, and no or insufficient aeration is provided to compensate for low levels of oxygen. The process may include maintaining low levels of oxygen.

In another aspect, various compositions are described herein. In some embodiments, a composition comprises an Acidimicrobiaceae Feammox bacterium A6 having Accession Deposit Number PTA-122488, at least one of soil, wastewater, and a carrier, and elemental sulfur. The bacterium is capable of oxidizing ammonium coupled with reduction of Fe(III) to Fe(II). In other embodiments, a composition comprises at least one enzyme capable of oxidizing ammonium into nitrite, at least one of soil, wastewater, and a carrier, and elemental sulfur. The soil or wastewater comprises an ammonium containing contaminant, and the at least one enzyme comprises a sequence with at least 70% identity to the sequence selected from the group consisting of SEQ ID NOS: 29-49.

In another aspect, systems employing the various compositions are provided. In some embodiments, a system comprises a reactor and a composition that includes an Acidimicrobiaceae Feammox bacterium A6 having Accession Deposit Number PTA-122488, at least one of soil, wastewater and a carrier, and elemental sulfur. The bacterium is capable of oxidizing ammonium coupled with reduction of Fe(III) to Fe(II).

In another aspect, processes for reducing a nitrogen contaminant from soil and/or water are described herein. A process, in some embodiments, comprises mixing the wastewater with an Acidimicrobiaceae Feammox bacterium A6 having Accession Deposit Number PTA-122488 to form a mixture. The process also comprises adding elemental sulfur to the mixture. In some embodiments, the water can be wastewater or water from a ground water system.

In a further aspect, various hosts are provided including nucleic acids comprising a sequence with at least 70% identity to a reference sequence selected from the group consisting of SEQ ID NOS: 8-28. Additionally, compositions comprising such hosts are also contemplated. A composition, for example, can comprise one or more hosts, at least one or soil, wastewater, and a carrier and elemental sulfur. The soil or wastewater can comprise an ammonium containing contaminant.

In some embodiments, a synthetic nucleic acid encodes an enzyme capable of oxidizing ammonium coupled with iron reduction. The enzyme may be Feammox Ammonium Monooxygenase (FMO). The synthetic nucleic acid may comprise consists essentially of, or consists of a sequence with at least 70, 72, 75, 80, 85, 90, 91, 92, 93, 94, 95, 96, 97, 98, 99, or 100% identity to a reference sequence selected from the group consisting of: SEQ ID NOs: 8-28.

Additionally, expression cassettes are provided that include any synthetic nucleic acid described herein. An expression cassette, for example, may include the synthetic nucleic acid encoding the FMO. The expression cassette may be introduced into a vector. Suitable vectors may be cloning vectors, transformation vectors, expression vectors, or virus-based vectors. The expression cassette portion of a vector may further include a regulatory element operably linked to a synthetic nucleic acid encoding the FMO. In this context, operably linked means that the regulatory element imparts its function on the synthetic nucleic acid. For example, a regulatory element may be a promoter, and the operably linked promoter would control expression of the synthetic nucleic acid.

Expression of a synthetic nucleic acid encoding the FMO from the expression cassette may be under the control of a promoter, which provides for transcription of the synthetic nucleic acid in a host. The promoter may be a constitutive promoter or, tissue specific, or an inducible promoter. A constitutive promoter may provide transcription of the nucleic acid throughout most cells and tissues of the host and during many stages of development but not necessarily all stages. An inducible promoter may initiate transcription of the synthetic nucleic acid sequence only when exposed to a particular chemical or environmental stimulus. A tissue specific promoter may be capable of initiating transcription in a particular host tissue. The promoter may provide transcription of a synthetic nucleic acid having a sequence with at least 70, 72, 75, 80, 85, 90, 91, 92, 93, 94, 95, 96, 97, 98, 99, or 100% identity to a reference sequence selected from the group consisting of SEQ ID NOS: 8-28 and expression of the FMO that is capable of oxidizing ammonium coupled with iron reduction.

In some embodiments, any one of the vectors or expression cassettes described herein may be introduced to a host. The host can comprise a bacterium, plant, algae, or yeast. An embodiment includes a host herein comprising any one of the vectors or expression cassettes described herein.

The following non-limiting examples are provided to illustrate particular embodiments. The embodiments throughout may be supplemented with one or more detail from one or more example below, and/or one or more element from an embodiment may be substituted with one or more detail from one or more example below.

Example 1. Development of an Enrichment Culture Capable of Ammonium Oxidation Under Iron Reducing Conditions An anaerobic $NH_4^+$ oxidation process coupled to iron reduction was first noted in a forested riparian wetland in New Jersey. In this reaction, $NH_4^+$ is the electron donor, which is oxidized to nitrite ($NO_2^-$), and ferric iron [Fe(III)] is the electron acceptor, which is reduced to ferrous iron [Fe(II)]. The stoichiometry and change in free energy when ferrihydrite is the Fe(III) source is:

$$3Fe_2O_3 \cdot 0.5H_2O + 10H^+ + NH_4^+ \rightarrow 6Fe^{2+} + 8.5H_2O + NO_2^-$$
$$(\Delta G_r \leq -145.08 \text{ kJ mol}^{-1}) \quad \text{(Equation 1)}$$

These pathways have been reported to oxidize $NH_4^+$ to $NO_2^-$, to $NO_3^-$, or directly to $N_2$, using Fe(III) as electron acceptor (Clement et al., 2005; Shrestha et al., 2009; Sawayama, 2006; Yang et al., 2012, all of which are incorporated by reference as if fully set forth).

Soil samples were collected from the same location and used for laboratory incubation experiments as well as to set up an enrichment system for Feammox in a continuous flow membrane reactor. Various incubation conditions [Fe(III) sources, inorganic carbon content, $NH_4^+$ concentration, $^{15}NH_4^+$, and acetylene gas ($C_2H_2$) as a selected inhibitor] were used to study the Feammox mechanism. Molecular biology methods, such as denaturing gradient gel electrophoresis (DGGE), 454 pyrosequencing, and real-time quantitative PCR (qPCR) analysis were used to investigate the bacterial community change during incubations. Production of both nitrite (NO2-) and ferrous iron were measured repeatedly during incubations when soil slurries were supplied with iron oxide (ferrihydrite or goethite) and ammonium chloride.

The Feammox process provided denitrifiers and anammox bacteria with the necessary NO2- under this anaerobic incubation, and achieved total nitrogen loss via denitrification and anammox pathways. Therefore, Feammox is an important process in the nitrogen cycle in soil environments under oxygen limited conditions, and reveals a new linkage between these two significant biogeochemical cycles (iron and nitrogen cycle).

Example 2. Sample Collection and Processing

Soils for all the experiments described in examples herein were taken from a temperate forested riparian wetland at the Assunpink Wildlife Management Area, New Jersey. Ten soil cores were collected from 10 cm below the surface with polyethylene column containers (8 cm diameter and 30 cm long) and transported to the laboratory within 2 hours. The soil pH was between 3.5 and 4.5, and no manganese oxides were detected. The detailed physicochemical characteristic of these wetland soils have been described elsewhere (Clement et al., 2005 Soil Biol Biochem 37: 2323-2328, which is incorporated by reference as if fully set forth). Prior to all incubation experiments, soil slurry from the field site was aerated for a month to degrade much of the labile organic carbon. After a 30 days of aeration, the dissolved organic carbon (DOC) content was stable at 2.06±0.20 mg g$^{-1}$.

Following the aeration treatment, the soil was divided into 400×10 g (air-dry equivalent) subsamples, and added into 50 mL serum vials, with 30 mL deionized water. The soil slurries were purged thoroughly with a $CO_2:N_2$ (80:20) mixture, resulting in a final pH of 4 to 4.5. The vials were sealed tightly with rubber stoppers and were stored in an anaerobic glove box for 30 days at ambient temperature to allow for stabilization before starting the incubations.

Example 3. Batch Incubation Experiments

All incubations, addition of reagents, and sampling were conducted in an anaerobic glove box with a solution of resazurin as the redox indicator. Soil samples were first incubated with different Fe(III) sources to determine which source would yield a more active Feammox process: 6-line ferrihydrite ($Fe_2O_3 \cdot 0.5H_2O$) or goethite [FeO(OH)]+$NH_4^+$ addition; ferric chloride+$NH_4^+$ addition; ferric citrate+$NH_4^+$ addition; either only ferrihydrite or $NH_4^+$ addition; and autoclaved soil with ferrihydrite+$NH_4^+$ addition (n=30 per treatment). 6-line ferrihydrite ($Fe_2O_3 \cdot 0.5H_2O$) or goethite [FeO(OH)] was prepared according to Cornell and Schwertmann, 2003 The Iron Oxides: Structure, Properties, Reactions, Occurrences, and Uses. John Wiley and Sons Ltd., which is incorporated herein by reference as if fully set forth. pH was adjusted to 4.5 in the ferrihydrite/goethite augmented samples, and to between 3.5~4.0 in the ferric chloride/citrate augmented samples. Soil-slurry samples, which were prepared to have an initial concentration of 12.0 mmol $L^{-1}$ Fe(III) and/or 2.00 mmol $L^{-1}$ $NH_4^+$, were incubated in a series of 50 ml vials with an oxygen-free headspace, created by purging with a $CO_2:N_2$ (80:20) mixture. Triplicate samples were collected destructively every two days to analyze iron and nitrogen species.

The second incubation was conducted to extend the anoxic incubation with ferrihydrite to 180 days, with repeated $NH_4Cl$ additions after the Nile in solution was exhausted. The initial concentration of Fe(III) was 25.0 mmol $L^{-1}$ and 1.00 mmol $L^{-1}$ $NH_4^+$ was added on days 4, 24, and 60, furthermore, 0.20 mmol $L^{-1}$ $NaHCO_3$ was added on day 50 and day 90 of the incubation. On day 125, incubation vials were divided into two sets to study the effect of different inorganic carbon contents on Feammox. Either 1.20 mmol $L^{-1}$ or 0.20 mmol $L^{-1}$ of $NaHCO_3$ plus 2 mmol $L^{-1}$ of $NH_4Cl$ were added to each set. $NaHCO_3$ was then added every 10 days, which increased the soil pH to ~5 in the samples amended with 1.20 mmol $L^{-1}$ of $NaHCO_3$. For this incubation, samples were collected every four days. Finally, soil samples collected on day 180 of the incubations were used to enrich the Feammox bacteria in a membrane reactor. To study how the organic carbon content affects the Feammox bacteria, 1.00 mmol $L^{-1}$ sodium citrate was also supplied on day 125 to four of the 1.20 mmol $L^{-1}$ $NaHCO_3$ amended samples.

In the third experiment, inorganic nitrogen species were quantified through incubations in the presence of $C_2H_2$. Soil slurries were first incubated for 90 days in eighty 50 mL vials. The Fe(III) concentration at the beginning of the incubations was 25 mmol $L^{-1}$. One mmol $L^{-1}$ $NH_4Cl$ and 0.20 mmol $L^{-1}$ $NaHCO_3$ was added on days 24, 60, and 90. After this incubation, 5 mL of pure $C_2H_2$ gas were added to 40 vials, which resulted in a finial $C_2H_2$ concentration of 100 $L^{-1}$. Samples with and without $C_2H_2$ were then incubated anaerobically for 20 days. The headspace gas was sampled every 24 hours for $N_2O$ analysis, and soil samples were analyzed every two days for Fe and N species.

Example 4. Continuous Flow Membrane Feammox Reactor

Soil samples collected on day 180 from the incubation with ferrihydrite, $NH_4Cl$, and 1.20 mmol $L^{-1}$ $NaHCO_3$ additions were inoculated into a continuous flow membrane reactor, which was operated under anaerobic conditions by constantly purging $N_2$ through the reactor's headspace at a room temperature (25° C.), and with a 48 hour hydraulic retention time (Abbassi et al., 2014 *J. Environ. Management* 142: 53-59, which is incorporated herein by reference as if fully set forth).

The enrichment medium contained the following components per liter: 177 mg $NH_4Cl$, 77.9 mg $(NH_4)_2SO_4$, 19.8 mg $NaHCO_3$, 71.0 mg $KHCO_3$, 9.00 mg $KH_2PO_4$, 100 mg $MgSO_4 \cdot 7H_2O$, and 60.0 mg $CaCl_2 \cdot 2H_2O$. After autoclaving, 1 mL trace element solution was added to the medium (Van de Graaf et al., 1996 *J. Microbiol.*, 142:2187-2196, which is incorporated herein by reference as if fully set forth). 50.0 mmol $L^{-1}$ ferrihydrite were added once every two weeks directly into the reactor. To aid in maintaining anaerobic conditions, 0.10-0.20 mmol$L^{-1}$ sodium citrate was fed to the reactor about twice per month. pH was controlled at around 4~5, and dissolved oxygen was <0.10 mg/L. Samples form the outflow were collected every two days, and sludge samples from reactor were collected and kept at −20° C. for molecular biology analysis.

Finally, $^{15}N$ isotope tracer incubations were conducted using slurries collected form the stable Feammox membrane reactor. Five treatments (n=3 per treatment) were conducted: (1) control with only anoxic deionized (DI) water; (2)$^{15}NH_4Cl$ addition; (3) $^{15}NH_4Cl$+Fe(III) addition; (4)$^{15}NH_4Cl$ and $C_2H_2$ addition; (5)$^{15}NH_4Cl$, $C_2H_2$, and Fe(III) addition. The headspace gas of each 50 mL incubation vial was sampled every 24 hours for $^{15}N_2O$ analysis.

Example 5. Chemical Analyses

For each sample collection during the incubations, a set of vials was destructively sampled in a glove box under oxygen-free conditions and the pH was measured immediately using a pH electrode. An extraction with 0.5N HCl was conducted for 24 hours at room temperature to determine acid-extractable Fe(II) and $NH_4^+$ concentrations in the soils. Fe(II) was analyzed using the ferrozine assay method (Stookey, 1970 Anal Chem 42: 779-781; Komlos et al., 2007 Water Res 41: 2996-3004, which are incorporated herein by reference as if fully set forth). Extraction efficiency of Fe(II) was affected by the HCl concentration and the extraction time. About 5-10% more Fe(II) could be extracted with either 1N HCl extraction over 24 hours or with 0.5N HCl over 36 hours as opposed to 0.5N HCl over 24 hours. Furthermore, after more Fe(II) was produced in the system with increasing incubation time, the Fe(II) extraction efficiency improved. Only a 1-2% difference was observed in the Fe(II) extracted over 24 hours using 0.5N vs. 1N HCl towards the end of the incubation period. Clays, present in the soil incubations, typically sorb Fe(II) more efficiently when the total Fe(II) is low, furthermore ferrihydrite is slowly converted to magnetite, resulting in relatively different associations to different phases of the Fe(II) over the duration of the incubation. All of which leads to incomplete Fe(II) extractions, especially when the Fe(II) is low. Fe(II) data obtained herein via 0.5N HCl extractions over 24 hours to ensure that the methods and hence data are comparable to those reported by other researchers focusing on iron reduction and iron bioavailability.

$NH_4^+$ was analyzed using a Dionex™ Ion Chromatograph (LC3000) with a CS-16 Column and a CS-16 guard column (flow rate=1.00 mL min$^{-1}$, detection limit=0.012 ppm). $NO_3^-$ and $NO_2^-$ were extracted with DI water for 1 hour anaerobically, and measured via Ion Chromatography, using an AS-22 Column along with an AG-22 guard column (flow rate=1.20 mL min$^{-1}$, detection limit=0.016 ppm). For the total organic carbon (TOC) and total nitrogen (TN) analyses a Shimadzu TOC-5000(A) was used. $N_2O$ concentrations were determined on a gas chromatograph Shimadzu 2014 equipped with an electron capture detector.

Example 6. DNA and RNA Isolation

DNA and RNA samples were extracted from soils collected at the wetland prior to any laboratory incubation, from the samples taken at different time points during the incubation experiments and from the reactor. DNA was extracted from 500 mg soil or sludge samples using the FastDNA® spin kit for soil (MP Biomedicals, USA) as described by the manufacturer, and RNA using the FastRNA® pro Soil Direct Kit. The concentrations were measured using a Nanodrop 2000 spectrophotometer (Thermo Scientific, USA).

Example 7. PCR-DGGE and 454 Pyrosequencing Analysis

Bacterial universal 16S rRNA gene primer sets V3-2/V3-3 were used for PCR amplification (Jensen et al., 1998 FEMS Microbiol Ecol 26: 17-26, which is incorporated herein by reference as if fully set forth). DGGE was performed with an 8% polyacrylamide gel containing a gradient from 40% to 80% denaturant using the gradient gel electrophoresis system (C.B.S. SCIENTIFIC, USA). The electrophoresis was carried out at 60 V for 15 hours. After that the gel was stained with 0.1 μL mL$^{-1}$ SYBR Green I and visualized with an UV transilluminator. All visible bands were excised from the gel and used as templates for re-amplification, using the primer set V3-1/V3-2 and followed by cloning (Jensen et al., 1998, which is incorporated herein by reference as if fully set forth). PCR products were purified via agarose gel extraction and cloned into a pGEM-T vector (Promega). A total of 10 to 30 positive recombinant clones for each band were identified by colony PCR, and were sent for sequencing to avoid erroneous interpretations. DNA sequencing was then conducted by Genewiz, Inc. Bacteria were classified and the phylogenetic tree of Acidimicrobiaceae-related sequences was constructed using the Bayesian inference (Huelsenbeck et al., 2001 Science, 294:2310-2314, which is incorporated herein by reference as if fully set forth). Sequences obtained in this study were submitted to the GanBank database on Feb. 4, 2013, and are available therein under accession numbers KC581755-KC581779. See also Huang S and Jaffe P R, *Characterization of incubation experiments and development of an enrichment culture capable of ammonium oxidation under iron reducing conditions,* 2014, Biogensciences Discuss, 11, 12295-12321, which is incorporated herein by reference as if fully set forth. To further confirm the changes in the bacterial community, 454 pyrosequencing was performed with samples collected from the incubation on days 0, 30, 90, 160 and from the membrane reactor after 150 days of reactor operation. Domain-specific primers Bact-338F1/909R, targeting the V3-V5 region of the 16S rDNA of bacteria were amplified and sequenced according to Pinto et al. (2012, PLoS One 7: 43093, which is incorporated herein by reference as if fully set forth).

Example 8. Quantitative PCR (qPCR) Assay qPCR experiments were carried using a StepOnePlus™ Real-Time PCR System (Life Technologies, USA), represented by 16S rRNA genes, using primer sets 1055f/1392r for total bacteria (Harms et al., 2003), Amx368f/Amx820r for anammox bacteria (Schmid et al., 2000; Schmid et al., 2003), acd320f-432r which were developed for Acidobacteriaceae bacteria, and acm342f-439r which were developed for Acidimicrobiaceae bacteria. See Harms et al. 2003 Environ Sci Technol 37: 343-351, for total bacteria; a Schmid et al., 2000 Syst Appl Microbiol 23:93-106, and Schmid et al., 2003 Syst Appl Microbiol 26:529-538 for anammox bacteria. For the detection of denitrifiers, AOB and AOA, denitrifying functional genes (nirS and nirk), ammonia monooxygenase structural gene (amoA) were quantified with primer sets NirS3F/NirS5R, NirK1F/NirK5R, amoA-1F/amoA-2R for AOB-amoA and Arch amoA-F/amoA-R for AOA-amoA (Braker et al., 1998 Appl Environ Microbiol 64:3769-3775; Rotthauwe et al., 1997 Environ Microbiol 9:1761-1771; Francis et al., 2005 Proc. Natl. Acad. Sci. 102:14683-14688, all of which are incorporated by reference herein as if fully set forth). Primer pairs CrenamoA23f/616r, was also used to quantify the thaumarchaeal amoA genes which represented acidophilic ammonia oxidizers (Tourna et al., 2008 *Environ Microbiol* 10: 1357-1364, which is incorporated herein by reference as if fully set forth). For DNA quantification, each qPCR mixture (20 μL) was composed of 10 μL of SYBR Premix Ex Taq® II (Takara, Japan), 0.8 μL 10 μM of each primer, and ~10 ng DNA template. RNA quantification was conducted through a real-time quantitative reverse transcription-PCR (RT-qPCR) analysis, by using the One Step SYBR® Prime-Script® RT-PCR Kit (Takara, Japan) according to the manufacturer's recommendations. Thermal cycling conditions for total 16S rDNA, nirS and AOB-amoA gene numbers was initiated for 30 s at 94° C., followed by 40 cycles of 5 s at 94° C., 30 s at 57° C., and 30 s at 70° C. 16S rDNA numbers of anammox, Acidobacteriaceae and Acidimicrobiaceae bacteria were performed at 56° C., 55° C., and 58° C. as annealing temperature respectively, with the same program. For AOB-amoA gene and thaumarchaeal amoA genes, annealing temperature was 53° C. and 55° C., and the annealing time was adjusted to 45 s. For RNA quantification, the cycling conditions were identical to those described for measuring gene numbers, with the exception that an initial incubation was conducted for 5 min at 42° C. to facilitate reverse transcriptase activity. Each assay contained a standard using a serial dilution of plasmids containing specific target genes, independent triplicate templates for each soil sample, and triplicate no template controls (NTC).

Example 9. Thermodynamic Consideration of Feammox

The change in Gibbs free energy of Equation 1 was calculated to determine the thermodynamic feasibility of the Feammox reactions using the following equation $$aA + bB \rightarrow cC + dD$$

$$\Delta G_r = \Delta G_r^0 + RT\ln\frac{(C)^c(D)^d}{(A)^a(B)^b}$$

and: $\Delta G_r^0 = c\Delta G_{fC}^0 + d\Delta G_{fD}^0 - a\Delta G_{fA}^0 - b\Delta G_{jB}^0$ R is the gas constant, which equals 0.008314 kJ mol$^{-1}$. K, and T is the absolute temperature in ° Kelvin (297.15 K). Free energies of formation were obtained from Stumm and Morgan (1996): $\Delta G_f^0$ (NH$_4^+$)=−79.37 kJ mol$^{-1}$, $\Delta G_f^0$ (NO$_2^-$)=−37.2 kJ mol$^{-1}$, $\Delta G_f^0$ (H$_2$O)=−237.18 kJ mol$^{-1}$, $\Delta G_f^0$ (Fe$^{2+}$)=−78.87 kJ mol$^{-1}$. $\Delta G_f^0$ (Fe$_2$O$_3$·0.5H$_2$O)=−711 kJ mol$^{-1}$ (Stumm and Morgan 1996 Aquatic Chemistry: Chemical Equilibria and Rates in Natural Waters (John Wiley, New York); Majzlan et al., 2004 Geochim. Cosmochim. Acta. 68, 1049-1059, which are incorporated herein by reference as if fully set forth). For biogeochemical reactions involving H$^+$, requires converting from standard condition (pH=0) to biochemical conditions: $\Delta G^{0\prime} = \Delta G^0 + m\Delta G_f^\prime$ (H$^+$), where in is the net number of H$^+$ in the reaction and $\Delta G_f^\prime$ (H$^+$) is calculated as −5.69 kJ mol$^{-1}$ per pH unit (Madigan et al., 2002 *Brock Biology of Microorganisms*, 10$^{th}$ ed. Appendix 1: energy calculations in microbial bioenergetics, which is incorporated by reference herein as if fully set fort). The chemical activity values used in the calculation are based on our incubation experiments: $C_{NH_4^+}$=2 mmol L$^{-1}$, $C_{NO_2^-}$=10 μmol L$^{-1}$, $C_{Fe^{2+}}$≤0.01 μmol L (detection limit), respectively, and pH=4.0. The dissolved Fe(II) was below the ferrozine method detection limit in the solution due to its sorption onto the Fe(III) oxides. Measurable dissolved Fe was only present in the samples extracted with 0.5 M HCl. An activity of 1 was used for the solid-phase Fe(III) oxide minerals, and water.

$$3Fe_2 \cdot O_3 \cdot 0.5H_2O + 10H^+ + NH_4^+ \rightarrow \qquad \text{(Equation 1)}$$
$$6Fe^{2+} + 8.5H_2O + NO_2^-$$

$$\Delta G_r \leq \left[6\Delta G_{fFe^{2+}}^0 + 8.5\Delta G_{fH_2O}^0 + 1\Delta G_{fNO_2^-}^0 - \right.$$
$$\left. 3\Delta G_{fFe_2O_3 \cdot 0.5H_2O}^0 - 10\Delta G_{fH^+}^0 - 1\Delta G_{fNH_4^+}^0\right] +$$
$$(0.008314 kJ \text{ mol}^{-1})(297.15K)\ln$$
$$\frac{(C_{Fe^{2+}})^6(C_{H_2O})^{8.5}(C_{NO_2^-})^1}{(C_{Fe_2O_3 \cdot 0.5H_2O})^3(C_{H^+})^{10}(C_{NH_4^+})^1}$$

$$\Delta G_r \leq [6(-78.87) + 8.5(-237.18) + 1(37.2) -$$
$$3(-711) - 10(4 \times -5.69) - 1(-79.37)]$$
$$+ (0.008314 kJ \text{ mol}^{-1})(297.15 K)\ln\frac{(10^{-8})^6(1)^{8.5}(10^{-5})^1}{(1)^3(10^{-4})^{10}(2 \times 10^{-3})^1}$$

$$\Delta G_r \leq -145.08 kJ \text{ mol}^{-1}$$

The ≤ sign is because an upper limit (detection limit) was used for the Fe(II) concentration.

Figure 10:
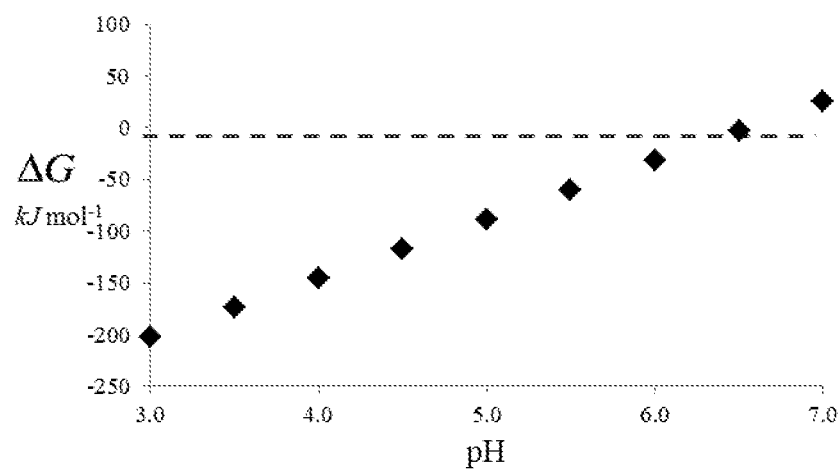
FIG. 10 illustrates a graph of $\Delta G$ vs. pH.

FIG. 10 illustrates a graph of ΔG vs. pH. Referring to this figure, pH shows that when maintaining all species concentrations constant except H$^+$, Feammox should not be feasible when the pH is above 6.5. Hence, Feammox is expected to occur in acidic environments.

Example 10. PCR Amplification, DGGE Analysis and Pyrosequencing

Bacterial universal 16S rRNA gene primer sets V3-2/V3-3 and 27f/519r were used for PCR amplification (Jensen et al., 1998; Lane, 1991, both of which are incorporated herein by reference as if fully set forth). Each 25 μL reaction mixture contained 2.5 μL 10×PCR Buffer (500 mM KCl, 25 mM MgCl$_2$, 200 mM Tris-HCl [pH 8.4], 0.1% Triton X-100), 2.0 μL 2.5 mM DNTP mixture (Takara, Japan), 0.3 μL of 10 μM V3-2 and V3-3, 0.13 μL 5U Taq polymerase, 1 μL of template DNA, and 18.77 μL sterilized ddH$_2$O. The PCR protocol was as follows: 30 s initial denaturation at 94° C.; 10 cycles with each cycle consisting of 30 s of denaturation at 94° C., 30 s of annealing at 61° C. (the temperature of anneal decreased 0.5° C. after each cycle), and 40 s extension at 72° C.; 25 cycle with each cycle included 30 s denaturation at 94° C., 30 s annealing at 55° C., and 40 s extension at 72° C.; followed by a final 5 min extension at 72° C. PCR products stained with 0.02 μL mL$^{-1}$ Genefinder were visualized on 1% (w/v) agarose gel at 120 V for 20 min, and visualized under SYNGENE Genesnap. A much higher degree of diversity was observed with primer sets V3-2/V3-3, hence its DGGE products were used for the following analysis.

After the DGGE was performed, all visible bands were excised from the gel and used as templates for re-amplification, using primer set V3-1/V3-2 (Jensen et al., 1998, which is incorporated herein by reference as if fully set forth). The PCR program was initiated with 30 s at 94° C., followed by 40 cycles of 5 s at 94° C., 30 s at annealing at 56° C., and 30 s at 70° C. The PCR products were purified using Qiaquick PCR preps (Qiagen, Valencia, CA) and cloned into a pGEM-T vector (Promega, USA). Positive recombinant clones were identified by PCR, and the PCR products were cleaned with ExoSap treatment and sequences were conducted by Genewiz, Inc., USA. Clone libraries from 12 samples resulted in 721 sequences of partial 16S rRNA gene fragments and the sequences were grouped into operational taxonomic units (OTUs) based on a 5% sequence distance cutoff calculated using the DOTUR program (Schloss and Handelsman, 2005 *Appl. Environ. Microbl.* 71, 1501-1506, which is incorporated herein by reference as if fully set forth). Six groups of bacteria were classified via a phylogenetic analysis using the Bayesian inference (BI), implemented with MrBayes version 3.1.2 (Huelsenbeck et al., 2001; Ronquist et al., 2003 *Bioinformatics.* 19, 1572-1574, which are incorporated herein by reference as if fully set forth). A best fit model of nucleotide substitution was identified using the Akaike information criterion (AIC) (Akaike, 1973) as implemented in MrModelTest 2.3 (Nylander, 2004). Bayesian analysis was carried out using GTR+I+G model selected by MrModelTest 2.3, in which model parameters were treated as unknown and estimated through the BI. The following settings were applied: implementing two Markov chain Monte Carlo (MCMC) runs, running four simultaneous Markov chains for 19 million generations, and sampling the Markov chains every 100 generations. Tracer V1.5 (Rambaut and Drummond, 2009) was used to judge convergence of the Bayesian Markov chain Monte Carlo runs. The first 10,000 sampled trees were discarded as burn-in. A consensus tree was constructed from the remaining sampled trees. Sequences obtained in this study were submitted to the GanBank database on Feb. 4, 2013, and are available therein under accession numbers KC581755-KC581779. See also Huang S and Jaffe P R, *Characterization of incubation experiments and development of an enrichment culture capable of ammonium oxidation under iron reducing conditions*, 2014, Biogensciences Discuss, 11, 12295-12321, which is incorporated herein by reference as if fully set forth. Approximately 2.5 ng of each DNA extract from samples collected from the incubation on days 0, 30, 90, 160 and from the membrane reactor after 150 days of reactor operation were used for 454 pyrosequencing analysis. To amplify a 16S rRNA gene fragment of the appropriate size and sequence variability for the 454 pyrosequencing, specific primers Bact-338F1(CC-TACG GGRGGCAGCAG) (SEQ ID NO: 2)/909R(CCGT-CAATTYHTTTRAGT) (SEQ ID NO: 3), targeting the V3-V5 region of the 16S rRNA gene of bacteria were chosen (Pinto and Raskin 2012, which is incorporated herein by reference as if fully set forth). The PCR conditions used were 94° C. for 2 min, 20 cycles of 94° C., 45 s denaturation; 55° C., 45 s annealing and 72° C., 1 min extension; followed by 72° C., 6 min. After 20 rounds of amplification, another 3 rounds of amplification were done to add the A and B adapters required for 454 pyrosequencing to specific ends of the amplified 16S rRNA fragment for library construction (Margulies et al., 2005 Nature, 437, 376-380, which is incorporated herein by reference as if fully set forth). Approximately 4 ng/μl of 16S rRNA gene fragment from each soil samples was required to construct the five libraries for 454 sequencing. Polymerase chain reaction products were cleaned using the QIAquick PCR Purification Kit (Qiagen) following the manufacturer's instructions, quantified using a Qubit Fluorometer (Invitrogen), and then sent for 454-pyrosequencing using a Roche/454 GS FLX sequencer.

A total of 19,021 partial 16S rRNA sequences were obtained from the five soil samples. The sequences were then passed through the DOTUR program to further reduce errors as outlined previously (Schloss and Handelsman, 2005, which is incorporated herein by reference as if fully set forth). Briefly, after trimming, pre-clustering, removal of chloroplast sequences and alignments, a total of 10172 sequences remained. These were clustered with the average neighbor algorithm with a 3% dissimilarity cutoff, which resulted in 1015 OTUs (Pinto and Raskin 2012, which is incorporated herein by reference as if fully set forth).

Example 11. Primer Design for Real-Time PCR Assay

Two sets of primers, acd320f (5'-CGG TCC AGA CTC CTA CGG GA-3') (SEQ ID NO: 4)-432r (5'-GAC AGG GTT TTA CAG TCC GAA GA-3') (SEQ ID NO: 5) and acm342f (5'-GCA ATG GGG GAA ACC CTG AC-3') (SEQ ID NO: 6)-439r (5'-ACC GTC AAT TTC GTC CCT GC-3') (SEQ ID NO: 7) were designed for Acidobacteriaceae bacteria A8 and Acidimicrobiaceae bacterium A6 respectively from clone libraries in this study, using an NCBI Primer-Blast program (http://www.ncbi.nlm.nih.gov/tools/primer-blast). This program did not show any putative sequences deposited in the GenBank, that amplified with the selected primers, could interfere with the experiment. The sequences of Acidobacteriaceae bacteria and Acidimicrobiaceae bacterium A6 acquired from this study did not exhibit any mismatches with the above primer sequences. Primers were then used for real-time PCR amplification in the soil samples from the incubation experiments.

Example 12. Isotope Tracer Incubations

After 270 days of operation, Feammox enrichment slurries collected form the Feammox membrane reactor were used for isotope tracer incubations. Slurries were first incubated for 20 days in 50 mL vials under anaerobic conditions. Five treatments (n=3 per treatment) were conducted as follows: (1) control treatment with only anoxic DI water; (2) $^{15}NH_4Cl$ addition; (3) $^{15}NH_4Cl+Fe(III)$; (4) $^{15}NH_4Cl$ and $C_2H_2$ addition; (5) $^{15}NH_4Cl$, $C_2H_2$ and $Fe(III)$ addition. The final concentration of $^{15}NH_4Cl$ was 1 mmol $L^{-1}$, and 5 mmol $L^{-1}$ of ferrihydrite was add as the Fe(III) source. 5 mL of pure $C_2H_2$ gas was added to the vials, which resulted in a finial $C_2H_2$ concentration of 100 μmol $L^{-1}$. Samples were then incubated anaerobically for 7 days. The headspace gas was sampled every 24 hours for $^{15}N_2O$ analysis. All these processes were conducted in an anaerobic glove box. $N_2O$ was determined by isotope ratio mass spectrometry (IRMS, Thermo Finnigan Delta V Advantage, Bremen, Germany). $^{15}N_2O$ concentration was also calculated as $^{15}N_2O$ atom % excess above its natural abundance, following methods described by Ding et al. 2014 Environ Sci Technol. 48(18): 10641-7, which is incorporated herein by reference as if fully set forth. $^{15}N_2O$ production rates were calculated from the linear change in $^{15}N_2$ concentrations in the vial headspace between two given time points.

Example 13. Change in Fe and N Species Under Different Operational Conditions

Figure 1B:
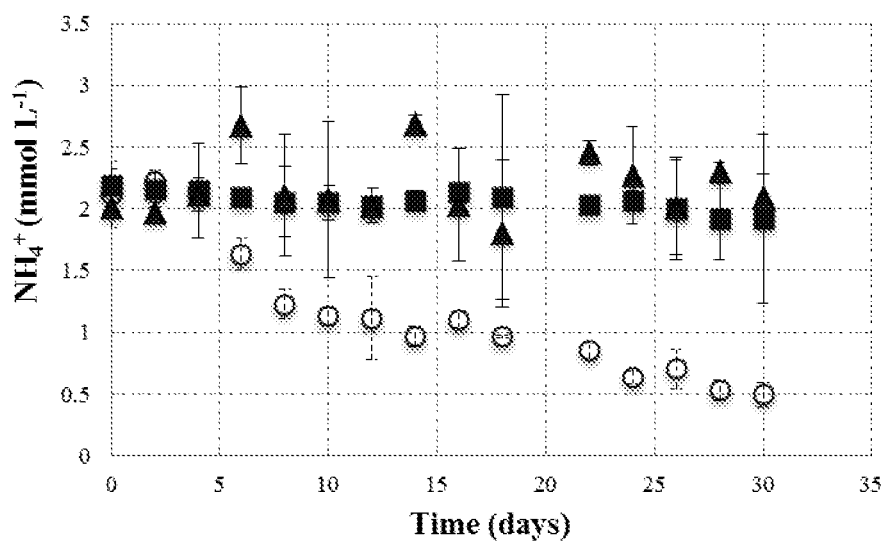
Figure 2A:
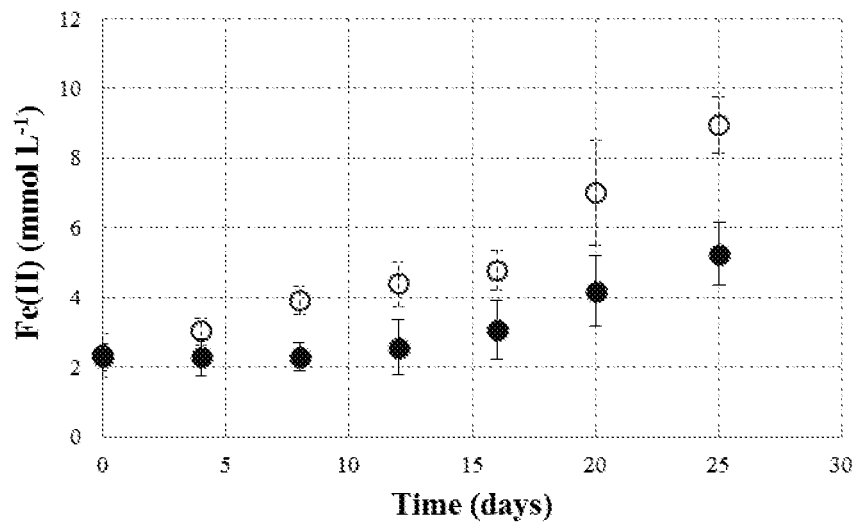
FIGS. 2A-2B illustrate concentration of Fe(II) (FIG. 2A) and $NH_4^+$ (FIG. 2B) in 25-day incubation with $NH_4Cl$ and ferrihydrite (open circle), $NH_4Cl$ and goethite (closed circle).
Figure 2B:
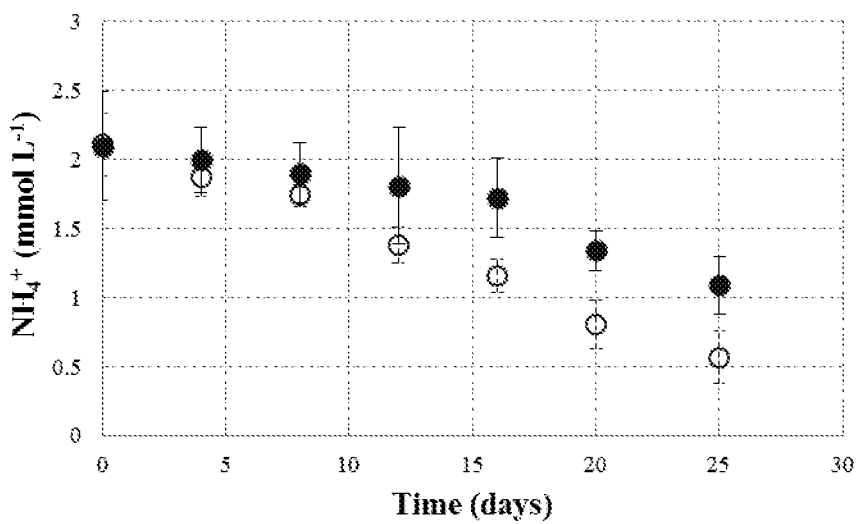
Figure 3A:
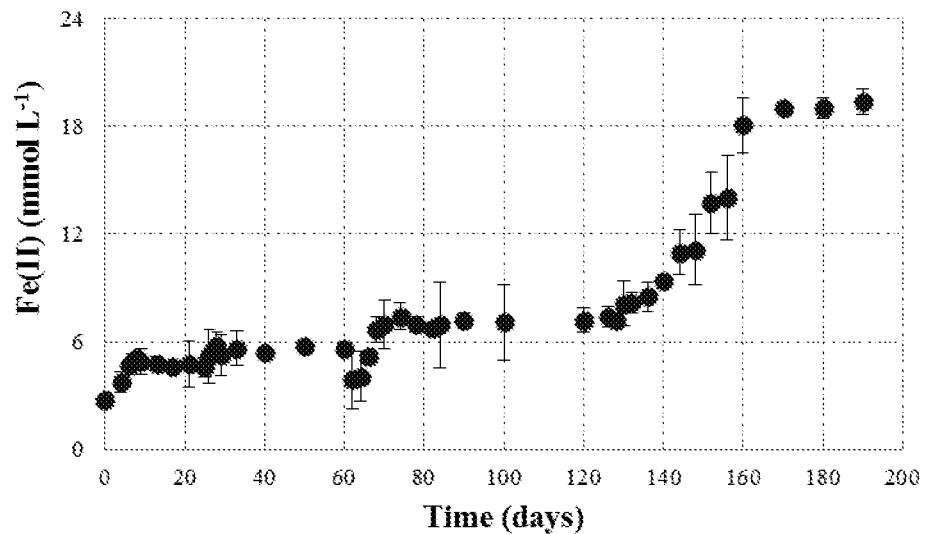
FIGS. 3A-3B illustrate concentration of Fe(II) (FIG. 3A) and $NH_4^+$ (FIG. 3B) during the 180 day incubation.
Figure 3B:
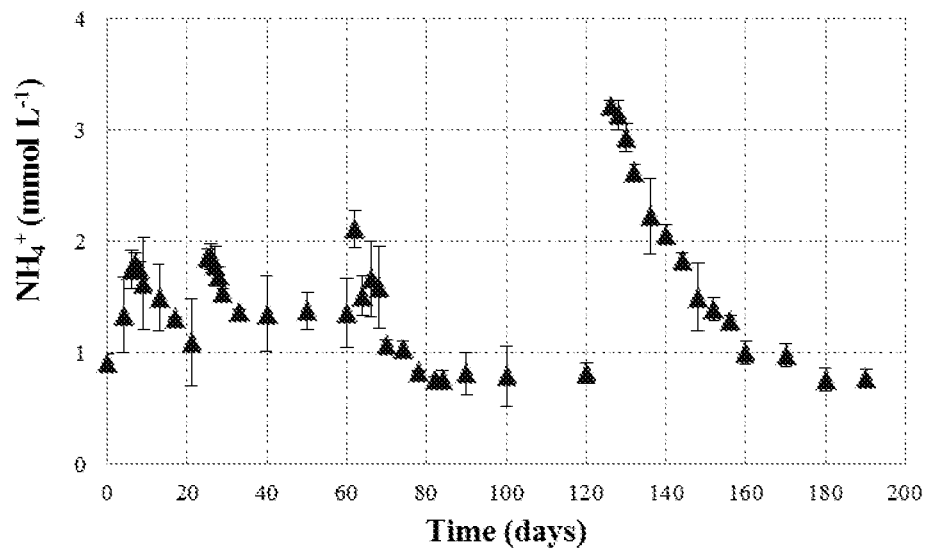
Figure 4A:
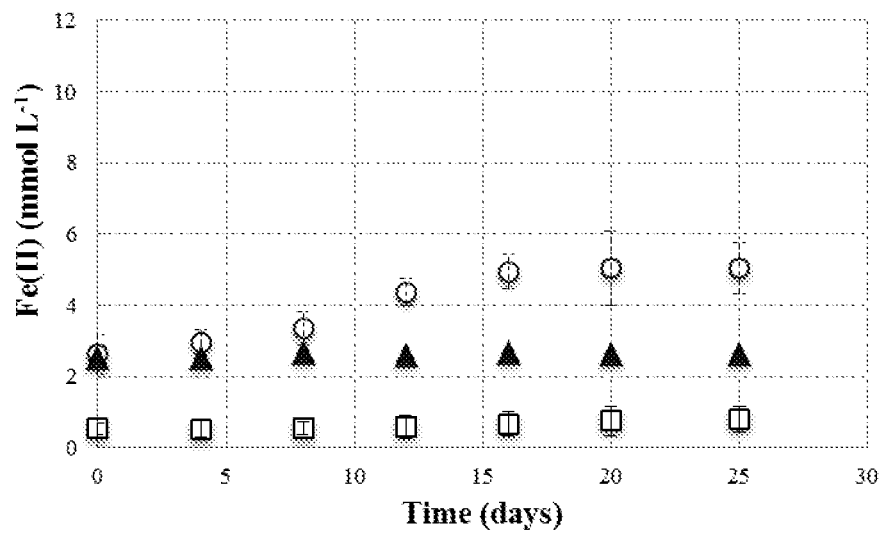
FIGS. 4A-4B illustrate concentration of Fe(II) (FIG. 4A) and $NH_4^+$ (FIG. 4B) in 25-day incubations in samples with $NH_4Cl$ (open square), ferrihydrite (open circle), sterilized soil with $NH_4Cl$ and ferrihydrite (closed triangle).
Figure 4B:
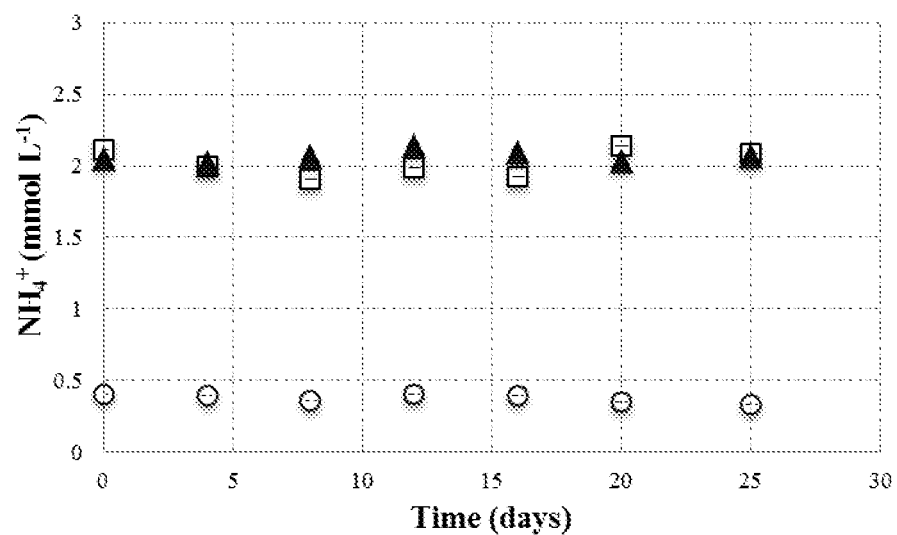

Batch incubation experiments were conducted. Batches included soil slurry included with three different Fe(III) sources. FIGS. 1A-1B illustrate concentration of Fe(II) (FIG. 1A) and $NH_4^+$ (FIG. 1B) in incubation with three different Fe(III) sources: ferrihydrite (open circle), ferric chloride (closed square), and ferric citrate (closed triangle). Referring to these figures, the values represent the mean and standard error (n=3). After incubating the pre-treated soil slurry with the three different Fe(III) sources for 30 days, only samples to which either ferrihydrite or goethite had been added showed measurable $NH_4^+$ oxidation. Referring to FIGS. 1A-1B, in samples incubated with ferric citrate and $NH_4Cl$, Fe(III) reduction was much faster than in those supplied with Fe(III) oxides, but the $NH_4^+$ concentration remained fairly constant. FIGS. 2A-2B illustrate concentration of Fe(II) (FIG. 2A) and $NH_4^+$ (FIG. 2B) in 25-day incubation with $NH_4Cl$ and ferrihydrite (open circle), $NH_4Cl$ and goethite (closed circle). The values represent the mean and standard error (n=3). FIGS. 3A-3B illustrate concentration of Fe(II) (FIG. 3A) and $NH_4^+$ (FIG. 3B) during the 180 day incubation. 25 mmol $L^{-1}$ Fe(III) was added on day 0. 1.0 mmol $L^{-1}$ $NH_4^+$ was added on days 4, 24, and 60. 0.2 mmol $L^{-1}$ $NaHCO_3$ was added on day 50 and day 90. 1.2 mmol $L^{-1}$+2 mmol $L^{-1}$ of $NH_4Cl$ were added on day 125. The values represent the mean and standard error (n=3). FIGS. 4A-4B illustrate concentration of Fe(II) (FIG. 4A) and $NH_4^+$ (FIG. 4B) in 25-day incubations in samples with $NH_4Cl$ (open square), ferrihydrite (open circle), sterilized soil with $NH_4Cl$ and ferrihydrite (closed triangle). Referring to these figures, the values represent the mean and standard error (n=3). Still referring to FIGS. 4A-4B, no detectable Fe(II) reduction or $NH_4^+$ oxidation was found in the sterilized soils amended with ferrihydrite and $NH_4Cl$. Referring to FIGS. 2A-2B, faster iron reduction and $NH_4^+$ removal was observed in ferrihydrite than in goethite-amended sediments.

Figure 9:
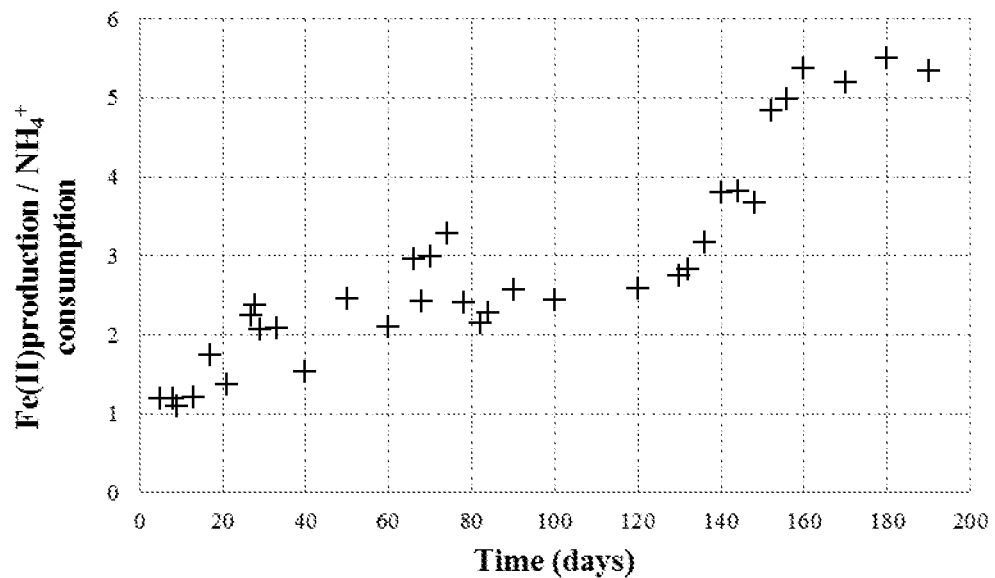
FIG. 9 illustrates stoichiometry between the Fe(II) production and $NH_4^+$ consumption during 180 day incubation.

Since samples incubated with ferrihydrite and $NH_4Cl$ resulted in the fastest $NH_4^+$ oxidation, the anaerobic incubation with ferrihydrite was extended to 180 days. Ferrihydrite as the Fe(III) source results in a larger negative ΔG value than goethite. The $NH_4^+$ oxidation rate increased as $NH_4Cl$ was supplied repeatedly, especially after 125 days of incubation when the $NaHCO_3$ additions were increased from 0.20 to 1.20 mmol $L^{-1}$ in addition to the 2.00 mmol $L^{-1}$ $NH_4^+$ added. Referring to FIGS. 4A-4B, the increased NaHCO$_3$ dosing also increased the generation of Fe(II). FIG. 9 illustrates stoichiometry between the Fe(II) production and NH$_4^+$ consumption during 180 day incubation. Referring to FIG. 9, 25 mmol L$^{-1}$ Fe(III) was added on day 0; 1.0 mmol L$^{-1}$ NH$_4^+$ was added on days 4, 24, and 60; 0.2 mmol L$^{-1}$ NaHCO$_3$ was added on day 50 and day 90 of the incubation. 1.20 mmol L$^{-1}$+2 mmol L$^{-1}$ of NH$_4$Cl were added on day 125. The values represent the mean ratio (n=3). During the 180-day incubation, the ratio of Fe(II) produced to NH$_4^+$ removed gradually increased until it reached 5.3:1 by day 160 after which it remained stable.

Figure 5A:
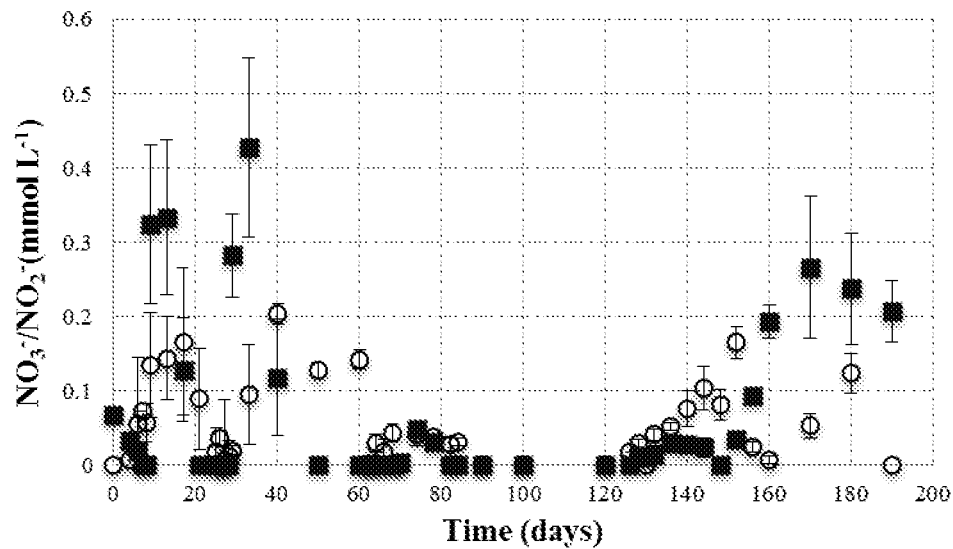
FIGS. 5A-5B illustrate concentration of $NO_3^-$ (open circle) and $NO_2^-$ (closed square) (FIG. 5A) and DOC (open triangle) and TN (open square) (FIG. 5B) during the 180 day incubation.
Figure 5B:
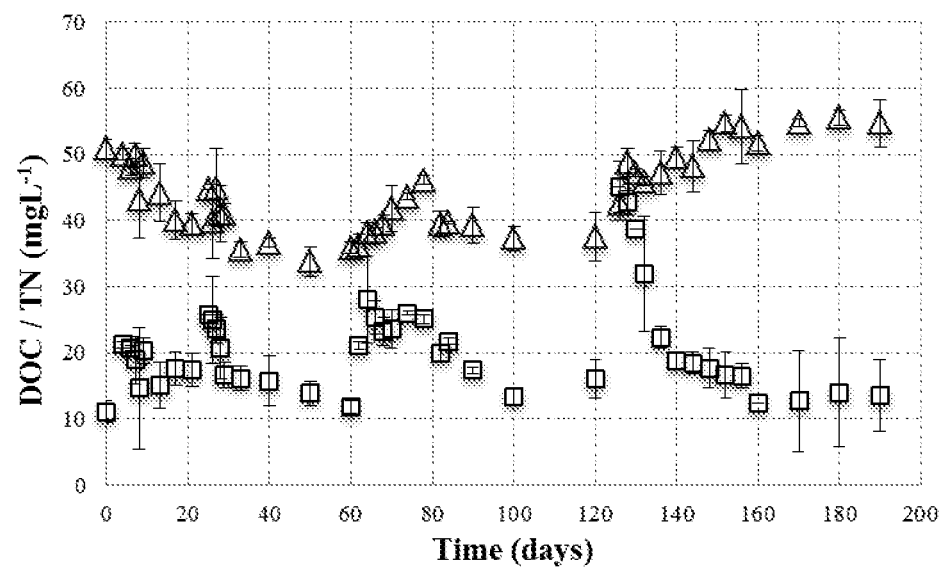

FIGS. 5A-5B illustrate concentration of NO$_3^-$ (open circle) and NO$_2^-$ (closed square) (FIG. 5A) and DOC (open triangle) and TN (open square) (FIG. 5B) during the 180 day incubation. Referring to these figures, 25 mmol L$^{-1}$ Fe(III) was added on day 0. 1.0 mmol L$^{-1}$ NH$_4^+$ was added on days 4, 24, and 60. 0.2 mmol L$^{-1}$ NaHCO$_3$ was added on day 50 and day 90 of the incubation; 1.20 mmol L$^{-1}$+2 mmol L$^{-1}$ of NH$_4$Cl were added on day 125. The values represent the mean and standard error (n=3).

Referring to FIGS. 5A-5B, NO$_2^-$ appeared within a few days after the addition of NH$_4^+$, with a maximum concentration 0.44±0.17 mmol L$^{-1}$ in the second NH$_4^+$ oxidation cycle. Referring to FIG. 5A, NO$_2^-$ did not accumulate in the system and was immediately consumed after generation. Referring to FIGS. 5A-5B, NO$_3^-$ production showed a similar pattern to that of NO$_2^-$ (FIG. 5A), and TN loss similar to the decrease in NH$_4^+$ (FIG. 5B). During 180 days of incubation, the system experienced a loss of TN of 57.2±3.13 mg L$^{-1}$. Referring to FIG. 5B, the DOC content fluctuated slightly in the early stage of incubation, but overall, the DOC concentration was relatively stable at around 45~50 mg L$^{-1}$.

A 64.5% NH$_4^+$ removal, between inflow and outflow was achieved in the membrane reactor after 150-days of operation.

Figure 6:
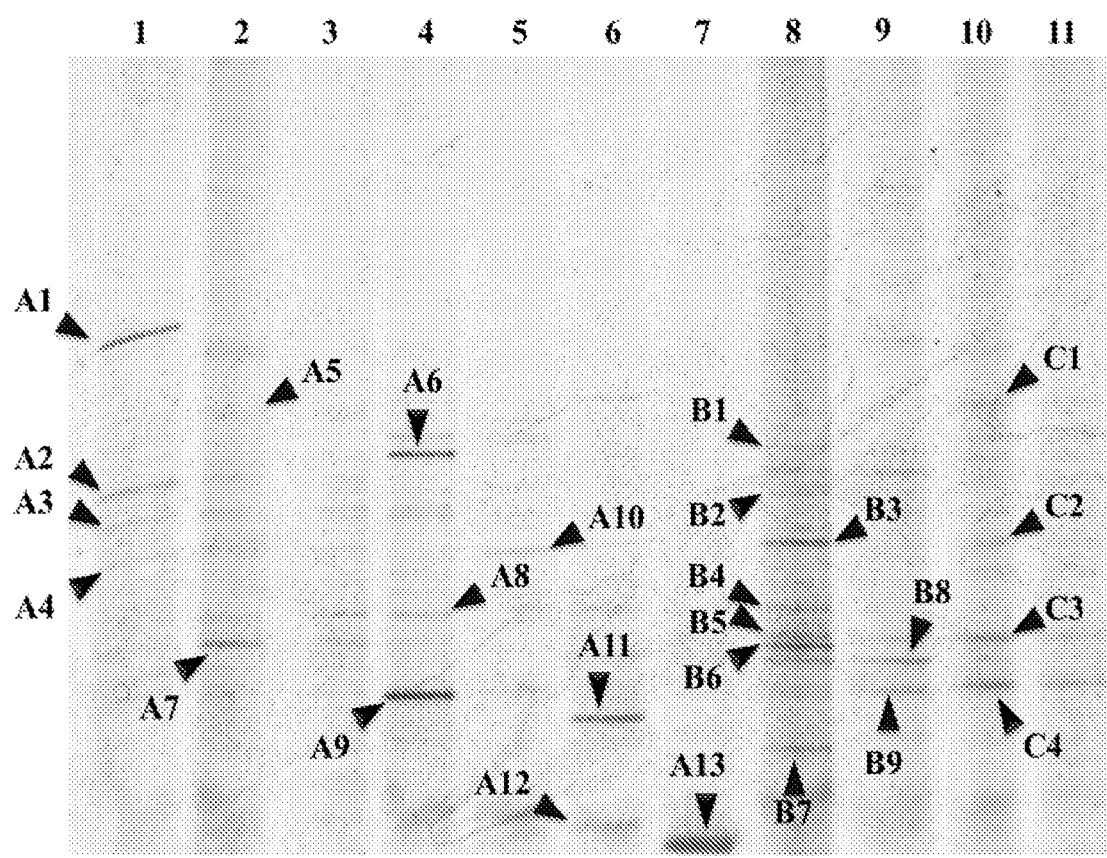
FIG. 6 illustrates comparison of DGGE analysis profiles of soil communities during anaerobic incubations.

Example 14. Phylogenetic Analysis of the Microbial Community Based on 16S rRNA Gene FIG. 6 illustrates comparison of denaturing gradient gel electrophoresis (DGGE) analysis profiles of soil communities during anaerobic incubations. Samples from 0, 30, 90 and 160 days of incubation with ferrihydrite+NH$_4$Cl+ NaHCO$_3$ (lane 1-4); 160 days of incubation with only ferrihydrite (lane 5); ferric chloride+NH$_4$Cl (lane 6); ferric citrate+NH$_4$Cl (lane 7); 120 days incubation with ferrihydrite+NH$_4$Cl+ NaHCO$_3$+ organic carbon (band 8); ferrihydrite+NH$_4$Cl+ organic carbon (lane 9). Still referring to FIG. 6, samples from 6 and 120 days of incubation without any addition (lanes 10 and 11) were used as controls.

Still referring to FIG. 6, all visible bands observed in the DGGE analysis (significant bands were marked) were excised from the gel and sequenced after cloning. Clone libraries from 12 samples resulted in 721 sequences of partial 16S rRNA gene fragments, and six groups of bacteria were classified via a phylogenetic analysis. During this 180-day anaerobic incubation with ferrihydrite and NH$_4$Cl, the microbial communities shifted dramatically and the microbial diversity decreased with time. See FIG. 6, lanes 1-4. Some DGGE bands disappeared gradually with time, such as band A5 and band A7. Band A5, represents a dissimilatory iron-reducing bacteria, *Geobacter* sp., which existed in this Fe(III)-rich wetland soil and reappeared for a short time during the initial anaerobic incubation. Band A7, represents an ammonia-oxidizing bacterium, *Nitrosomonas* sp., which showed a strong presence in the samples at 30 days of incubation and was attenuated after longer incubation times. In contrast, DGGE bands A6, A8 and A9 became more significant as the incubation time increased, showing that there were three groups of bacteria dominating in the system after 160 days of incubation. Band A6 represents a group of bacteria belonging to the Acidimicrobiaceae family. Bacteria from the Acidobacteriaceae family are represented by band A8. Some species in this family have been described as iron reducers and obligate heterotrophs (Kishimoto et al, 1991 Water Res 41: 2996-3004; Rowe et al., 2007 Environ Microbiol 9:1761-1771; Coupland and Johnson, 2008 FEMS Microbiol Lett 279:30-35). DGGE band A9 represents bacteria of the Rhodocyclaceae family. This family contains mainly denitrifying bacteria, which exhibit very versatile metabolic capabilities (Smith et al, 2005 Water Res 39: 2014-2023; Huang et al., 2011 Biogeosciences 8: 5251-5280).

Microbial communities also differed between samples incubated with various Fe(III) sources, and between samples with or without the addition of inorganic carbon. Samples supplied with either ferric chloride or ferric citrate as the Fe(III) source plus NH$_4^+$, and samples supplied with just ferrihydrite and no NH$_4^+$, had a decreased diversity in their bacterial communities. See FIG. 6, lanes 5-7. Samples supplied with both organic carbon (1.00 mmol L$^{-1}$ sodium citrate) and inorganic carbon (1.20 mmol L$^{-1}$ NaHCO$_3$) had a higher bacterial diversity. See FIG. 6, lane 8.

Changes in the microbial community after 180 days of incubation were also confirmed via 454-pyrosequencing, and the obvious growth of Actinobacteria, Acidobacteria and β-Proteobacteria groups (which band A6, A8 and A9 belong to) was consistent with the DGGE results, where the Actinobacteria cell number increased the most. Planctomycetes phylum, with which anammox bacteria are affiliated, was detected in the first 90 days of incubation, but disappeared or was below detection on day 160. Actinobacteria were also the dominant species in the Feammox enrichment reactor based on the results of the 16S rDNA library obtained via pyrosequencing.

The Acidimicrobiaceae bacterium, represented by band A6, which belongs to the Actinobacteria phylum, was the dominant species in the incubation experiments after 180 days of incubation (14.8% in total 16S rRNA gene sequences) as well as in the membrane reactor after 150 days of operation (40.2% in total 16S rRNA gene sequences). Its similarity to other Acidimicrobiaceae-related sequences was shown using a phylogenetic tree. The tree was constructed using the Bayesian inference (BI) method with 16S rRNA gene sequences from DGGE band A6 and bacteria from the Acidimicrobiaceae family from other studies. Unlike the bacteria represented by band A8 and A9, which were also found in samples that did not show Feammox transformations, this Acidimicrobiaceae bacterium was only detected in incubations (or reactor) that were augmented simultaneously with ferrihydrite, NH$_4$Cl, and NaHCO$_3$ and have shown Feammox activity.

Figure 7:
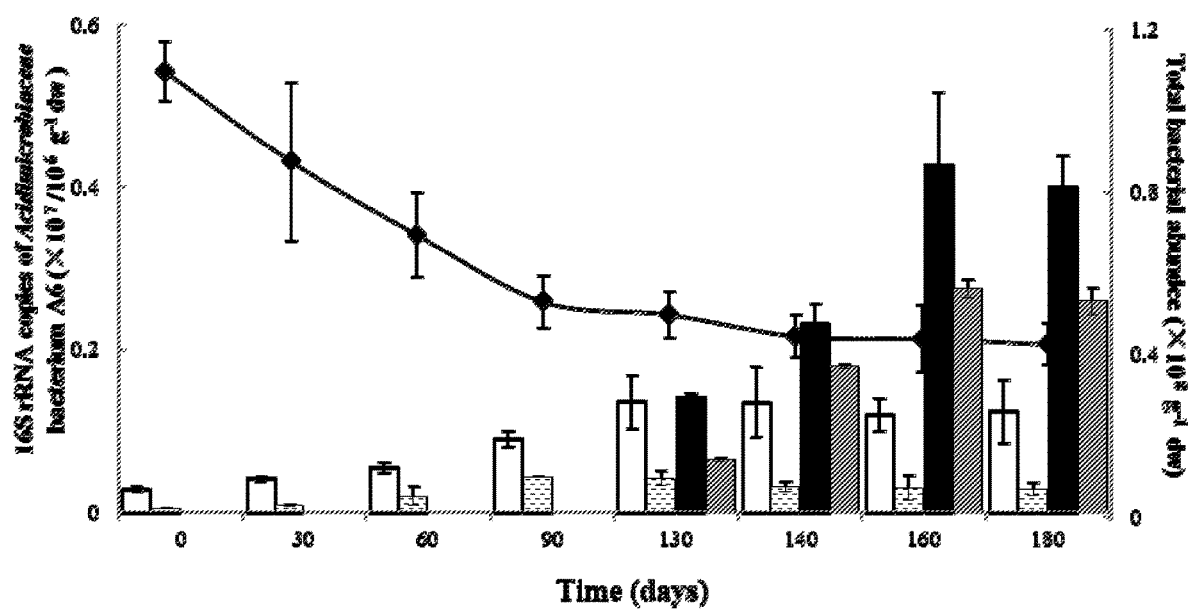
FIG. 7 illustrates abundance of total bacteria (closed rhombus) during 180 days of anaerobic incubation, 16S rRNA gene (black bars) and RNA copy numbers (gray bars) of Acidimicrobiaceae bacterium A6 in soil samples with 1.20 mmol $L^{-1}$ $NaHCO_3$ addition, 16S rRNA gene (white bars) and RNA copy numbers (dotted bars) of bacterium A6 with 0.20 mmol $L^{-1}$ $NaHCO_3$ addition.

Example 15. Changes of Bacterial Abundance and Activity During Incubations and in the Reactor The total bacterial abundance determined via the 16S rRNA gene copy number, decreased during the 180-day incubation. FIG. 7 illustrates abundance of total bacteria (closed rhombus) during 180 days of anaerobic incubation. 16S rRNA gene (black bars) and RNA copy numbers (gray bars) of Acidimicrobiaceae bacterium A6 in soil samples with 1.20 mmol L$^{-1}$ NaHCO$_3$ addition. 16S rRNA gene (white bars) and RNA copy numbers (dotted bars) of bacterium A6 with 0.20 mmol $L^{-1}$ $NaHCO_3$ addition. Referring to FIG. 7, both, 16S rRNA gene and rRNA fragment copies of Acidimicrobiaceae bacteria (DGGE band A6) increased during the incubation, particularly after 90 days. Still referring to FIG. 7, the rRNA numbers increased slowly during the first 3 months and doubled between day 130 and day 140 of the incubation period. rRNA as a biomarker for changes of protein level, even though not as specific as mRNA, is a good indicator for bacterial activity (Poulsen et al., 1993 Appl Environ Microbiol 59: 1354-1360; Park et al., 2010 Environ Sci Technol 44: 6110-6116), both of which are incorporated by reference herein as if fully set forth. Increase in the denitrifier activity was most likely stimulated by the $NO_2^-$ generated via Feammox. The number of the amoA gene, representing the abundance of ammonia-oxidizing bacteria, decreased sharply with time and was hardly detected after 90 days of incubation. Through quantification of thaumarchaeal amoA genes, none of the acidophilic ammonia oxidizers were detected in the system.

In the Feammox reactor, the copy number of Acidimicrobiaceae bacterium A6, Anammox bacteria and nirS gene were $0.37 \times 10^7$, $0.13 \times 10^6$, and $0.92 \times 10^6$ copies $g^{-1}$ dw, respectively, while the amoA gene was not detected.

Example 16. Changes of Bacterial Abundance and Activities with $NaHCO_3$ Amendment Abundance and activity of Acidimicrobiaceae bacteria, represented by band A6, were compared between samples incubated under the same conditions except the amounts of $NaHCO_3$ added (0.20 mmol $L^{-1}$ vs. 1.20 mmol $L^{-1}$). From day 125 to day 180 of the incubation, both 16S rRNA gene and rRNA fragment numbers of Acidimicrobiaceae bacteria were higher in the soils with the higher inorganic carbon content. Referring to FIG. 7, the 16S rRNA gene copies of samples augmented with 1.20 mmol $L^{-1}$ $NaHCO_3$ were four times higher than those in samples that had been augmented with only 0.20 mmol $L^{-1}$ $NaHCO_3$. The rRNA copies of the Acidimicrobiaceae bacteria, showed even larger differences in response to the amounts of $NaHCO_3$ added. In the samples augmented with 1.20 mmol $L^{-1}$ $NaHCO_3$, the rRNA copy number increased from $0.04 \pm 0.06 \times 10^6$ to $0.19 \pm 0.09 \times 10^6$ copies $g^{-1}$ dw over 50 days of incubation (day 130 to day 180). Still referring to FIG. 7, however, in the samples to which only 0.2 mmol $L^{-1}$ $NaHCO_3$ were added on day 125, the rRNA number gradually deceased from $0.29 \pm 0.10 \times 10^5$ to $0.19 \pm 0.05 \times 10^5$ copies $g^{-1}$ dw during the same 50 days incubation.

Figure 8A:
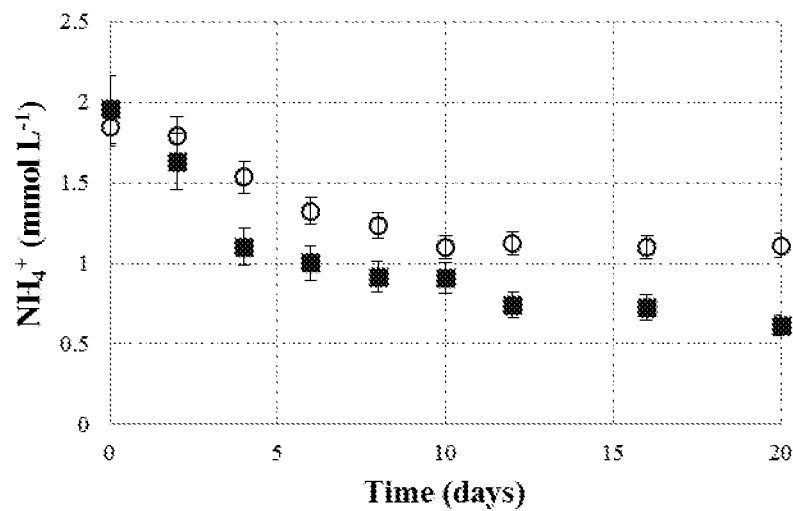
FIGS. 8A-8D illustrate concentration of $NH_4^+$ (FIG. 8A), $NO_2^-$ (FIG. 8B), $NO_3^-$ (FIG. 8C), and $N_2O$ (FIG. 8D) in the samples incubated with (open circle) or without (closed square) $C_2H_2$.
Figure 8B:
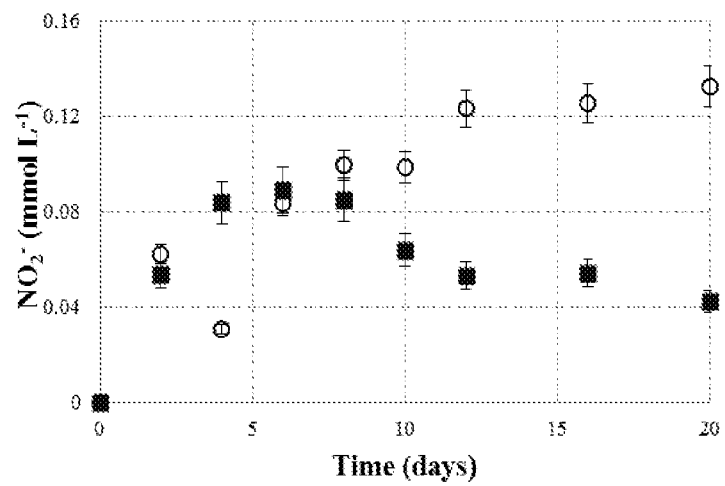
Figure 8C:
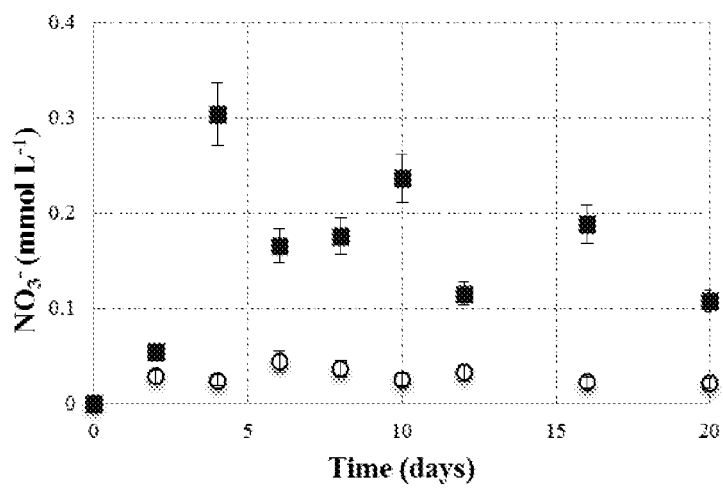
Figure 8D:
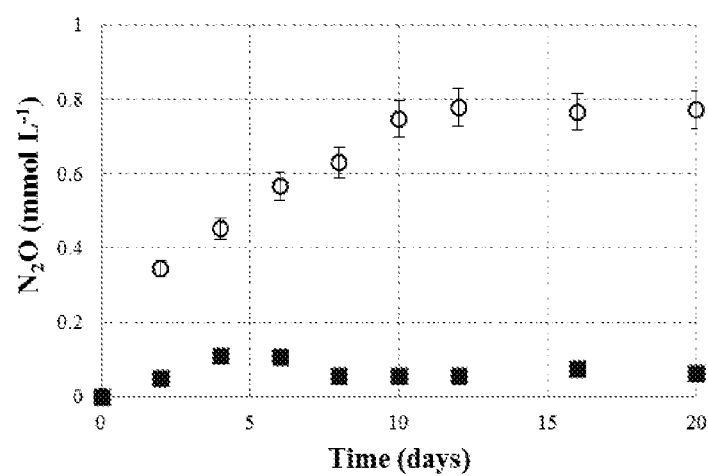

Example 17. Nitrogen Species Changes in Samples Incubated in the Presence of $C_2H_2$ $C_2H_2$ can inhibit the oxidation of $NH_4^+$ to $NO_2^-$ under aerobic conditions, and the reduction of $N_2O$ to $N_2$ as well as the anammox pathway under anaerobic conditions (Yoshinari et al., 1977 Soil Biol Biochem 9: 177-183; Jensen et al., 2007 FEMS Microbiol Ecol 26: 17-26; Kartal et al., 2011 Nature 479:127-130, all of which are incorporated by reference herein as if fully set forth). To gain further insights into the nitrogen removal process observed, incubations with $C_2H_2$ were conducted. FIGS. 8A-8D illustrate concentration of $NH_4^+$ (FIG. 8A), $NO_2^-$ (FIG. 8B), $NO_3^-$ (FIG. 8C), and $N_2O$ (FIG. 8D) in the samples incubated with (open circle) or without (closed square) $C_2H_2$. The values represent the mean and standard error (n=3). After 20 days of incubation, less $NH_4^+$ was oxidized in the samples amended with $C_2H_2$, compared to those incubated without $C_2H_2$. Referring to FIG. 8A, $NO_2^-$, which is postulated to be the direct product of the $NH_4^+$ oxidation, accumulated slowly in samples incubated with $C_2H_2$. Referring to FIG. 8B, $NO_3^-$ reached a higher concentration in samples without $C_2H_2$ than in samples incubated with $C_2H_2$. Referring to FIG. 8C, $N_2O$, a product of $NO_2^-$ reduction, accumulated in samples incubated with $C_2H_2$, which inhibits the reduction of $N_2O$ to $N_2$. Fe(II) production was not much affected by the presence of $C_2H_2$, and after 20 days incubation was $4.36 \pm 0.72$ and $5.71 \pm 0.67$ mmol $L^{-1}$ in sample incubated with and without $C_2H_2$, respectively.

In $^{15}N$ isotope tracer incubations, detectable $^{15}N$—$N_2O$ was only found in samples amended with both, $^{15}NH_4Cl$ and Fe(III), with $^{15}N$—$N_2O$ production rates $2.14 \pm 0.059$ or $0.072 \pm 0.023$ µg $g^{-1}$ $d^{-1}$ in samples incubated with or without $C_2H_2$ treatment.

Referring to FIG. 6, DGGE band A5 represents dissimilatory iron-reducing bacteria, which appeared for a short time at the beginning of the anaerobic incubation. For longer incubation times these heterotrophic bacteria decreased rapidly. Referring to FIG. 2A and FIG. 4A, over a 25 day incubation period, more than three times the mass of Fe(II) was produced in samples amended with ferrihydrite and $NH_4^+$ as compared to the samples amended only with ferrihydrite, indicating that most of the Fe(III) reduction came from the Feammox reaction, and not from dissimilatory Fe(III) reduction.

Referring to FIG. 6, AOB represented by DGGE band A7, as well as the amoA gene, decreased after 30 days of incubation. Also, no AOA or acidophilic ammonia oxidizers were detected although the pH condition seems suitable for them in these incubations. Oxygen deficiency was the most likely reason for the decline in AOB in this system over time (Laanbroek et al., 1994 rch Microbiol 161:156-162). Referring to FIGS. 4A-4B, even though a small amount of AOB would be enough for $NH_4^+$ oxidation, in control samples to which no Fe(III) was added, and which AOB do not require, no $NH_4^+$ consumption was detected. Moreover, the decrease in amoA gene at a time of increasing $NH_4^+$ oxidation also indicates that neither AOB nor acidophilic ammonia oxidizers were the drivers of the $NH_4^+$ oxidation in the later incubation times.

An uncultured Acidimicrobiaceae bacterium became the dominant species during the 180-day anaerobic incubation period, increasing from 0.92% on day 0 in terms of cell numbers to 14.8% on day 160. Referring to FIGS. 1A-1B, FIGS. 2A-2B, and FIG. 6, in the incubation experiments conducted (which included controls with only $NH_4^+$, only iron, autoclaved, and various Fe(III) sources), this Acidimicrobiaceae bacterium was only detected and growing in samples to which $NH_4^+$ was supplied as an electron donor, ferrihydrite was supplied as electron acceptor, and $NaHCO_3$ was supplied as a carbon source. The abundance and activity of this Acidimicrobiaceae bacterium increased along with the Feammox activity during the incubations. Referring to FIG. 7, during the incubation period its rRNA changed from $(0.22 \pm 0.01) \times 10^5$ copies $g^{-1}$ dw to $(0.28 \pm 0.07) \times 10^6$ copies $g^{-1}$ dw, indicating a substantial increase in its activity. In the continuous flow membrane reactor, which had a high $NH_4^+$ removal and Fe(III) reduction rate, this Acidimicrobiaceae bacterium was enriched from an initial 14.8% to 40.2% after 150 days operation, and no other known $NH_4^+$ oxidizers (AOB or anammox) were detected. These results indicated that this Acidimicrobiaceae bacterium might play an important role in the Feammox reactions described in this study. According to a phylogenetic analysis, this bacterium has a 92% identity with *Ferrimicrobium acidiphilum* sp. *F. acidiphilum*, which belongs to the Acidimicrobiaceae family, and was first isolated from mine environments, and *F. acidiphilum* strain T23 is the only pure strain with a comprehensive characterization. Uncultured *Ferrimicrobium* sp. has been detected in mine water, but so far not in wetland soils. *Ferrimicrobium* sp. is an acidophilic heterotrophic ferrous iron oxidizing bacterium, which can also reduce Fe(III) under anoxic conditions (Johnson et al., 2009). The uncultured Acidimicrobiaceae bacterium, also has a 90% identity with *Acidimicrobium ferrooxidans*, a facultative autotroph in the same family that can reduce Fe(III) in anaerobic environments while oxidizing sulfide to sulfur and exists widely in soil environments.

According to a phylogenetic comparison with similar clones from studies reported in the GenBank, and taking into account its special growth characteristics (stimulated by inorganic carbon, oxidizing $NH_4^+$ coupled to Fe(III) reduction), also its gradual activity increase with increased Feammox activity, as well as a strong link with a Feammox enrichment reactor, this uncultured Acidimicrobiaceae bacterium A6 is probably a previously unreported species in the Acidimicrobiaceae family that might be either responsible or play a key role in the Feammox process described here. Referring to FIGS. 3A-3B and FIG. 7, Acidimicrobiaceae bacterium A6 was more active and the Feammox pathway was faster in samples with higher $NaHCO_3$ amendments, which, in addition to the fact that $\Delta G$ in Equation 1 is negative, indicates that if this Acidimicrobiaceae bacterium is actually responsible for conducting the Feammox reaction as depicted in equation 1, it may be an autotroph. Growth of nirS gene suggested that denitrification pathways were also active in the incubations described here. $NO_2^-$ that was being produced during the anaerobic $NH_4^+$ oxidation was reduced to $N_2$ by denitrifiers, and $NO_2^-$ did not accumulate in the system.

Referring to FIGS. 1A-1B and FIGS. 2A-2B, the Feammox reaction studied here proceeded only when iron oxides (ferrihydrite or goethite) were supplied as electron acceptor, whereas samples incubated with ferric chloride or ferric citrate as the Fe(III) source showed no measurable $NH_4^+$ oxidation. In the incubations to which ferric citrate was added as the Fe(III) source, Fe(III) was reduced rapidly by dissimilatory iron reducers, using organic carbon as electron donor. Referring to FIG. 6, the DGGE results for incubations with ferric citrate (lane 7) show that the most dominant species was an *Actinobacterium*, known to reduce iron under anaerobic conditions. Acidimicrobiaceae bacterium A6 was not detected in these incubations. Since acidic conditions as well as minimal dissolved Fe(II) and $NO_2^-$ concentrations are required to make the Feammox reaction energetically favorable as shown in Equation 1, the presence of iron oxides as the main Fe(III) source may have helped to maintain the concentrations of Fe(II) in solution below the detection limit through the incubation since iron oxides can sorb Fe(II) and/or incorporate it into their structure.

Various $NH_4^+$ oxidation products, i.e. $NO_3^-$, $NO_2^-$ and $N_2$, generated through the Feammox process are thermodynamically feasible, and were reported in different Feammox studies (Sawayama, 2006; Shrestha et al., 2009; Yang et al., 2012, which are incorporated by reference herein as if fully set forth). Because there was no initial nitrate or nitrite in the system, because all experiments were conducted under strict oxygen free conditions, and because of the rapid decrease of amoA genes, neither $NO_3^-$ reduction nor aerobic $NH_4^+$ oxidation could be the reason for the formation of $NO_2^-$ during the incubations. In all incubations where $NH_4^+$ was removed, the production of $NO_2^-$ was observed, although $NO_2^-$ did not accumulate. Most of the $NO_2^-$ produced from the $NH_4^+$ oxidation was reduced rapidly by denitrifiers, which were present in the incubations.

When $C_2H_2$ was used to stop the reduction of $N_2O$ to $N_2$, the total $N_2O$ (0.72±0.23 mmol $L^{-1}$) plus $NO_2^-$ produced (0.13±0.07 mmol $L^{-1}$) was equal to the $NH_4^+$ consumed, showing that $NH_4^+$ was not oxidized directly to $N_2$ in the samples. $^{15}N$—$NH_4^+$ incubations, as an extension of $C_2H_2$ treatment, showed that $^{15}N$—$N_2O$ built up when $^{15}NH_4Cl$ was added as the $NH_4^+$ source, demonstrating that $NH_4^+$ was oxidized during the Feammox process rather than be adsorbed or taken uptake by microorganisms in the system.

Although nitrification might happen in suboxic environments (oxygen<5 μM, Lam et al., 2007), $NH_4^+$ oxidation in the presence of $C_2H_2$ has never been reported. $C_2H_2$ is an inhibitor of ammonia monooxygenase (AMO), and can restrain aerobic $NH_4^+$ oxidizers from using oxygen by binding covalently to AMO (Hynes and Knowles, 1982; Hyman and Wood, 1985; Gilch et al., 2009). $C_2H_2$ can also inhibit the $NH_4^+$-activation step of anammox cells, which use $NO_2^-$ as the oxidant (Kartal et al., 2011). Therefore these Feammox bacteria might differ from common $NH_4^+$ oxidizers, by using an alternative $NH_4^+$ oxidation pathway that is not inhibited by $C_2H_2$, and AMO might not play a role in Feammox. The fact that $NH_4^+$ oxidation was not affected by the presence of acetylene is a further indication that AOB are not responsible for this process since they would be affected by acetylene. Furthermore, in the isotope tracer incubations, $^{15}N$—$N_2O$ was below the detection limit in samples to which Fe(III) was not supplied, showing again that $NH_4^+$ oxidation proceeded only when iron was being reduced.

Referring to FIG. 9, the role of anammox during the incubations was also evaluated. During the incubations the ratio of $NH_4^+$ oxidized to Fe(III) reduced increased gradually from 1:1.9 to 1:5.3, which is close to the stoichiometry of 1:6, shown in Equation 1. Although the discrepancies in the Feammox stoichiometry between iron and $NH_4^+$ are attributed in part to incompletely Fe(II) extraction, the influence of anammox activity in the earlier incubations would have contributed to a lower Fe(II) produced to $NH_4^+$ removed ratio than the theoretical value of 1:6.

The Feammox reaction became more dominant in terms of $NH_4^+$ oxidation after 125 days of incubation due to a relative increase in the activity of the Feammox bacteria. A parallel pathway to Feammox, such as anammox, could as mentioned above, explain the lower stoichiometric ratio, especially at earlier incubation times. In the samples taken before the incubation, 0.17±0.05×10$^6$ copies g$^{-1}$ dw of anammox rRNA gene were found, which decreased to 0.09±0.06×10$^5$ on day 130. It was postulated that anammox was responsible for some initial $NH_4^+$ and $NO_2^-$ removal, and denitrification became more dominant for $NO_2^-$ removal later during the incubation period. $NH_4^+$ removal via Anammox in the early incubations may also explain why the observed $NH_4^+$ oxidation rates and the abundance of Acidimicrobiaceae A6 did not change proportionally over the full incubation period.

Example 18. Influence of Environmental Factors on Feammox Pathway in Soil Environments Sample collection. Soils for all the experiments described in this study were taken from a series of local wetland-, upland-, as well as storm-water detention pond-sediment at New Jersey and labeled according to the samples location as L, A, P, C, B, V and W. Three soil cores were collected from 0 cm to 20 cm soil from each sample location, and transported to the laboratory within 2 hours for further analysis.

Analysis of Chemical Properties.

Physicochemical characteristic of these soils such as soil pH; Fe content [Fe(III) and Fe(II)]; nitrogen species ($NO_3^-$, $NO_2^-$ and $NH_4^+$); sulfate ($SO_4^{2-}$); phosphate ($PO_4^{3-}$); dissolve organic carbon (DOC) were determined. pH was measured immediately using a pH electrode. A 0.5N HCl extraction was conducted for 24 hour at room temperature to determine acid-extractable Fe(II) and $NH_4^+$ concentrations in the soils. Fe(II) was analyzed using the ferrozine assay method (39), and $NH_4^+$ was analyzed using a Dionex™ Ion Chromatograph (LC3000) with a CS-16 Column and a CS-16 guard column (flow rate=1.0 mL min$^{-1}$, detection limit=0.012 ppm). $NO_3^-$, $NO_2^-$, $SO_4^{2-}$ and $PO_4^{3-}$ concentrations were measured from anaerobic DI water extraction for 1 hour, via Ion Chromatography, using an AS-22 Column along with an AG-22 guard column (flow rate=1.2 mL min$^{-1}$, detection limit=0.016 ppm). For the DOC analyses a Shimadzu TOC-5000(A) was used.

Batch Incubation.

A series of incubation experiments were conducted. Soil samples from each location were divided into 12×10 g (air-dry equivalent) subsamples, and added into 50 mL serum vials, with 30 mL deionized water. The soil slurries were purged thoroughly with a $CO_2$:$N_2$ (80:20) mixture, and then incubated under anaerobic condition in glove box.

In the first incubation experiment, Feammox activities of each sample were checked. In day 0 to 15, no $NH_4^+$ or Fe(III) was added to the incubations. On day 16, samples were amended with 5 mmol·$NH_4Cl$ and 30 mmol·L$^1$ ferrihydrite, and continue incubated under anaerobic condition. On day 45, 2 mmol·L$^{-1}$ $NH_4Cl$ and 5 mmol·L$^{-1}$ ferrihydrite were added again after $NH_4^+$ was exhausted. Autoclaved sterilized soils were incubated as controls. Triplicate samples were collected from two vials every four days to analyze iron and nitrogen species.

The second incubation was conducted to check how pH and $NO_2^-$ concentration control Feammox reaction. For pH incubation, enrichment culture with Acidimicrobiaceae bacterium A6 were exposed to different pH gradients, pH=2, 4.5, 6.5, 8 (adjusted with HCl and NaOH). For $NO_2^-$ incubation, enrichment cultures were added with different concentration of $NO_2^-$ (0.02, 0.2, 1.0, 2.0 mmol·L$^{-1}$ as final concentrations). The initial concentrations of Ferrihydrite were 25 mmol·L$^-$ 1 and 2 mmol·L$^{-1}$ $NH_4^+$ was added. Triplicate samples were collected every two days to analyze iron, nitrogen species, and also the copy number of Acidimicrobiaceae bacterium A6.

DNA was isolated as described in Example 6.

QPCR was carried out for total bacteria, anammox bacteria and Acidimicrobiaceae bacteria, represented by 16S rRNA genes, using primer sets 1055f/1392r, Amx368f/Amx820r and acm342f/439r, respectively. (Harms et al. 2003; Schmid et al, 200, 2003 and Huang and Jaffe, 2013, all of which are incorporated by reference as if fully set forth) For the detection of denitrifiers, denitrifying functional genes (nirS) were quantified with primer sets NirS3/NirS5 (Braker et al., 1998, which is incorporated by reference herein as if fully set forth). Thermal cycling conditions for total 16S rDNA and nirS gene numbers were essentially as described in Example 7.

Statistical Analysis.

Correlations between the bacterial distributions vs. the environmental factors were analyzed with the canonical correspondence analysis (CCA) using R (22). Analyses of Spearman rank, multivariate and stepwise linear regressions of environmental and bacterial abundance variables were carried out using SPSS v12 on both raw and log-transformed data. All data were analyzed using one-way analysis of variance (ANOVA) with the significant level P<0.05.

It has been shown that anammox activity is optimal at a pH of 7.8-8.0 and temperatures between 28° C.-35° C. In anammox reactors, the DO concentration is usually maintained between 0.2 mg/L-1 mg/L to allow for partial nitritation, which is required to achieve satisfactory $NH_4^+$ removal. In soils environments, anammox bacteria are usually present under slightly oxic conditions, which again, ensures that AOB are able to provide adequate $NO_2^-$ levels. Both AOB and anammox bacteria are autotrophic, therefore the organic carbon content in soils does not affect their $NH_4^+$ oxidation rate, except for *Nitrosopumilis maritimus* (an AOB species) which was reported to be inhibited by organic substrates even at very low concentrations.

AOB and anammox bacteria usually coexist in hypoxic environments, since AOB provide the $NO_2^-$ for the anammox reaction. Hence, Feammox bacteria, which also produce $NO_2^-$ while oxidizing $NH_4^+$, may enhance anammox in environments where AOB are not active. Batch incubations of soil samples at sites where Feammox activity was observed have shown that after $NH_4^+$ was oxidized to $NO_2^-$ by the Feammox process, nitrogen loss proceeded via denitrification and/or anammox. Since, as shown by equation 1, removal of $NO_2^-$ makes the reaction more favorable, the coexistence of Feammox with denitrifiers and/or anammox may be key for anaerobic ammonium oxidation in soil environments.

Therefore, influence of the different environment factors on the Feammox presence/activity in soil environments was investigated, the relationships between Feammox bacteria and other microorganisms responsible for nitrogen transformations in soils were determined.

Chemical Properties of Samples Collected from Different Locations

Soil and sediment samples collected for this study cover a wide range of chemical properties: pH from 4.26 to 7.21; Fe(III) from 120 to 1243 mg kg$^{-1}$; Fe(II) from 7.92 to 356 mg kg$^{-1}$; $NH_4^+$ from 6.02 to 86.0 mg kg$^{-1}$; $NO_3^-$ from 6.71 to 274.8 mg kg$^{-1}$; $NO_2^-$ from 4.74 to 152.8 mg kg$^{-1}$; $SO_4^{2-}$ from 4.89 to 128.6 mg kg$^{-1}$; $PO_4^{3-}$ from 2.97 to 28.5 mg kg$^{-1}$; DOC from 9.37 to 28.09 g kg$^{-1}$.

Most of the soil and sediment samples selected for this study were acidic. pH value of surface soil samples (top 5 cm of soil,) was higher than that of soil below 10 cm. Concentrations of $NO_3^-$ and DOC were also higher in the surface soils. $NO_3^-$ were only showed in samples from 0 to 5 cm of soil, but hardly detected in soils collected from 10 to 20 cm in L7. On the contrary, $NO_2^-$ was found more rich below 10 cm than the upper soil samples in most of the locations.

All of these soil samples were iron rich, compared to the total iron levels usually reported for wetland soils (100 mg·kg$^{-1}$ to 620 mg·kg$^{-1}$) and sediment environments (30 to 120 mg·kg$^{-1}$). Fe(III) concentrations in vegetation-covered soil samples were obvious higher than the other samples. In additional, Fe(III) concentrations in soil collected from rhizosphere, were much higher than that from non-rooting zone at the same location. Fe(II) abundance shown a different trend, and was found negatively correlated (r=−0.61 p=0.001) with Fe(III) in the same sample locations.

Among these samples, samples originated from a forested riparian wetland area that was 0.5 km near some agricultural lands, have higher $NH_4^+$ and $PO_4^{3-}$ contents. The distribution of $SO_4^{2-}$ in samples of this study was similar to that of $NO_3^-$ between different sample locations but shown no obvious discrepancy with sample depth.

Feammox activity and abundance of Acidimicrobiaceae bacterium A6 Fe(II) production and $NH_4^+$ consumption were checked after two weeks anaerobic incubation to monitor the Feammox activity in different samples. After 15 days of anaerobic incubation without the addition of extra $NH_4^+$ and Fe(III), all samples showed clearly iron reduction, form 2.10 to 8.86 mmol·$L^{-1}$.

The existence and abundance of the Feammox Acidimicrobiaceae bacterium A6 in soil and sediment samples were determined via qPCR analysis. Abundance of Acidimicrobiaceae bacterium A6 in the field samples shown consistent with the anaerobic $NH_4^+$ consumption in incubations, and a positively correlation (r=0.58 p=0.012) were revealed between them.

Feammox activity in incubation with different pH and $NO_2^-$ concentrations. The Feammox reaction was most active in samples with pH 4.5. When pH increased or decreased, $NH_4^+$ oxidation and Fe reduction slow down, and Feammox reaction seem to stop at a pH 2.0 or 8.0. Abundance of Feammox Acidimicrobiaceae bacterium A6 increased after 14 days anaerobic incubation in samples with pH 2, 4.5, or 6.5 and slightly decreased in alkaline conditions. There was no significant difference between number of Acidimicrobiaceae bacterium A6 in samples incubated with pH 4.5 and 6.5, which is $2.37 \times 10^4$ and $2.41 \times 10^4$ copies $mL^{-1}$, respectively.

Feammox activity was sensitive to $NO_2^-$ concentration in the samples. Feammox reaction processed when $NO_2^-$ concentrations were 0.02 and 0.2 mmol·$L^{-1}$, but it was inhibited when $NO_2^-$ reached to 1.0 mmol·$L^{-1}$. Changes of Acidimicrobiaceae bacterium A6 abundance were consistent with Feammox activities with different concentration of $NO_2^-$ were added. In samples with 1.0 and 2.0 mmol·$L^{-1}$ $NO_2^-$ were added, the numbers of Acidimicrobiaceae bacterium A6 were decreased after incubation.

CCA Analysis of Feammox Distributions in Soil Samples.

Figure 12A:
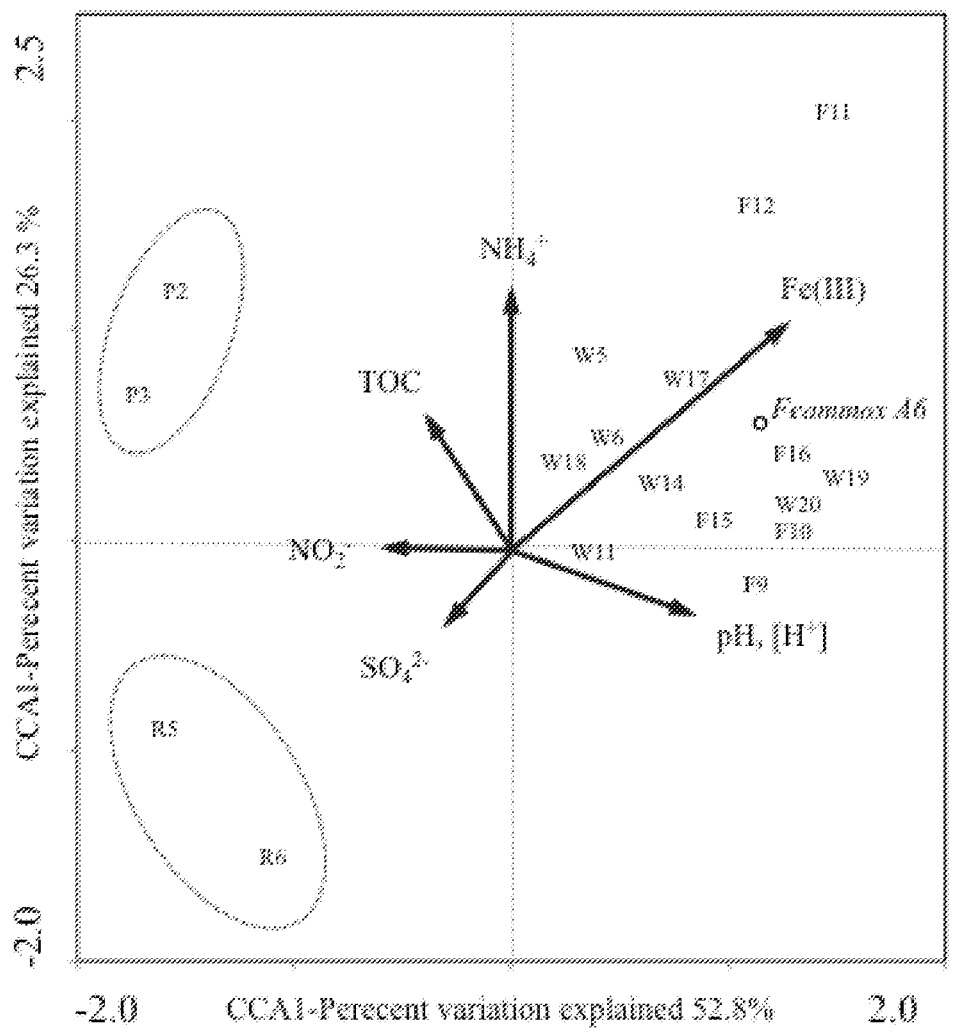
FIGS. 12A-12B illustrate ordination plots of the canonical correspondence analysis (CCA) for the first two dimensions of CCA of the relationship between the environmental factors and Feammox bacteria vs. environment factor of soil analysis and relation of Feammox to other bacterial communities affecting the nitrogen cycle.
Figure 12B:
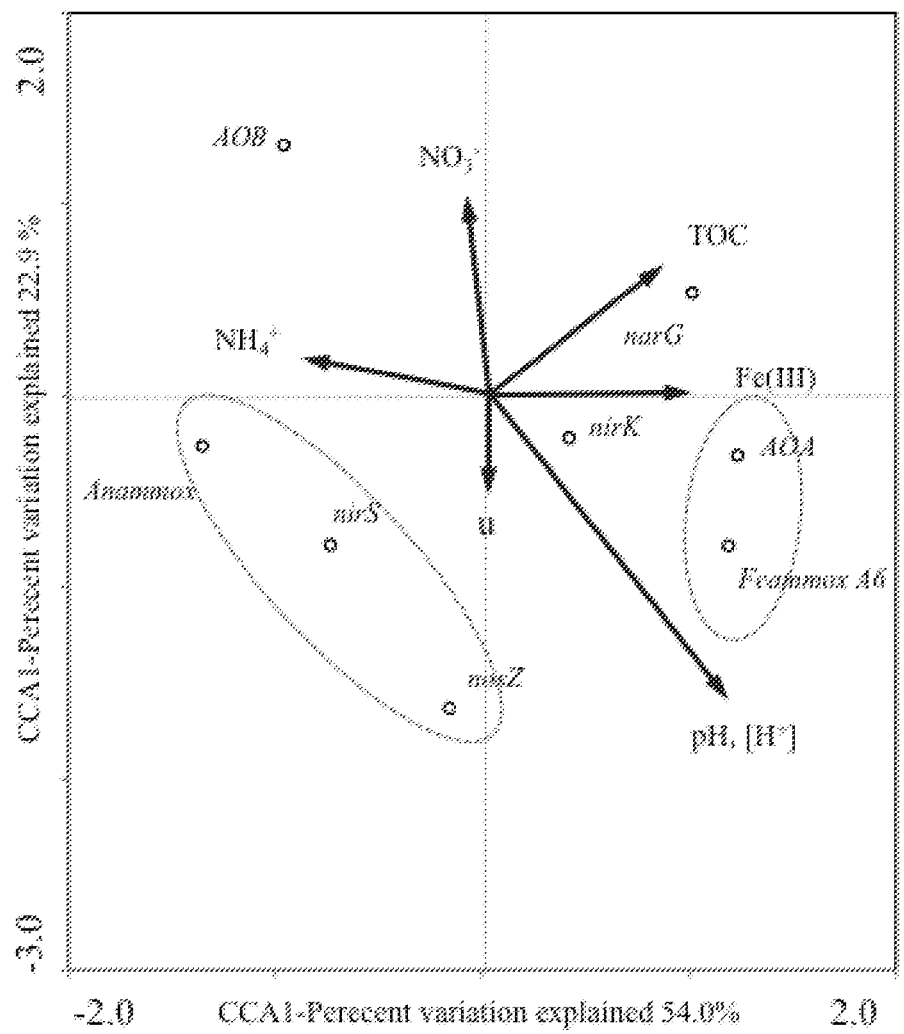

Soils for all the experiments described in this study were taken from three areas: New Jersey and South Carolina in Unities States, Guangdong province in China. A total of 52 locations were selected and cover 4 different types of soil samples, which are wetland soils (W), river sediments (R), forest soils (F), paddy soils (P). FIGS. 12A-12B illustrate ordination plots of the canonical correspondence analysis (CCA) for the first two dimensions of CCA of the relationship between the environmental factors and Feammox bacteria vs. environment factor of soil analysis and relation of Feammox to other bacterial communities affecting the nitrogen cycle. FIG. 12A illustrates the total variance in the bacterial abundance and the cumulative variance of the bacteria-environment relationship. FIG. 12B illustrates the total variance in the microbial composition and the cumulative variance of the bacteria-sampling location relationship.

Referring to FIG. 12A, the CCA analysis of Feammox bacteria and nitrogen microorganisms in response to environmental variables confirmed the influence shown in this figure. The first two CCA axes (CCA1 and CCA2) explained 73.2% of the total variance in the bacterial abundance and 80.6% of the cumulative variance of the bacteria-environment relationship. pH value (p=0.030) and Fe(III) content (p=0.021) had significant effects on the distributions of Acidimicrobiaceae bacterium A6, and $NO_2^-$ seemed to inhibit this bacteria by showing a negatively correlation. Concentrations of $NO_2^-$ were supporting anammox bacterial existence (p=0.025), and the combined effects of $SO_4^{2-}$ and $NO_2^-$ affects the distribution of nirS genes. $NH_4^+$ content was not limited for either Feammox or aerobic/anaerobic $NH_4^+$ oxidation bacteria. Referring to FIG. 12B, the first two CCA axes (CCA1 and CCA2) explained 71% of the total variance in the microbial composition and 81% of the cumulative variance of the bacteria-sampling location relationship. The CCA analysis showed that CCA1 represented the pH level of the soils. Referring to FIG. 12B, sample with Feammox activity assembled in a low pH area, while other soil samples distributed in the opposite pH area showed no Feammox reaction. CCA2 represents the vertical distributions of soil samples, soils collected from similar depth gathered together. More aerobic or anaerobic $NH_4^+$ oxidation bacteria were found in surface soil samples. It was observed that Feammox bacteria and denitrifiers tended to be active at depths below 10 cm of the soil environments.

Example 19. Reduction of Uranium by Acidimicrobiaceae Bacteria A6 with Ferrihydrite as the Iron Source Acidimicrobiaceae bacteria A6 from a pure culture were prepared for uranium (U) bioreduction experiments. Twelve 15-mL vials of bacteria in their normal growth medium were centrifuged after which the bacteria were resuspended in a modified anaerobic growth medium. Of the twelve vials, three contained bacteria that had been autoclaved to establish a control condition with dead bacteria. The centrifugation and washing was repeated twice. The modified anaerobic growth medium consisted of $NaHCO_3$, $KHCO_3$, $MgSO_4 \cdot 7H_2O$, $CaCl_2$, and AQDS. It differed from the normal growth medium in that it did not contain $KH_2PO_4$, which was removed due to its high sorption of U, or $NH_4Cl$, which was added separately. Uranyl acetate was added to all vials such that the initial concentration of U was approximately 64 μM.

The twelve vials were divided into four groups: three different control conditions and the experimental condition as shown in Table 1. Ammonium ($NH_4^+$) in the form of $NH_4Cl$ was added to the three experimental vials as an electron source for the bacteria. In the first control condition, $NH_4Cl$ was also added, but the microbial monoxygenase enzyme was inhibited by the addition of $Na_2S$. The second control condition, mentioned earlier, contained bacteria that had been killed in an autoclave. $NH_4Cl$ was added to this condition, as well. No $NH_4Cl$ was added to the third control condition to establish an electron donor-limited control. No iron (Fe) was added to any vials, but some ferrihydrite, a common ferric oxyhydroxide, which acted as the Fe source in the original pure culture medium remained with the bacteria through the washing process.

TABLE 1

Experimental and control conditions in U bioreduction experiment with ferrihydrite as Fe source

|  | Experimental | Control 1: Enzyme Inhibited | Control 2: Autoclaved Bacteria | Control 3: No $NH_4+$ |
|---|---|---|---|---|
| $NH_4+$, mM | 3.98 ± 0.01 | 3.96 ± 0.01 | 4.01 ± 0.02 | 0.03 ± 0.01 |
| Initial total U, μM | 64.8 ± 15.6 | 65.5 ± 6.3 | 65.4 ± 6.1 | 59.3 ± 17.0 |
| $Na_2S$, μM | 0 | 20 | 0 | 0 |
| Acidimicrobiaceae bacteria A6 | Live | Live | Dead | Live |

In Table 1, values given for $NH_4^+$ and U concentrations are the averages of three vials±one standard deviation The extent of Acidimicrobiaceae bacteria A6 activity in each condition was monitored by measuring concentrations of U and $NH_4^+$ on the day the experiment started and again six days later. Samples for $NH_4^+$ analysis were filtered using 0.2 μm nylon filters and stored at 4° C. until they were analyzed using a Dionex™ Ion Chromatograph ICS3000 with a CS-16 column, a CS-16 guard column, and a CERS 500 (4 mm) suppressor. Samples for U(VI) analysis were also filtered at 0.2 μm to remove reduced U(IV) precipitates and were preserved in 2% $HNO_3$. Unfiltered samples for total U analysis were mixed in a 1:1 ratio with 0.2 M $NaHCO_3$ to dissolve any U(IV) that had been reduced by the bacteria. After a 24-hour extraction at room temperature, these samples were also preserved in 2% $HNO_3$. U measurement in acidified samples was completed on a Thermo Scientific Element 2 inductively-coupled plasma mass spectrometer (ICP-MS).

Reduction of Uranium by Acidimicrobiaceae Bacteria A6 with Ferrihydrite as the Iron Source.

Figure 13:
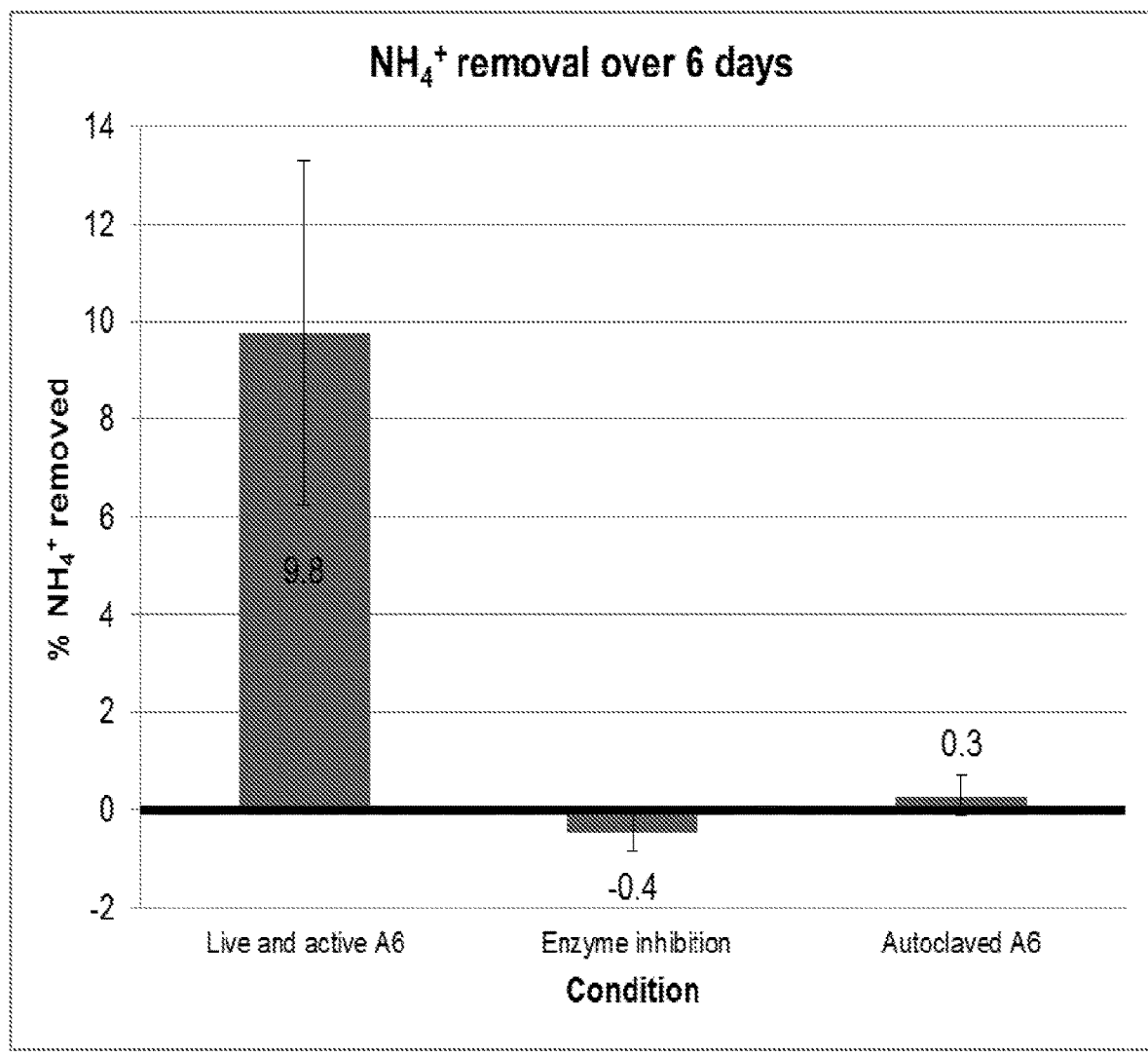
FIG. 13 illustrates $NH_4^+$ oxidized over 6 days by Acidimicrobiaceae bacteria A6.

$NH_4^+$ analyses indicate that Acidimicrobiaceae bacteria A6 were only active in the experimental condition which contained live bacteria with $NH_4^+$ and U. FIG. 13 illustrates $NH_4^+$ oxidized over 6 days by Acidimicrobiaceae bacteria A6. Uranium (U) was present in all conditions. Referring to FIG. 13, percentages shown are an average of three replicates. Error bars indicate one standard deviation. Referring to FIG. 13, over 6 days, bacteria in this condition oxidized an average of 7.0 mg $L^{-1}$ of $NH_4^+$ which is equivalent to the removal of 9.8% of the initial $NH_4^+$. $NH_4^+$ oxidation was not seen in any of the control conditions which suggests that Acidimicrobiaceae bacteria A6 were not active in these conditions. In the control conditions in which the relevant monoxygenase enzyme was inhibited, the average $NH_4^+$ concentration increased by 0.31 mg $L^{-1}$ indicating no $NH_4^+$ oxidation. Similarly, in the control condition containing autoclaved bacteria, the average $NH_4^+$ concentration decreased by 0.20 mg $L^{-1}$ indicating no significant $NH_4^+$ oxidation. In the control in which no $NH_4^+$ was added, the concentration of $NH_4^+$ actually increased from an average concentration of 0.52 mg $L^{-1}$ to 1.83 mg $L^{-1}$. This increase was seen in all three replicates and could indicate nitrogen release through the death and decay of Acidimicrobiaceae bacteria A6 that were deprived of their requisite electron donor $NH_4+$.

Figure 14:
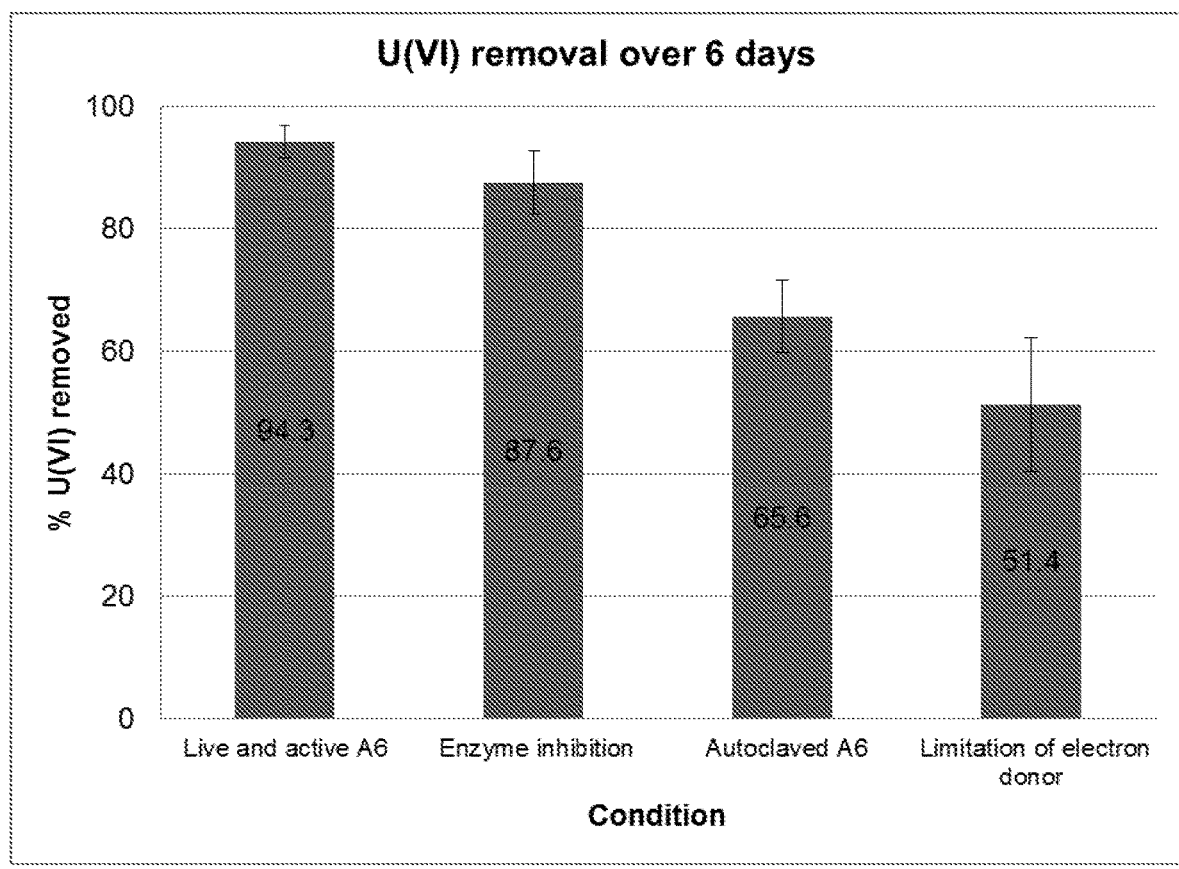
FIG. 14 illustrates uranium U(VI) removed from solution over 6 days.

Measurement of U concentrations indicates that biological reduction is one of multiple pathways by which U was removed from solution in these experiments. Across all experimental and control conditions, between 74% and 91% of the added U disappeared from solution within 2 hours of uranyl acetate addition. It is likely that this U(VI) sorbed to ferrihydrite which remained with the bacterial cells through the centrifugation and washing procedure. As a result, the effective initial aqueous U(VI) concentrations varied from 7.2 μM to 13.2 μM U(VI). FIG. 14 illustrates uranium U(VI) removed from solution over 6 days. Referring to FIG. 14, the difference between the "Live and active A6" condition and both the "Autoclaved A6" and the "Limitation of electron donor" conditions is attributable to U reduction by Acidimicrobiaceae bacteria A6. Percentages shown are an average of three replicates. Error bars indicate one standard deviation.

Referring to FIG. 14, significant U(VI) removal in all conditions continued after the initial removal by sorption. In the three control cases, the lack of $NH_4^+$ oxidation indicates that Acidimicrobiaceae bacteria A6 were inactive and thus the U(VI) removal in those cases must have been abiotic. It is likely that U diffusion into the matrix of ferrihydrite caused the removal of 51.4% and 65.6% of effective initial aqueous U(VI) over 6 days in the $NH_4^+$-limited and autoclaved controls, respectively. This two-step uranyl sorption to ferric oxyhydroxides is an established phenomenon (Hsi C K D and Langmuir D 1985 *Geochim Cosmochim Ac* 49, 1931-1941; Morrison, S J et al., 1995 *J Contam Hydrol* 17, 333-346, both of which are incorporated herein by reference as if fully set forth). In the enzyme inhibited control, even more U(VI) was abiotically removed over 6 days than in the autoclaved or $NH_4^+$-limited control. The additional U(VI) removal in this case is likely due to abiotic U(VI) reduction by the added enzyme inhibiting compound, $Na_2S$. The sulfide in $Na_2S$ is able to act as an electron donor for U(VI) reduction (Hua B et al. 2006 *Environmental Science & Technology* 40, 4666-4671, which is incorporated herein by reference as if fully set forth).

Referring to FIG. 14, comparison of U(VI) removal in the experimental condition and the controls with autoclaved bacteria and with $NH_4^+$ limitation suggests that biotic reduction of U(VI) by Acidimicrobiaceae bacteria A6 is significant. Without the help of reductants like $Na_2S$, the U(VI) removal in vials with live and active bacteria exceeds the highest removal in vials with dead bacteria by 25%. Since these conditions are identical except for the state of the bacteria, it is reasonable to conclude that the additional U(VI) reduction is performed by Acidimicrobiaceae bacteria A6.

Example 20. Reduction of Uranium by Acidimicrobiaceae Bacteria A6 with Nontronite as the Iron Source Cell suspension experiments with nontronite, an Fe-rich clay, were performed to study U bioreduction by Acidimicrobiaceae bacteria A6 in an environment rich in electron accepting Fe(III) to promote Acidimicrobiaceae bacteria A6 activity. This experiment was similar to the cell suspension experiments without the addition of an Fe source as described above. Pure culture of Acidimicrobiaceae bacteria A6 in twelve 15-mL vials was washed by centrifugation and resuspension in anaerobic growth medium consisting of $NaHCO_3$, $KHCO_3$, $MgSO_4 \cdot 7H_2O$, $CaCl_2$, and AQDS.

Nontronite (NAu-2) from the Source Clay Repository of the Clay Minerals Society was selected as an electron acceptor for this experiment due to its inability to sorb significant amounts of U at slightly acidic pH. The structural formula of this clay is $M^+_{0.72} [Si_{7.55}Al_{0.45}][Fe_{3.83}Mg_{0.05}] O_{20}(OH_4)$ where $M^+$ represents monovalent interlayer cations (Keeling J L et al. 2000 *Clay Clay Miner* 48, 537-548, which is incorporated herein by reference as if fully set forth). This clay is 23.4% Fe by weight, of which 99.4% is Fe(III) (Liu D et al. 2011 *Geochim Cosmochim Ac* 75, 1057-1071, which is incorporated herein by reference as if fully set forth). A stock solution of 20 g $L^{-1}$ nontronite was prepared using a previously established protocol (Liu et al. 2011, which is incorporated herein by reference as if fully set forth). Briefly, the clay was ground by hand with mortar and pestle before it was soaked in 0.5 mM NaCl overnight. The solution was centrifuged to eliminate all but the 0.02-0.5 µm size fraction. These remaining particles were washed with deionized water and dried in an oven at 100° C. The clay was diluted to 20 g $L^{-1}$ in deionized water and autoclaved to create a sterile stock solution. This stock solution was added to all 12 vials so that the final concentration of nontronite in each vial was 5 g $L^{-1}$.

Again, the twelve vials were divided into four groups: one experimental group and three control groups as described in Table 2. To establish the experimental condition with live and active Acidimicrobiaceae bacteria A6, $NH_4Cl$ and uranyl acetate were added so that the initial concentrations of $NH_4^+$ and U were 3.726 mM and 12.5 µM, respectively. The first control condition contained bacteria that had been autoclaved, but $NH_4Cl$ and uranyl acetate were added to these control vials so that they were otherwise identical to the experimental condition. The second control condition contained live bacteria and U, but no $NH_4^+$ was added to these vials to distinguish the effects of live and active bacteria from live and inactive bacteria. The third control condition contained live bacteria and added $NH_4^+$, but did not contain any U in order to determine whether the presence of U altered the activity of Acidimicrobiaceae bacteria A6.

Fe(II) was measured at intervals of 24 to 48 hours throughout the experiment to gauge Fe-reducing activity of Acidimicrobiaceae bacteria A6. 20 µL of unfiltered samples were deposited in 1 mL of 0.5N HCl. After 15 minutes, Fe(II) was measured using the well-established ferrozine method (Komlos J and Jaffe P R, 2004 *Biodegradation* 15, 315-325, which is incorporated herein by reference as if fully set forth). Briefly, Fe(II) was measured by adding 30 µL of HCl-extracted sample to 1.5 mL of ferrozine and measuring the absorbance after 30 minutes at a wavelength of 562 nm in a Spectronic Genesys 2 spectrophotometer. Absorbances were converted to molar concentrations of Fe(II) using a standard curve.

TABLE 2

Experimental and control conditions in U bioreduction experiment with nontronite as Fe source

| | Experimental | Control 1: Autoclaved Bacteria | Control 2: No $NH_4^+$ | Control 3: No U |
|---|---|---|---|---|
| $NH_4^+$, mM | 3.726 mM | 3.726 mM | 0 mM | 3.726 mM |
| Initial total U, µM | 12.5 ± 2.3 | 11.8 ± 0.3 | 12.4 ± 0.5 | 0 |
| Nontronite, g $L^{-1}$ | 5 | 5 | 5 | 5 |
| Acidimicrobiaceae bacteria A6 | Live | Dead | Live | Live |

Concentrations of Fe(II) measured by the ferrozine method include aqueous Fe(II) and approximately 74% of the Fe(II) sorbed to nontronite surfaces (Zhang G X et al. 2009 *Geochim Cosmochim Ac* 73, 3523-3538, which is incorporated herein by reference as if fully set forth). Therefore, these measurements were used only in relation to each other to track bacterial Fe(II) production indicating Acidimicrobiaceae bacteria A6 activity. U, $NH_4^+$, nitrate ($NO_3^-$), and nitrite ($NO_2^-$) concentrations were measured after 0, 7, and 11 days to determine activity of Acidimicrobiaceae bacteria A6. Total U and U(VI) concentrations were measured by ICP-MS as described above. $NH_4^+$, $NO_3^-$, and $NO_2^-$ concentrations were measured on a Dionex™ Ion Chromatograph ICS3000. Columns used for $NH_4^+$ were identical to those described above. $NO_3^-$ and $NO_2^-$ analysis was carried out with an AS-22 column, an AG-22 guard column, and an ASRS 300 (4 mm) suppressor. It had previously been determined that $NH_4^+$ could sorb to nontronite, so total $NH_4^+$ was also measured. Sorbed $NH_4^+$ was extracted from nontronite by adding 20 µL samples from each vial to 1 mL of 0.5N HCl. After 20 hours, the acid extractions were filtered on 0.2 µm nylon filters and preserved at 4° C. until the $NH_4^+$ concentrations were measured on a Dionex™ Ion Chromatograph.

Purity of bacterial cultures was confirmed after the experiment using DNA isolation and quantitative polymerase chain reaction (qPCR) assay. 1 mL samples of the slurry containing bacteria, growth medium, and nontronite were centrifuged at 1000 rpm for 10 minutes before DNA was extracted from the pellets using the FastDNA® spin kit for soil (MP Biomedicals, USA) as described by the manufacturer. Total bacterial abundance was represented by the number of copies of 16S rRNA genes quantified by qPCR with primers BACT1369F-PROK1492R and the TaqMan probe 1389F (Suzuki M T et al. 2000 *Appl Environ Microb* 66, 4605-4614, which is incorporated herein as if fully set forth). Acidimicrobiaceae bacteria A6 bacteria were enumerated with the primer set acm342f-439r (Huang S and Jaffe P R 2015 *Biogeosciences* 12, 769-779, which is incorporated herein by reference as if fully set forth). Several other U-reducing species were also targeted to check the samples for contamination. To investigate the presence of sulfate and Fe reducing bacteria, δ-Proteobacteria was enumerated by qPCR using primer set 361F-685R and the TaqMan probe 1839F (Stults J R et al. 2001 *Appl Environ Microb* 67, 2781-2789, which is incorporated herein by reference as if fully set forth). *Geobacter*, the dominant Fe-reducing microorganisms in sediment environments, was enumerated by qPCR primer set 561F-825R and TaqMan probe Gbc2 (Stults et al. 2001, which is incorporated herein by reference as if fully set forth). *Anaeromyxobacter* spp., a metal-reducing group of bacteria, was enumerated with the 60F-

461R primer pair (Petrie L et al. 2003 *Appl Environ Microb* 69, 7467-7479, which is incorporated herein by reference as if fully set forth). All qPCR experiments were carried out using a StepOnePlus™ Real-Time PCR System (Life Technologies, USA). For DNA quantification, each qPCR mixture (20 µL) was composed of 10 µL of SYBR Premix Ex Taq® II (Takara, Japan), 0.8 µL of 10 µM of each primer, and ~10 ng DNA template. Each assay contained a set of standards produced by serial dilution of plasmids containing specific target genes, independent triplicate templates for each slurry sample, and triplicate no template controls (NTC).

Reduction of Uranium by Acidimicrobiaceae Bacteria A6 with Nontronite as the Iron Source.

Figure 15:
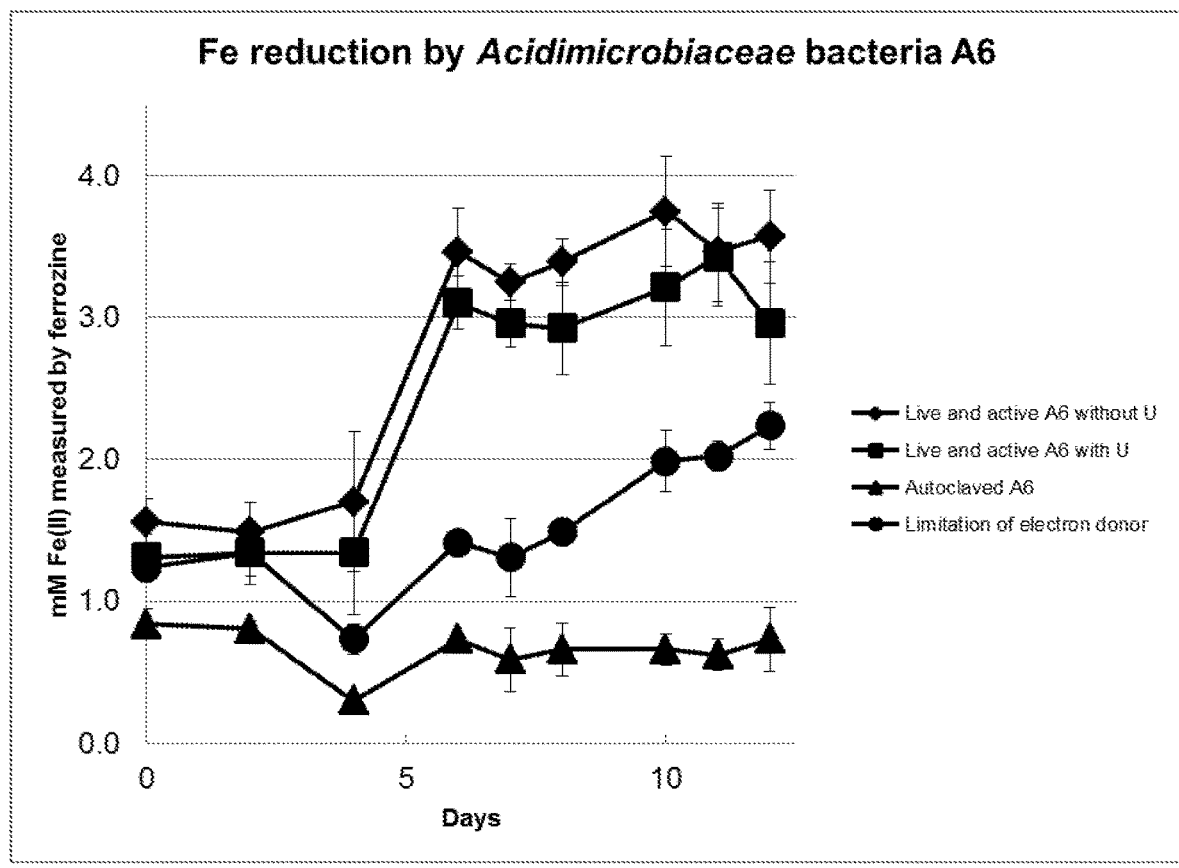
FIG. 15 illustrates reduction of Fe in nontronite over 12 days.

Measurements of Fe(II) confirm that Acidimicrobiaceae bacteria A6 remain active in the presence of U and nontronite. FIG. 15 illustrates reduction of Fe in nontronite over 12 days. Values shown are averages of three replicates. Error bars indicate one standard deviation. Referring to FIG. 15, Fe(II) production was similar in rate and extent in conditions with and without U, indicating that the addition of 10 µM uranyl acetate is not toxic to Acidimicrobiaceae bacteria A6. In cases with and without added U, Acidimicrobiaceae bacteria A6 were able to use the Fe(III) in nontronite as an electron acceptor for $NH_4^+$ oxidation. Still referring to FIG. 15, in the condition with autoclaved Acidimicrobiaceae bacteria A6, the Fe(II) remained constant throughout the 12-day experiment. This result indicates that there was no abiotic Fe cycling occurring in the vials.

Figure 16:
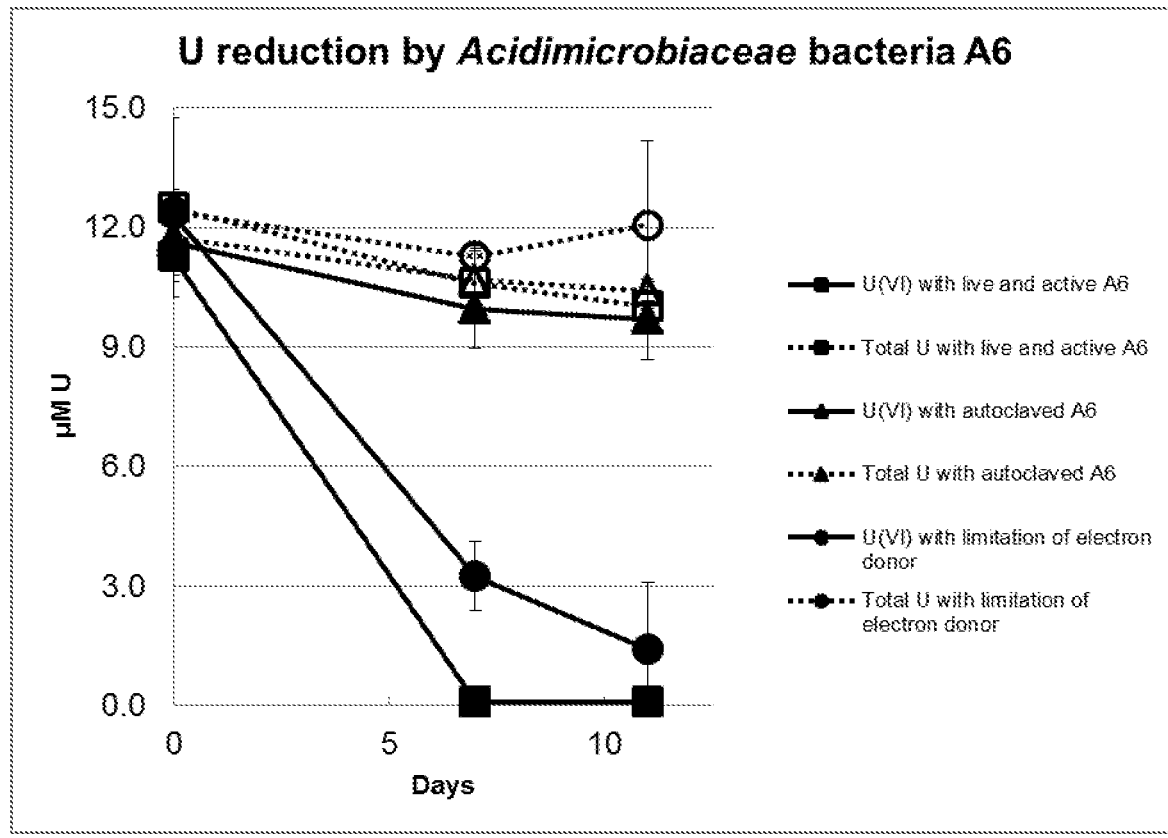
FIG. 16 illustrates total U and U(VI) concentrations over 11 days.

Results indicate that Acidimicrobiaceae bacteria A6 can reduce U in addition to Fe. FIG. 16 illustrates total U and U(VI) concentrations over 11 days. Values shown are averages of three replicates. Error bars indicate one standard deviation. Referring to FIG. 16, essentially all of the U(VI) disappeared from solution in 7 days in the condition with live Acidimicrobiaceae bacteria A6, $NH_4^+$, and U. This change cannot be attributed to activity of other bacteria, as qPCR results indicated that only Acidimicrobiaceae bacteria A6 were present in all vials with live bacteria. Referring to FIG. 16, this change in U(VI) also cannot be attributed to sorption of U to nontronite or ingredients of the growth medium because the aqueous U(VI) concentrations remained essentially equivalent to total U concentrations in vials in which Acidimicrobiaceae bacteria A6 had been killed. The similarity between U(VI) and total U in the condition with autoclaved bacteria also demonstrates that no abiotic U reduction occurred. The difference between vials with dead and live Acidimicrobiaceae bacteria A6 indicate that Acidimicrobiaceae bacteria A6 can reduce aqueous U(VI) to U(IV) solids. It has previously been determined that *Shewanella oneidensis* MR-1 are also able to completely reduce U in the presence of nontronite (Zhang G X et al 2009, which is incorporated herein by reference as if fully set forth). *Shewanella oneidensis* MR-1 are only able to reduce U in the presence of AQDS; though this present study did not examine the effect of AQDS on U reduction by Acidimicrobiaceae bacteria A6, it is likely that they similarly require AQDS (Zhang G X et al 2009, which is incorporated).

In all vials except one, the total U measured by bicarbonate extraction decreased over 11 days. This change likely resulted from the slow incorporation of U into the structure of nontronite where it would be unaffected by the extraction.

Unexpectedly, Fe and U reduction occurred in vials without $NH_4^+$ for the live Acidimicrobiaceae bacteria A6 to oxidize. In these vials, the Fe(II) increased and U(VI) decreased more slowly and to a lesser extent over 12 days than they did in vials with $NH_4^+$. These results could indicate that the live Acidimicrobiaceae bacteria A6 area able to use a structural component of the nontronite as an electron donor rather than $NH_4^+$. Alternatively, biomass turnover and decomposition could provide the remaining live Acidimicrobiaceae bacteria A6 with $NH_4^+$. In this case, the lower proportion of live bacteria and the lower concentrations of $NH_4^+$ would explain the slower rates and smaller extent of Fe and U reduction.

Example 21. Bioreduction of Cu(II) by Feammox

Figure 17A:
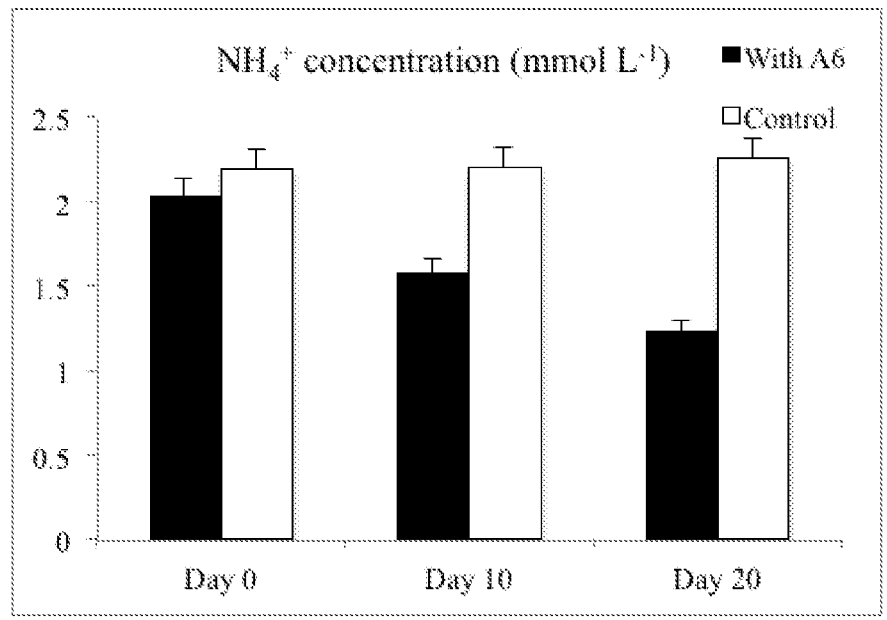
FIGS. 17A-17B illustrate oxidation of $NH_4^+$ (FIG. 17A) and bioreduction of Cu(II) (FIG. 17B) by Feammox. Filled bars are for results with A6, and open bars are controls.
Figure 17B:
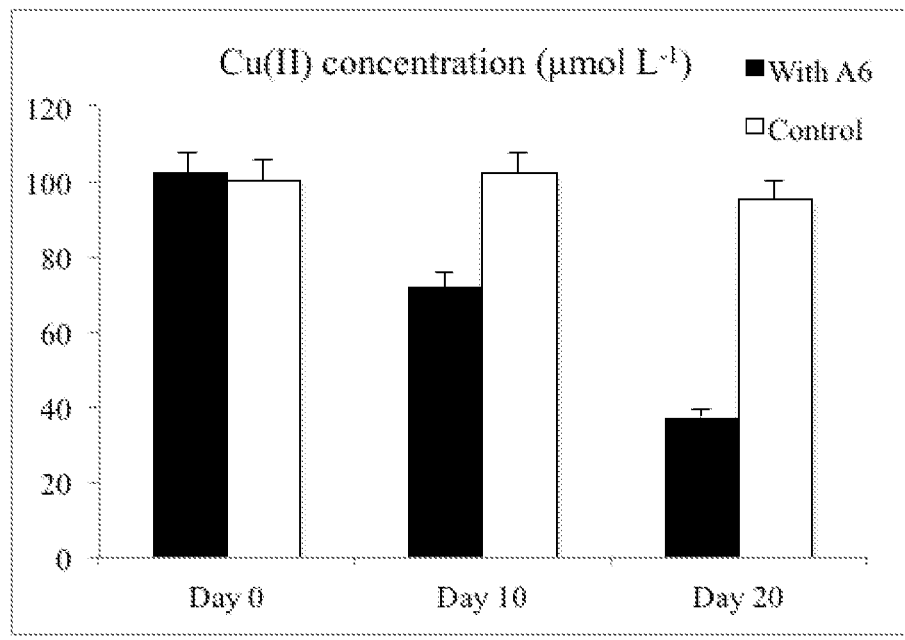

FIGS. 17A-17B illustrate oxidation of $NH_4^+$ (FIG. 17A) and reduction of Cu(II) (FIG. 17B) by Feammox. Around $10^4$ cell per ml of pure A6 were incubated in inorganic $NH_4^+$-Ferric iron liquid medium with 20 ppm Copper (II) chloride ($CuCl_2$) under anaerobic conditions for 40 days. Referring to FIG. 17B, 64.2% of Cu(II) was reduced and the total dissolved Cu [including Cu(II) and Cu(I)] decreased by 23.1% over the incubation period, while the concentrations of Cu(II) and Cu(I) remained constant for the autoclaved treatment.

After the incubation, the samples were aerated to reoxidize the reduced copper. This resulted in full recovery or the initial Cu(II).

Example 22. Investigation of Selected Organic Contaminants Biodegradation by Feammox Around $10^4$ cell per ml of pure A6 were incubated in inorganic $NH_4^+$-Ferric iron liquid medium with 1000 ppb Trichloroethylene (TCE)/1000 ppb tetrachloroethylene (PCE)/100 ppb benzene/100 ppb phenanthrene under anaerobic conditions for 40 days. Six 15-mL vials of incubations were conducted for each organic contaminant. The six vials were divided into three groups: two different control conditions and the experimental condition as shown in Table 3.

TABLE 3

Experimental and control conditions in selected organic contaminants biodegradation by Feammox

|  | Experimental | Control 1: Enzyme Inhibited | Control 3: No $NH_4+$ |
|---|---|---|---|
| $NH_4+$, mM | 2.96 ± 0.12 | 2.97 ± 0.05 | 0.02 ± 0.01 |
| Initial total TCE/PCE/benzene/ phenathrene, ppb | 1000/1000/ 100/100/ | 1000/1000/ 100/100/ | 1000/1000/ 100/100/ |
| $Na_2S$, µM | 0 | 50 | 0 |
| Acidimicrobiaceae bacteria A6 | Live | Live | Live |

Subsamples were taken on day 0, 12, 22, 30 and 37 under anoxic conditions. Samples for $NH_4^+$ analysis were filtered using 0.2 um nylon filters and stored at 4° C. until they were analyzed using a Dionex™ Ion Chromatograph ICS3000 with a CS-16 column, a CS-16 guard column, and a CERS 500 (4 mm) suppressor. TCE, PCE, benzene or phenathrene were measured with a Thermo Scientific Vanquish UHPLC system. FIGS. 18A-18D illustrate an effect of biodegradation of trichloroethylene (TCE) (FIG. 18A), tetrachloroethylene (PCE) (FIG. 18B), benzene (FIG. 18C) and phenanthrene (FIG. 18D) by Feammox. Around $10^4$ cell per ml of pure A6 were incubated in inorganic $NH_4^+$-Ferric iron liquid medium with 1000 ppb Trichloroethylene (TCE)

(FIG. 18A), 1000 ppb tetrachloroethylene (PCE) (FIG. 18B), 100 ppb benzene (FIG. 18C), 100 ppb phenanthrene (FIG. 18D) under anaerobic conditions for 40 days.

Figure 18A:
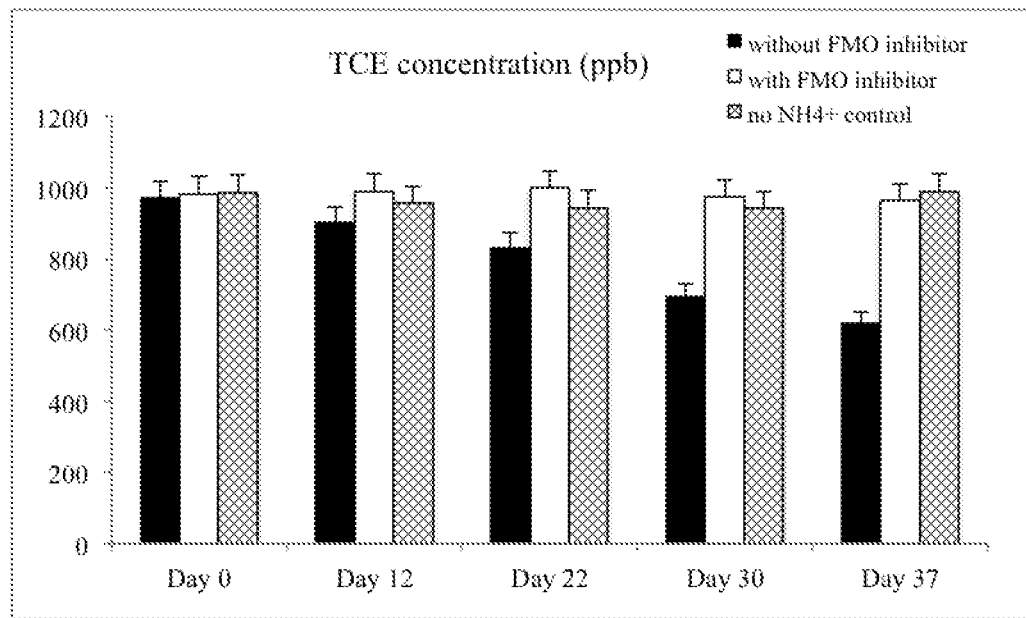
FIGS. 18A-18D illustrate an effect of biodegradation of trichloroethylene (TCE) (FIG. 18A), tetrachloroethylene (PCE) (FIG. 18B), benzene (FIG. 18C) and phenanthrene (FIG. 18D) by Feammox. Filled bars are for results without FMO inhibitor, open bars are for results with FMO inhibitor and crosshatched bars are no $NH_4^+$ controls.
Figure 18B:
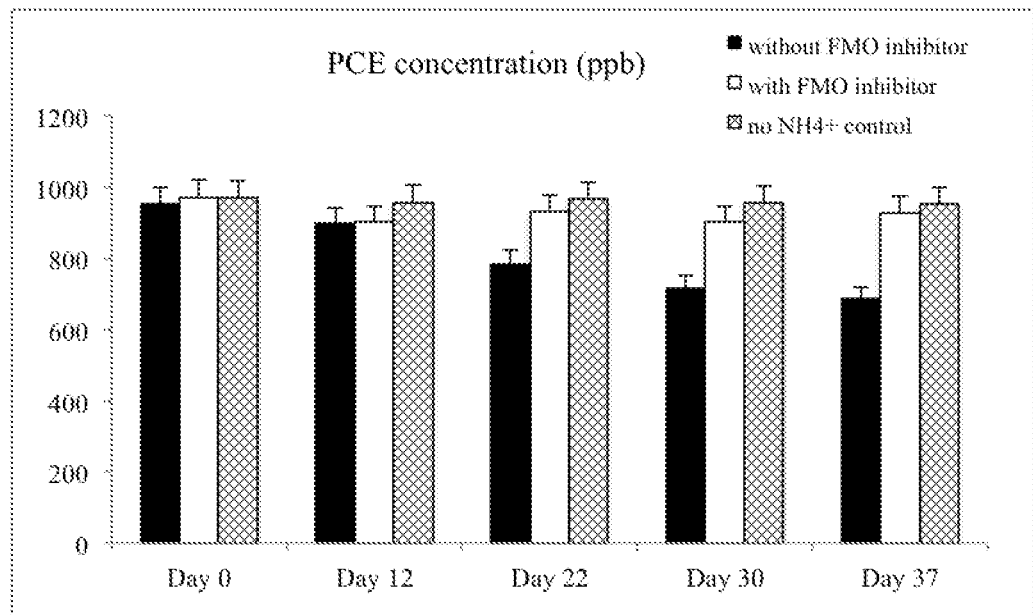
Figure 18C:
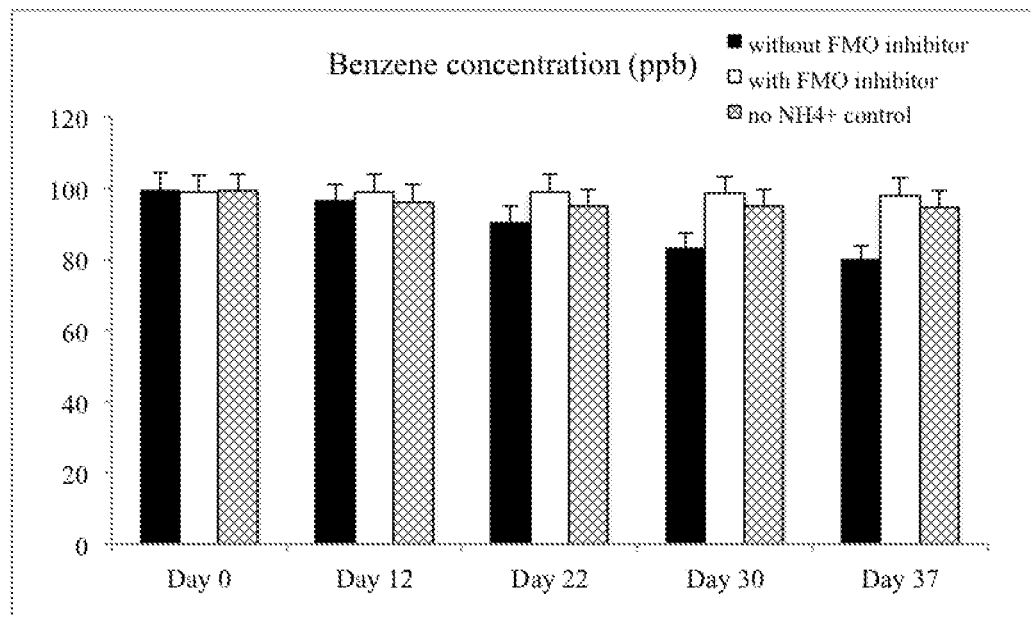
Figure 18D:
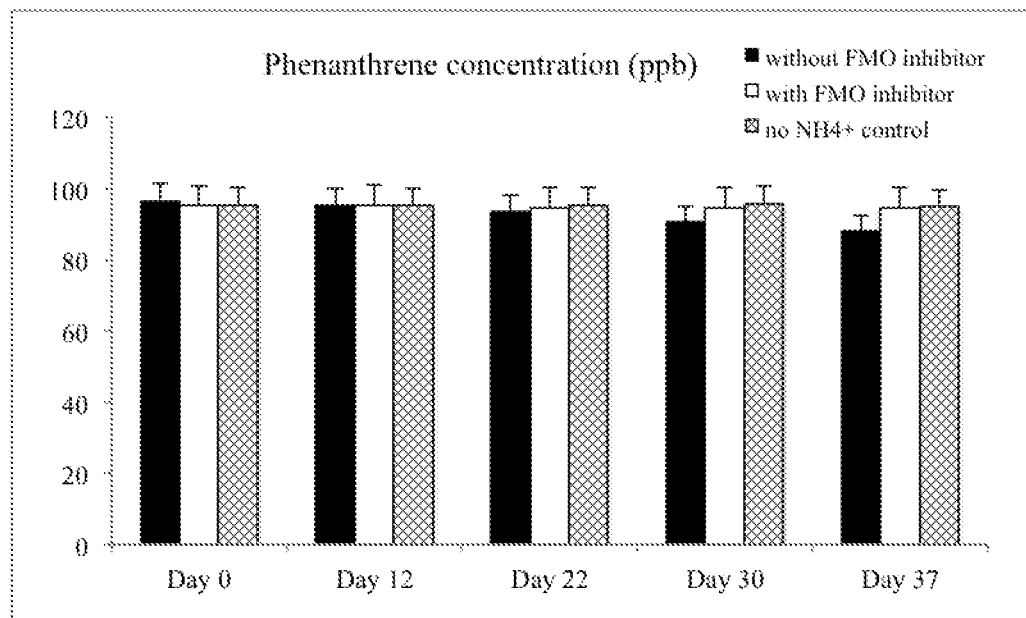

Referring to FIGS. 18A-18B, TCE, PCE, benzene and phenanthrene degradation were found in all Feammox active samples, but not in the samples that included Feammox enzyme inhibitor (sodium bisulfide) and samples without $NH_4^+$. It was observed that 36% of TCE, 28% of PCE, 20% of benzene and 8.8% of phenanthrene was degraded over an incubation period of approximately one month. $NH_4^+$ oxidation was not seen in any of the control conditions, which suggests that Acidimicrobiaceae bacteria A6 were not active in these conditions that also did not result in the degradation of the organics.

It should be noticed that all of the above are extremely recalcitrant compounds, especially in anaerobic environments. Higher degradation rates can be achieved by having larger bacterial numbers. The bacterial numbers for higher degradation may be $10^6$, $10^8$ or $10^{10}$ cells per ml of pure A6.

Example 23. Characteristics of Feammox Acidimicrobiaceae Bacterium A6 and Enzyme Identification Feammox bacteria were isolated in inorganic $NH_4^+$-Ferric iron solid medium from wetland soils collected in New Jersey as described in Examples 2-17. The bacteria were cultured in liquid and solid media.

Inorganic $NH_4^+$-Ferric iron liquid medium contained the following components per liter: 177 mg $NH_4Cl$, 77.9 mg $(NH_4)_2SO_4$, 19.8 mg $NaHCO_3$, 71.0 mg $KHCO_3$, 9.00 mg $KH_2PO_4$, 100 mg $MgSO_4\cdot 7H_2O$, and 60.0 mg $CaCl_2\cdot 2H_2O$. 3.37 g ferrihydrite, 18.42 mg antraquinone-2,6-disulfonate (AQDS) and 1 mL trace element solution and vitamin (ATCC®). Inorganic $NH_4^+$-Ferric iron solid medium was prepared with liquid medium and 0.8% agar, 0.2 mL 3.37 g $L^{-1}$ ferrihydrite was spread on the surface.

Figure 19A:
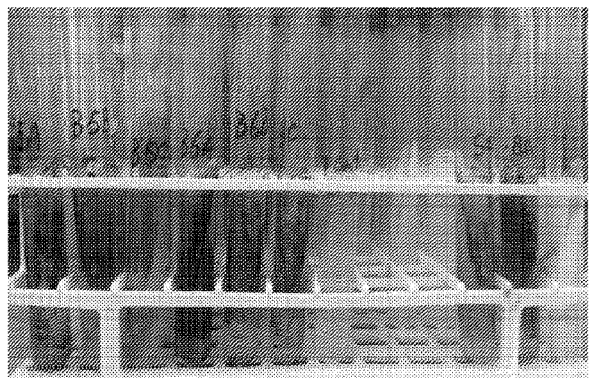
FIGS. 19A-19D illustrate A6 bacterial cultures and cells.
Figure 19B:
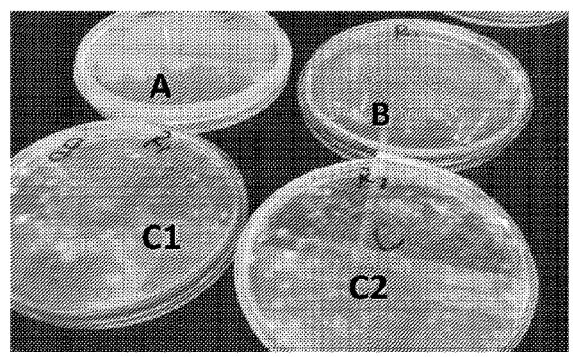
Figure 19C:
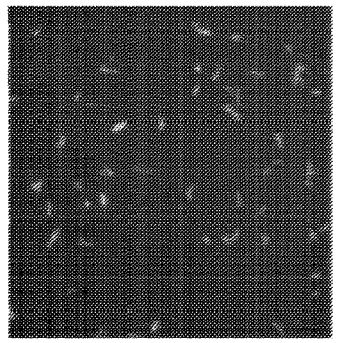
Figure 19D:
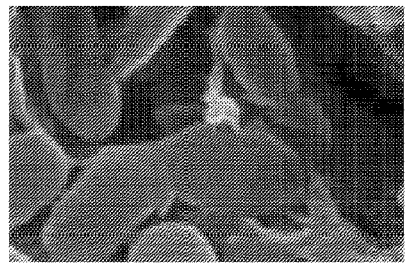

FIGS. 19A-19D illustrate A6 bacterial cultures and cells. FIG. 19A illustrates growth of the A6 bacterium in the liquid medium. Cultures of A6 became increasingly turbid and black-colored (due to accumulation of ferrous iron) during incubation. Culture doubling times of the A6 isolate were 10.2 days. FIG. 19B illustrates A6 growth on the solid inorganic $NH_4^+$-ferric iron medium. Colonies of A6 are displayed with black spot (iron-encrusted) on the solid medium. FIGS. 19C-19D show rod-shaped A6 cells. The cells were 1.5-3 mm long by 0.5 mm wide. The A6 bacteria are gram-positive bacteria. On the solid medium, colonies with black spot (accumulation of ferrous iron) were collected and transferred to inorganic $NH_4^+$-Ferric iron liquid medium. Their Feammox activity was verified by the $NH_4^+$ oxidation and iron reduction rates. A strain of Actinobacteria was isolated and identified as Feammox bacteria, and named Feammox Acidimicrobiaceae bacterium A6. The pH optimum for growth of A6 was 4.5, but reasonable activity was detected from pH 2 to 7. Its temperature optimum was 25° C., and a doubling time of 10.2 days. A $^{13}C$ labeled $CO_2$ amendment was conducted, and the $^{13}C$ in cells of A6 increased from 1.80% to 10.3% after 14 days incubation. In a separate incubation, $^{15}NH_4Cl$ was added with a final concentration of 0.5 mmol $L^{-1}$, and 0.133 mmol $L^{-1}$ of $^{15}NO_2^-$ was detected, while no $^{15}NO_3^-$ was produced.

The genome size and guanine-cytosine content of A6 are 3.3 mega base pairs (Mb) and 52%. The Feammox ammonium Monooxygenase (FMO) gene (SEQ ID NO: 8), was identified. FMO is considered to be the functional gene coding ammonium oxidation coupled to ferric iron reduction in A6.

Isolation, Purification and Cultivation of Bacteria: Continuous Flow Membrane Feammox Enrichment Reactor Soil samples from wetland soils collected in New Jersey were inoculated into a continuous flow membrane reactor, which was operated under anaerobic conditions by constantly purging $N_2$ trough the reactor's headspace at a room temperature (25° C.), and with a 48 hour hydraulic retention time. FIG. 11 illustrates a scheme of a membrane reactor for $NH_4^+$ oxidation via Feammox. Referring to this figure, 1 refers to the feed solution, 2 refers to the feed pump, 3 refers to the membrane module, 4 refers to the floater connected to an electrical on/off switch, 5 refers to the ceramic diffuser, 6 refers to the $N_2$ supplier, 7 refers to the water bath, 8 refers to outflow, and 9 refers to the outflow pump. Inorganic $NH_4^+$-Ferric iron liquid medium contained the following components per liter: 177 mg $NH_4Cl$, 77.9 mg $(NH_4)_2SO_4$, 19.8 mg $NaHCO_3$, 71.0 mg $KHCO_3$, 9.00 mg $KH_2PO_4$, 100 mg $MgSO_4\cdot 7H_2O$, and 60.0 mg $CaCl_2\cdot 2H_2O$. 3.37 g ferrihydrite, 18.42 mg AQDS and 1 mL trace element solution and vitamin (ATCC®). pH was controlled at around 4-5, and dissolve oxygen was <0.10 mg/L. Samples form the outflow were collected every two days, and sludge samples from reactor were collected and kept at −20° C. for molecular biology analysis.

454 pyrosequencing was performed with samples collected from the membrane reactor after 150 days of reactor operation with Domain-specific primers, targeting the V3-V5 region of the 16S rDNA of bacteria were amplified following methods suggested by Pinto et al. 2012, PLoS One 7: 43093, which is incorporated herein by reference as if fully set forth. And the results were compared with samples from previous incubation on days 0, 30, 90, 160. Acidimicrobiaceae bacterium A6, which belongs to the Actinobacteria phylum, was the dominant species in the incubation experiments after 180 days of incubation (14.8% in terms of cell numbers) and increased in the membrane reactor after 150 days of operation (40.2% in terms of cell numbers).

Growth on Solid Media:

Inorganic $NH_4^+$-Ferric iron solid media was prepared with liquid media and 0.8% agar, 0.2 mL 3.37 g $L^{-1}$ ferrihydrite was spread on the surface.

Figure 20:
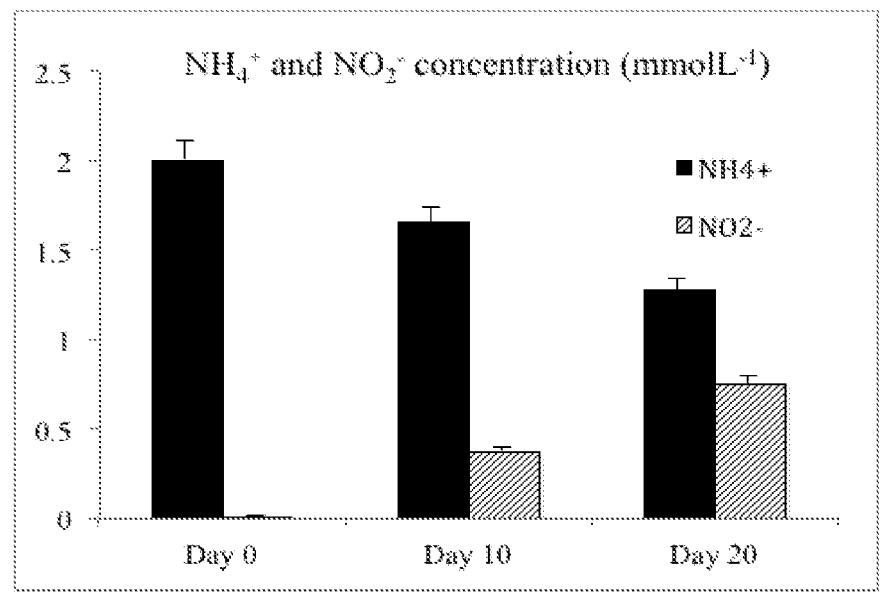
FIG. 20 illustrates anaerobic oxidation of ammonium by the A6 isolate. Filled bars are for results with $NH_4^+$ and stripped bars are results with $NO_2^-$.

On the solid medium, colonies with black spot (accumulation of ferrous iron) were collected and transferred to inorganic $NH_4^+$-Ferric iron liquid media. FIG. 20 illustrates anaerobic oxidation of ammonium by the A6 isolate. Referring to FIG. 20, bacterial cells were incubated for 20 days on the inorganic, $NH_4^+$-ferric iron media, pH 4.5. The A6 concentration was $10^5$ copies per mL. 0.738 mM of $NH_4^+$ was oxidized and 0.710 mM of $NO_2^-$ was produced. Still referring to FIG. 20, the Feammox activity of the bacterial cells was verified by the $NH_4^+$ oxidation and iron reduction rates. A strain of Actinobacteria was isolated and identified as Feammox bacteria, and named Feammox Acidimicrobiaceae bacterium A6. Referring to FIGS. 19C-19D, microscopic examination showed that cells were rod-shaped, 1.5-3 mm long by 0.5 mm wide, gram-positive.

Growth on Liquid Media:

In ferric iron-containing liquid media, cultures of A6 became increasingly turbid and black-coloured (due to accumulation of ferrous iron) during incubation. Microscopic examination showed that endospores were produced. The pH optimum for growth of isolate A6 were 4.5, and its temperature optimum was 25° C. Under optimum conditions of pH and temperature, culture doubling times of isolate A6 were 10.2 days.

Anaerobic Oxidation of Ammonium—Ammonium Oxidation Rates

The A6 isolate was incubated for 20 days on the inorganic, $NH_4^+$-Ferric iron media, at a pH 4.5. The A6 bacterial concentration was $10^5$ copies per mL. FIG. 20 illustrates concentrations of $NH_4^+$ and $NO_2^-$ during anaerobic oxidation of ammonium. After incubation, 0.738 mM of $NH_4^+$ was oxidized and 0.710 mM of $NO_2^-$ was produced.

Effect of $NH_4^+$ Concentration on Feammox.

Figure 21:
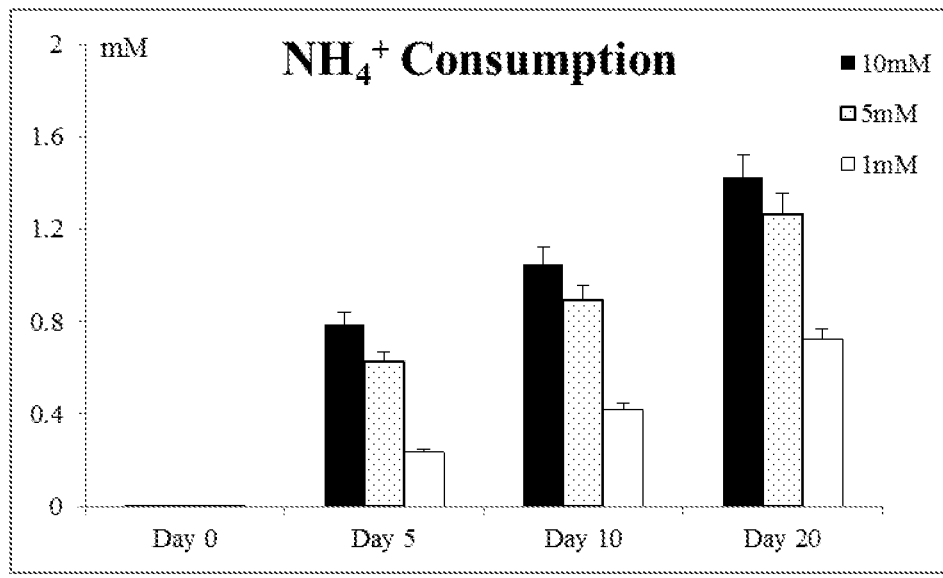
FIG. 21 illustrates an effect of $NH_4^+$ concentration on its consumption by A6. 10 mM $NH_4^+$ results are reported in the left filled bar of each of days 0, 5, 10 and 20 panels. 5 mM $NH_4^+$ are reported in the middle dotted bar of each of days 0, 5, 10 and 20 panels. 1 mM $NH_4^+$ is reported in the right open bar of each of days 0, 5, 10 and 20 panels.

FIG. 21 illustrates an effect of $NH_4^+$ concentration on its consumption by A6. Referring to this figure, the isolate A6 was incubated for 20 days in the inorganic $NH_4^+$-Ferric iron media, pH4.5. A6 included $10^5$ copies per mL. 10 mM ferrihydrite and three different amounts (10 mM, 5 mM, 1 mM) of $NH_4^+$ were added initially. Higher $NH_4^+$ consumption rates by Feammox were found for higher $NH_4^+$ concentration incubation.

$^{15}N$ Isotope Incubation $^{15}NH_4Cl$ was added with a final concentration of 0.5 mmol $L^{-1}$ and 0.133 mmol $L^{-1}$ of $^{15}NO_2^-$ was detected after 7 days incubation, while no $^{15}NO_3^-$ was produced. The data was summarized in Table 4.

TABLE 4

Summary of $^{15}N$ isotope incubation

|  | $^{14}N$ | $^{15}N$ |
|---|---|---|
| D1-NH4+ | 0.892 | 0.108 |
| D1-NO2− | 0.995 | 0.005 |
| D1-NO3− | 0.995 | 0.005 |
| D7-NH4+ | 0.847 | 0.153 |
| D7-NO2− | 0.757 | 0.243 |
| D7-NO3− | 0.992 | 0.008 |

|  | D1 | D7 |
|---|---|---|
| 15N-NH4+ | 0.5192 | 0.3862 |
| 15N-NO2− | 0.0001 | 0.1330 |
| 15N-NO3− | 0.0001 | 0.0001 |

The data confirmed that $NO_2^-$ is the main product of $NH_4^+$ oxidation in Feammox reaction.

Figure 22:
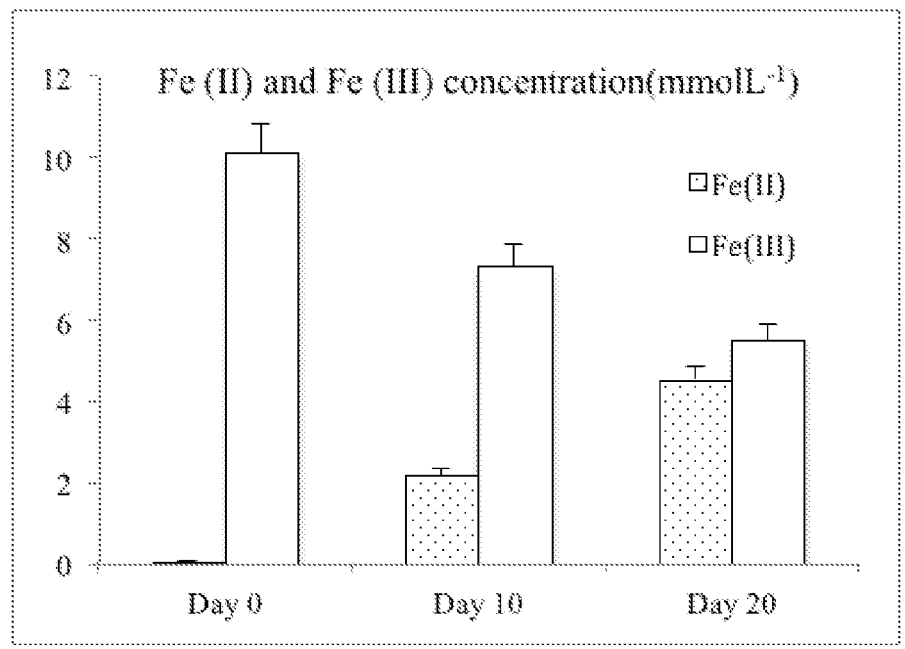
FIG. 22 illustrates iron reduction rates. Fe(II) results are reported in the left bar of each of the day 0, 10, and 20 panels. Fe(III) results are reported in the right bar of each of the days 0, 10, and 20 panels.

Reduction of Ferric Iron Reduction Rates:

FIG. 22 illustrates iron reduction rates. The A6 cells were incubated for 20 days on the inorganic, $NH_4^+$-ferric iron medium, pH 4.5. The A6 concentration was $10^5$ copies per mL. After incubation, 4.330 mM of $NH_4^+$ was oxidized, and 4.317 mM of Fe(II) was produced.

Figure 23:
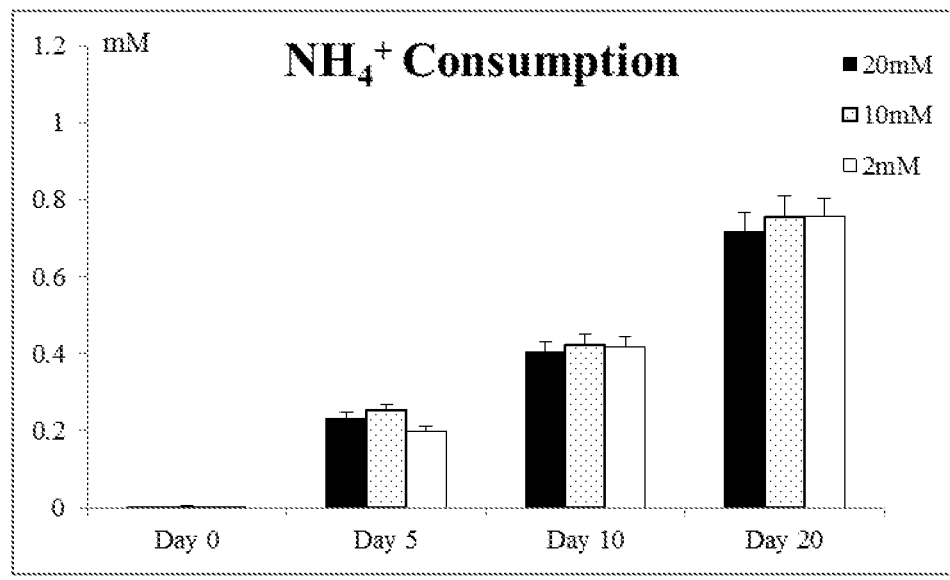
FIG. 23 illustrates an effect of iron concentration on Feammox. 20 mM $NH_4^+$ results are reported in the left filled bar of each of days 0, 5, 10 and 20 panels. 10 mM $NH_4^+$ results are reported in the middle dotted bar of each of days 0, 5, 10 and 20 panels. 2 mM $NH_4^+$ results are reported in the right open bar of each of days 0, 5, 10 and 20 panels.

Effect of Iron Concentration on Feammox:

FIG. 23 illustrates an effect of iron concentration on Feammox. Referring to FIG. 23, the isolate A6 was incubated for 20 days in the inorganic $NH_4^+$-Ferric iron media, at pH4.5. A6 included $10^5$ copies per mL. 2 mM $NH_4^+$ and three different amounts (20 mM, 10 mM, 2 mM) of ferrihydrite were added initially. No significant different of $NH_4^+$ consumption by Feammox with different ferrihydrite amended during incubation was found. As long as there was sufficient iron included in the media, no effect of iron concentration on Feammox was observed.

Figure 25A:
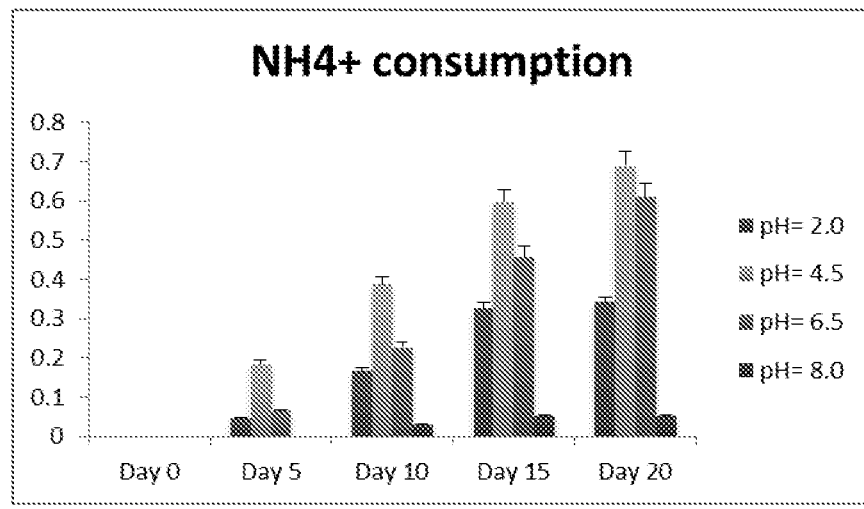
FIGS. 25A-25B illustrate determination of the effect of pH on $NH_4^+$ consumption (FIG. 25A) and bacterial growth (FIG. 25B). pH=2 results are reported in the far left bar of each of days 0, 5, 10, 15 and 20 panels. pH=4.5 results are reported in the left middle bar of each of days 0, 5, 10, 15 and 20 panels. pH=6.5 results are reported in the right middle bar of each of days 0, 5, 10, 15 and 20 panels. pH=8 results are reported in the far right bar of each of days 0, 5, 10, 15 and 20 panels.
Figure 25B:
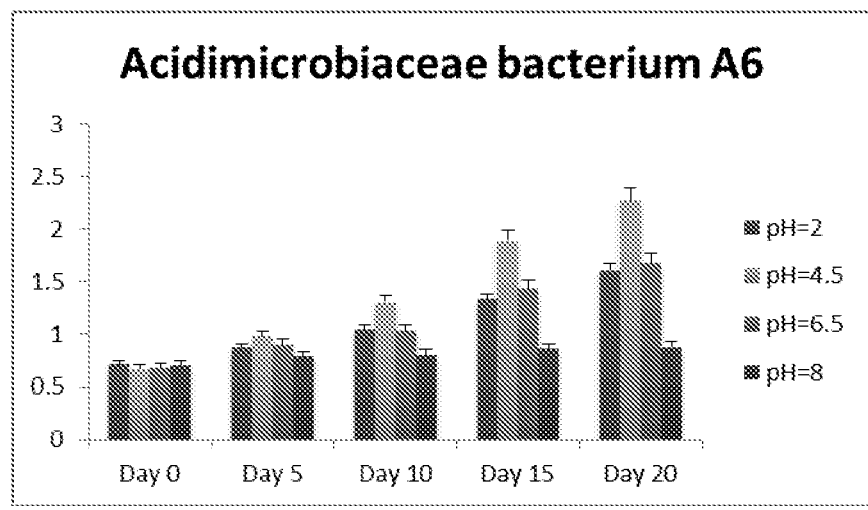

Determination of pH and Temperature Optima:

Isolate A6 incubation for 20 Days under different pH gradient in inorganic, $NH_4^+$-Ferric iron media. A6 is 105 copies per mL. pH adjust to 2, 4.5, 6.5, 8.0 by HCl and NaOH. FIGS. 25A-25B illustrate determination of the effect of pH on $NH_4^+$ consumption (FIG. 25A) and bacterial growth (FIG. 25B). pH=2 results are reported in the far left bar of each of days 0, 5, 10, 15 and 20 panels. pH=4.5 results are reported in the left middle bar of each of days 0, 5, 10, 15 and 20 panels. pH=6.5 results are reported in the right middle bar of each of days 0, 5, 10, 15 and 20 panels. pH=8 results are reported in the far right bar of each of days 0, 5, 10, 15 and 20 panels. The pH optimum for growth of A6 was 4.5, but reasonable activity was detected from pH 2 to 7.

Figure 24:
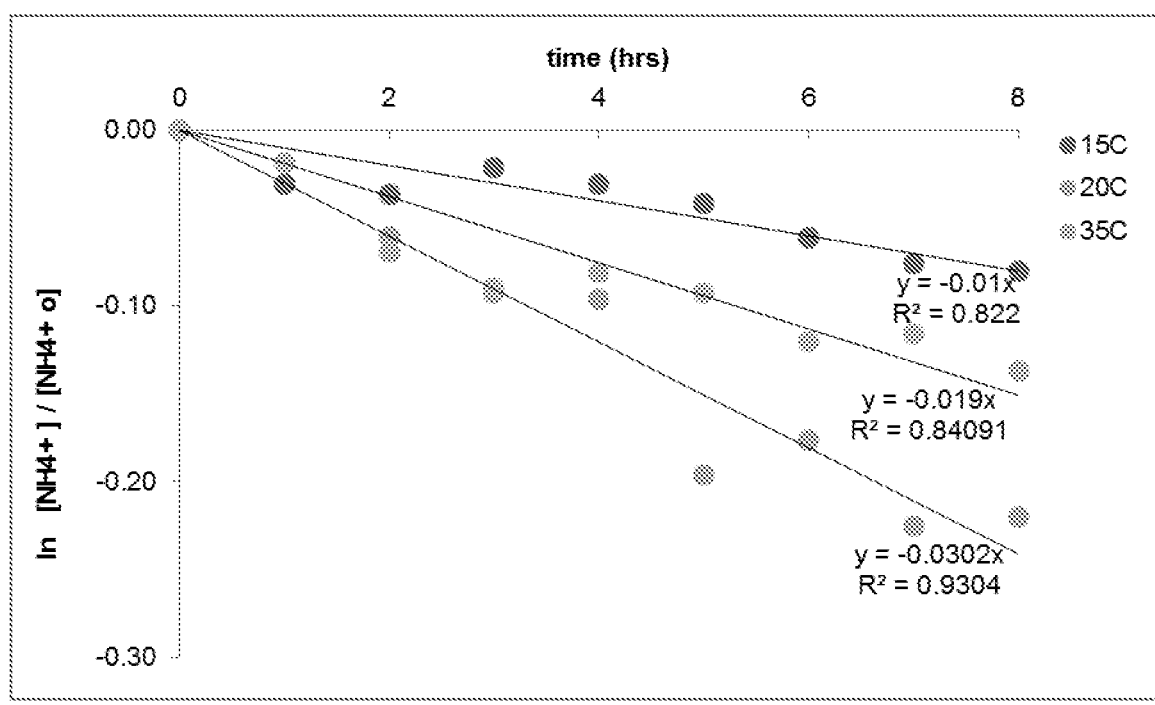
FIG. 24 illustrates the relative ammonium removal rate constants (k) by Acidimicrobiaceae-bacteria A6 at 15° C. (top line), 20° C. (middle line) and 35° C. (lower line).

Temperature Gradient:

FIG. 24 illustrates the relative ammonium removal rate constants (k) by Acidimicrobiaceae-bacteria A6 at 15° C., 20° C. and 35° C. Referring to this figure, the highest rate was measured at 20° C., k=0.03 $hr^{-1}$, followed by 35° C., k=0.019 $hr^{-1}$, and 15° C., k=0.01 $hr^{-1}$.

Utilization of Organic Substrates:

Growth yields of isolate A6 have no growth difference in media containing glycerol, citric acid and glutamic acid with in control cultures $NaHCO_3$ added. The data shows that A6 is an autotroph utilizing inorganic carbon but the presence of different organic carbons does not affect its growth.

It was observed that culturing of the isolate A6 in yeast extract media required one or more additional growth factors.

Heavy Metal Tolerance:

This gram-positive isolate was able to grow in media containing elevated concentrations of the heavy metals tested. The A6 isolate was tested for the ability to grow in the media supplemented with 100 μM-100 mM of copper, 10-200 mM of zinc, 20-100 μM of uranium, 10-200 mM of ferric iron or 10-200 mM of ferrous iron. It was observed that the isolate A6 grew in 260 mM on ferric iron. However, addition of ferrous iron did not inhibit the bacterial growth. Growth also occurred in the presence of 100 mM, but not 200 mM, copper. It was also observed that 50 mM zinc inhibited growth. The A6 bacteria was growing in the presence of the tested concentrations of uranium but it was found that uranium was toxic to the bacterial cells at 200 μM.

Autotrophic growth and CO2 fixation—assimilation of $CO_2$ in cultures of isolate A6: A6 was able to grow in organic carbon-free liquid media. A $^{13}C$ labeled $CO_2$ amendment was conducted with a Thermo MAT 253™ stable isotope ratio mass spectrometer, and the $^{13}C$ in cells of A6 increased from 1.80% to 10.3% after 14 days incubation.

TABLE 5

Summary of assimilation of $CO_2$

|  | Cell (with methanol wash) | | DNA | |
|---|---|---|---|---|
|  | $^{12}C$ | $^{13}C$ | $^{12}C$ | $^{13}C$ |
| Day 0 | 98.2% | 1.80% | 98.9% | 1.10% |
| Day 14 | 89.7% | 10.3% | 82.0% | 18.0% |

Screening of RuBisCo (Ribulose-1,5-Bisphosphate Carboxylase/Oxygenase) Genes:

RuBisCO genes were amplified from cell lysates of A6. Both cbbL and cbbM genes were successfully amplified.

Figure 26:
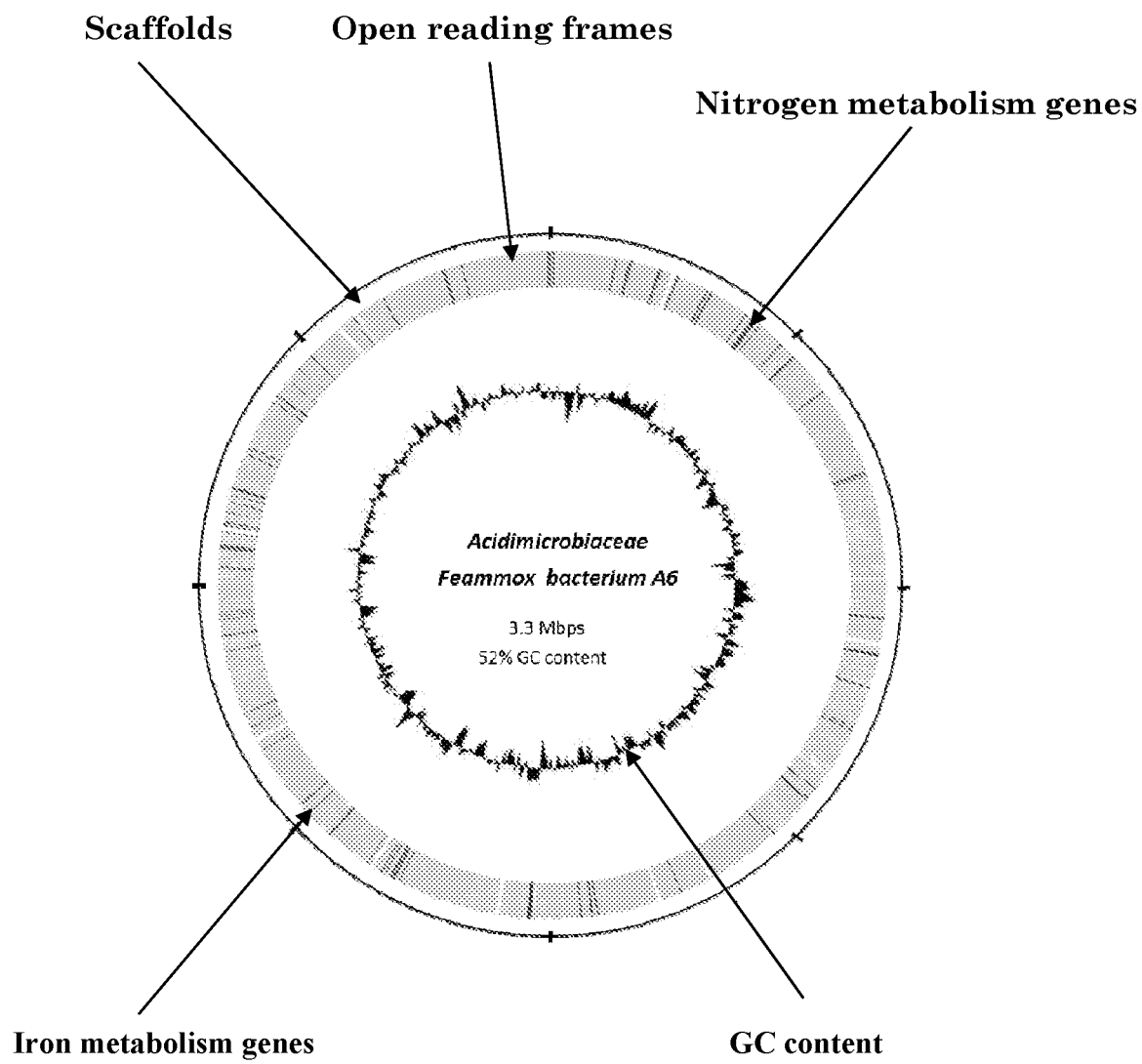
FIG. 26 illustrates a schematic representation of the genome of the Acidimicrobiaceae Feammox bacterium A6.

Full Sequencing and Functional Gene-Single-Copy Gene Analysis:

FIG. 26 illustrates a schematic representation of the genome of the Acidimicrobiaceae Feammox bacterium A6. The genome size and guanine-cytosine content of A6 are 3.3 mega base pairs (Mb) and 52%. Genotypic traits are summarized in Table 6.

TABLE 6

Genotypic traits

| Attribute | Value |
| --- | --- |
| Genome size (bp) | 3,106,468 |
| Plasmid size (bp) | 106,011 |
| DNA Coding region (bp) | 2,991,461 |
| DNA G + C content (bp) | 1,709,039 |
| RNA genes | 42 |
| rRNA operons | 2 |
| Protein-coding genes | 2032 |
| Pseudo genes | 58 |
| Genes with function prediction | 1579 |
| Genes assigned to COGs | 1392 |
| Genes assigned Pfam domains | 1497 |
| Genes with transmembrane helices | 538 |

Functional Gene:

The gene encoding Feammox ammonium Monooxygenase (FMO) having a sequence of SEQ ID NO: 12 was identified. The gene was located in the bacterial plasmid. The FMO is considered to be the functional gene coding ammonium oxidation coupling to ferric iron reduction in A6.

FMO Activity.

Figure 27:
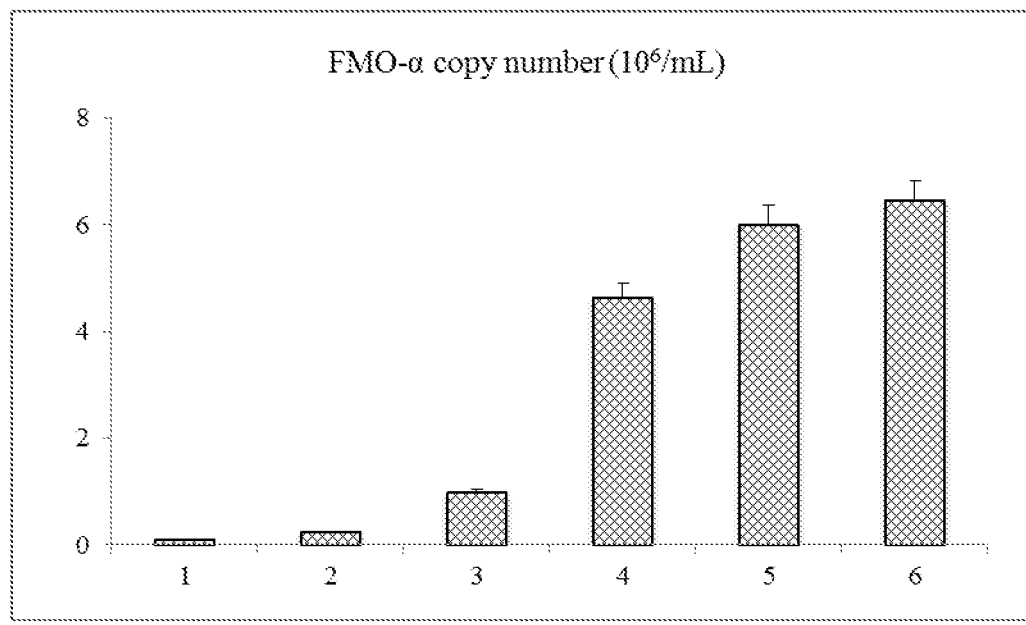
FIG. 27 illustrates the FMO activity.

FIG. 27 illustrates the FMO activity. Referring to FIG. 27, isolate A6 was incubated for 20 days under pH 4.5, in inorganic $NH_4^+$-Ferric iron media. Copy number of Feammox gene, FMO-a, was analyzed during the incubation which showed active Feammox reaction. It was observed that that FMO activity increased as total microbial as well as Acidimicrobiaceae Feammox bacterium A6 activity increased.

Figure 28:
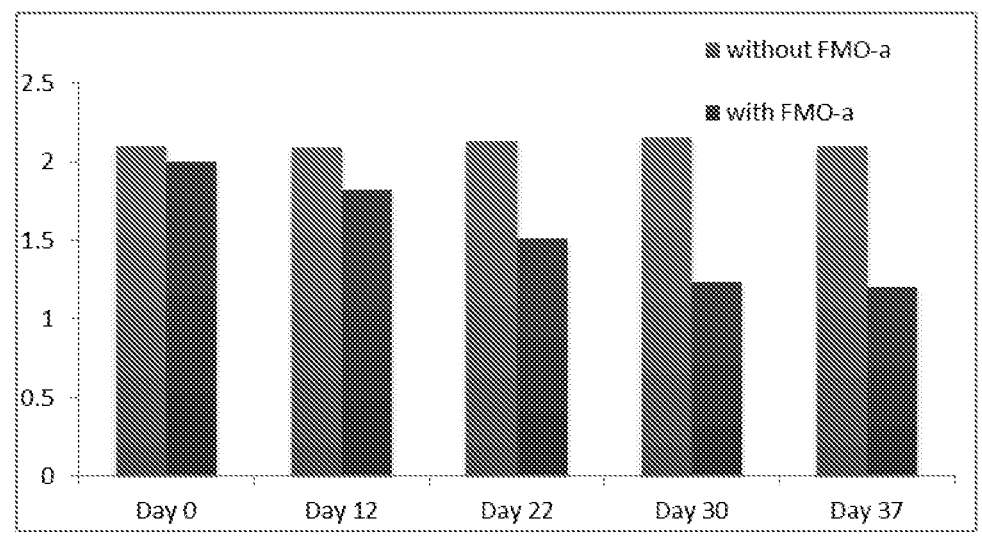
FIG. 28 illustrates oxidation of $NH_4^+$ by Acidimicrobiaceae bacterium A6 when the FMO activity in the presence (left bars for each of 0, 12, 22, 30 and 37 day panels) and absence (right bars for each of 0, 12, 22, 30 and 37 day panels) of a broad enzyme inhibitor (NaS).

FIG. 28 illustrates oxidation of $NH_4^+$ by Acidimicrobiaceae bacterium A6 and the FMO activity in the presence (without FMO-a) and absence (with FMO-a) of a broad enzyme inhibitor (NaS). Referring to FIG. 28, it was observed that the $NH_4^+$ oxidation rate decreased in the samples without FMO-a.

Phylogenetic Analysis:

According to the phylogenetic analysis, Acidimicrobiaceae bacterium A6), belonging to the Acidimicrobiaceae family, whose closest cultivated relative is *Ferrimicrobium acidiphilum* (with 92% identity) and *Acidimicrobium ferrooxidans* (with 90% identity).

Example 24. Feammox Applications

Feammox process could be applied for waste water treatment for ammonium removal without the need to supply oxygen. Oxygen supply is the highest energy cost in waste treatment plants. The process may also be used in the design of engineered wetlands for nitrogen removal. That would be important in the agricultural and livestock industry. There might be many other applications.

Ammonium oxidation requires oxygen. Anammox process works with nitrite, but it requires high temperatures (around 82° F.). Since the bacterium was isolated at a New Jersey wetland, it is reasonable that it will function at lower temperatures. This is important for waste treatment, since in the winter waste water temperatures are around 40° F. Feammox may be applied for developing more temperature robust treatment processes that do not need aeration. Means to recycle iron and/or use scrap grounded up iron may be developed to be supplied for Feammox. The process similar to the one tested in incubation experiments will be utilized in a simple prototype reactor. Table 6 describes $NH_4^+$ removal using the reactor illustrated in FIG. 11 contrast Anammox and Feammox.

TABLE 7

Comparison of Feammmox and Anammox reactors

| | Feammox reactor | Anammox reactor | Conditions |
| --- | --- | --- | --- |
| Temperature | 20-25° C. | 28-35° C. | Feammox con work if T~15° C. |
| pH | 4.5-6 | cirumneutral | Feammox can work if pH~2 |
| Aeration time | 0 h/day | Non or 1.5 h/day | Feammox require Fe(III) |
| Doubling time | 8-12 days | 10-12 days | Both are slow growing bacteria |
| $NH_4^+$ removal | 85% | 41% (no aeration) 72% (with aeration) | $NH_4^+$ inflow concentration 5 mM; Retention Time 48 h |

It was shown that the Feammox reactor is as efficient if not more than the anammox reactor. Finally, sludge was mixed from the Feammox and Anammox reactors, showing that a combined Feammox/Anammox mode is feasible and does not require partial aeration, which is required by Anammox to convert some $NH_4^+$ to NO2-, which in the combined process is done by Feammox. Operating conditions were different for the Feammox/Anammox reactor.

A combined Feammox/Anammox process results in less iron demand than a pure Feammox process. Anammox with 20% Feammox sludge may result in 70% $NH_4+$ removal without aeration.

Example 25. Feammox in Electrogenic Microbial Reactors

Electrogenic microbial reactors such as Microbial Fuel Cells (MFCs) and Microbial Electrolysis cells (MECs) are bioelectrochemical systems that extract energy from a substrate (Call and Logan 2011 *Biosen. Bioelectron.* 26(11): 4526-4531, which is incorporated herein by reference as if fully set forth). This process harvests electrons biologically, which are then transferred to the anode that functions as the terminal electron acceptor for the microorganisms in the system, and $H_2$ is produced at the anode. FIG. 29 illustrates a scheme of the electrogenic microbial reactor. Referring to FIG. 29, the reactor includes a vial, a graphite anode connected via titanium wire to the positive terminal of the power supply, a stainless steel catode connected via stainless steel wire to the negative terminal of the power supply.

MECs require a small potential applied from an external power source ($E_{AP}$>0.25 V), resulting in $H_2$ production at the anode (Logan, Hamelers et al. 2006 *Environ. Sci. Technol.* 40(17):5181-5192; Call and Logan 2008 *Environ. Sci. Technol.* 42(9):3401-3406; Call and Logan 2011, all of which e incorporated by reference as if fully set forth). When the anode in a MFC or MEC works in place of a finite electron acceptor (i.e., Fe(III)), the bacterial growth is no longer limited by the consumption of that electron acceptor.

Some electrogenic iron reducing microorganisms; e.g., *Geobacter* sp., are capable of transferring the electrons to an anode instead of Fe(III) and grow in MECs (Logan 2009, which is incorporated herein by reference as if fully set forth). Thus, we have tested A6's ability to grow in small MECs has been tested. It was found that under constant mixing, and with a voltage input of 0.7V, MECs seeded with a pure culture of A6 to which 5 mM ammonium was added produced a current density (I) that increased from 0.02 A/m$^3$ to up to ~36 A/m$^3$, while the autoclaved control increased to only 1.3 A/m$^3$ (Call and Logan 2011, which is incorporated herein by reference as if fully set forth). The A6 biomass increased from 10$^4$ copies of DNA/ml to 9×10$^5$ over 14 days of operation. An electron shuttling compound, AQDS (Anthraquinone-2,6-disulfonate) had to be added to the solution, since unlike *Geobacter*, A6 does not seem to colonize the anode. When an electron shuttling compound like AQDS is added, the electron will be transferred from $NH_4^+$ to AQDS in solution and then to the anode. Hence, MECs and MFCs may be the ideal Feammox reactor configuration for $NH_4^+$ removal from wastewater via Feammox that solves the Fe(III) supply problem. Other configurations and materials can also be used to construct MECs as well as MFCs.

Although the equation in FIG. 29 shows that the solution pH should decrease while $NH_4^+$ is being oxidized, it was observed that pH increases. Our hypothesis is that this is due to the $CO_2$ consumption by A6, which is an autotroph. Hence, $CO_2$ control may be for the growth of a pure A6 culture. $CO_2$ addition should not be needed when organics are degraded simultaneously since $CO_2$ is produced during the biodegradation of organics.

Example 26. Addition of Elemental Sulfur Stimulates Feammox Activity

Standard Feammox incubations were conducted with the addition of S(0). It was shown that by adding S(0) to the medium the growth rate of Acidimicrobiaceae bacterium A6 was increased, as well as the removal of ammonium, and the production of Feammox related enzymes (Accession numbers AF5136601-AF5136621). SEQ ID NOS of amino acid and nucleic acid sequences Feammox related enzymes ERCFMO_0001-FERCFMO_0021 (correspond to AF5136601-AF5136621) are listed in Table 8 below.

TABLE 8

SEQ ID NOS of FMO Related Enzymes and Genes

| FMO clone* | SEQ ID NO (Gene) | SEQ ID NO (Enzyme) |
|---|---|---|
| ERCFMO_0001 | 8 | 29 |
| ERCFMO_0002 | 9 | 30 |
| ERCFMO_0003 | 10 | 31 |
| ERCFMO_0004 | 11 | 32 |
| ERCFMO_0005 | 12 | 33 |
| ERCFMO_0006 | 13 | 34 |
| ERCFMO_0007 | 14 | 35 |
| ERCFMO_0008 | 15 | 36 |
| ERCFMO_0009 | 16 | 37 |
| ERCFMO_0010 | 17 | 38 |
| ERCFMO_0011 | 18 | 39 |
| ERCFMO_0012 | 19 | 40 |
| ERCFMO_0013 | 20 | 41 |
| ERCFMO_0014 | 21 | 42 |
| ERCFMO_0015 | 22 | 43 |
| ERCFMO_0016 | 23 | 44 |
| ERCFMO_0017 | 24 | 45 |
| ERCFMO_0018 | 25 | 46 |
| ERCFMO_0019 | 26 | 47 |
| ERCFMO_0020 | 27 | 48 |
| ERCFMO_0021 | 28 | 49 |

*Clone refers to the clone of uncultured bacterium particulate methane monooxygenase/ammonia monooxygenase subunit A, partial cds, also referred to as the FMO.

Based on the findings that Feammox can degrade TCE/PCE and PAHs, it was investigated whether one or a contortion of these enzymes are involved in these reactions.

Table 9 describes an increase in copy numbers of the genes encoding clones of the FMO enzyme in response to the addition of S(0).

TABLE 9

Increase in Copy Numbers of the Genes Encoding Clones of the FMO Enzyme in Response to Addition of S(0)

| Gene Encoding Clone of the FMO Enzyme | Origin of the Clone | initial | Number of A6 cells (×10$^4$)/mL of culture | | | Gene copy number (×10$^4$)/mL of culture | | |
|---|---|---|---|---|---|---|---|---|
| | | | after 20 days incubation with S(0) | after 20 days incubation without S(0) | with S(0)/without S(0) | after 20 days incubation with S(0) | after 20 days incubation without S(0) | with S(0)/without S(0) |
| ERCFMO_0001 | Pure* | 23.00 | 121.77 | 48.88 | 2.49 | 258.00 | 38.91 | 6.631 |
| ERCFMO_0002 | Pure* | 41.79 | 253.49 | 210.48 | 1.20 | 138.00 | 72.59 | 1.901 |
| ERCFMO_0003 | Enrichment ** | 294.98 | 113.65 | 75.53 | 1.50 | 162.00 | 73.54 | 2.203 |
| ERCFMO_0004 | Enrichment ** | 22.81 | 215.65 | 183.08 | 1.18 | 212.00 | 31.71 | 6.686 |
| ERCFMO_0005 | Pure* | 59.30 | 75.09 | 21.85 | 3.44 | 78.00 | 25.13 | 3.104 |
| ERCFMO_0006 | Enrichment ** | 226.56 | 275.09 | 236.90 | 1.16 | 261.00 | 20.52 | 12.718 |
| ERCFMO_0007 | Pure* | 65.38 | 146.68 | 29.33 | 5.00 | 137.00 | 16.84 | 8.135 |
| ERCFMO_0008 | Enrichment ** | 199.70 | 196.86 | 155.78 | 1.26 | 308.00 | 133.40 | 2.309 |
| ERCFMO_0009 | Enrichment ** | 93.68 | 312.54 | 236.33 | 1.32 | 237.00 | 215.13 | 1.102 |
| ERCFMO_0010 | Enrichment ** | 80.59 | 217.89 | 120.70 | 1.81 | 259.00 | 129.07 | 2.007 |
| ERCFMO_0011 | Pure* | 51.70 | 70.82 | 77.63 | 0.91 | 70.00 | 25.65 | 2.729 |
| ERCFMO_0012 | Enrichment ** | 24.33 | 76.92 | 98.05 | 0.78 | 308.00 | 111.97 | 2.751 |

TABLE 9-continued

Increase in Copy Numbers of the Genes Encoding Clones of the FMO Enzyme in Response to Addition of S(0)

| Gene Encoding Clone of the FMO Enzyme | Origin of the Clone | initial | Number of A6 cells (×10⁴)/mL of culture | | | Gene copy number (×10⁴)/mL of culture | | |
|---|---|---|---|---|---|---|---|---|
| | | | after 20 days incubation with S(0) | after 20 days incubation without S(0) | with S(0)/without S(0) | after 20 days incubation with S(0) | after 20 days incubation without S(0) | with S(0)/without S(0) |
| ERCFMO_0013 | Enrichment ** | 439.43 | 504.46 | 388.55 | 1.30 | 329.00 | 225.75 | 1.457 |
| ERCFMO_0014 | Enrichment ** | 15.21 | 80.67 | 38.05 | 2.12 | 234.00 | 125.65 | 1.862 |
| ERCFMO_0015 | Pure* | 15.21 | 133.99 | 62.73 | 2.14 | 132.00 | 32.71 | 4.036 |
| ERCFMO_0016 | Enrichment ** | 316.27 | 372.08 | 413.23 | 0.90 | 541.00 | 407.03 | 1.329 |
| ERCFMO_0017 | Pure* | 28.09 | 141.41 | 74.44 | 1.90 | 159.00 | 82.74 | 1.922 |
| ERCFMO_0018 | Enrichment ** | 482.01 | 574.22 | 423.33 | 1.36 | 560.00 | 180 | 3.111 |
| ERCFMO_0019 | Enrichment ** | 206.79 | 226.83 | 250.00 | 0.91 | 410.00 | 120 | 3.417 |
| ERCFMO_0020 | Enrichment ** | 428.79 | 537.18 | 341.00 | 1.58 | 323.23 | 134.00 | 2.412 |
| ERCFMO_0021 | Pure* | 13.68 | 102.00 | 26.67 | 3.83 | 120.00 | 23.00 | 5.217 |

*Pure bacterial culture (10⁵/mL Acidimicrobiaceae bacterium A6 only, in series of 20 mL vials)
** Enriched bacterial culture (10⁶⁻⁷/mL Acidimicrobiaceae bacterium A6; include ~ 35%-45% of the total bacteria number)

It was observed that incubation of the bacterium A6 with S(0) resulted in increase in the number of A6 cells and the number of the copies of the genes encoding clones ERCFMO_0001, ERCFMO_0002, ERCFMO_0005, ERCFMO_0007, ERCFMO_0011, ERCFMO_0015, ERCFMO_0017, and ERCFMO_0021 of the FMO enzyme. Elemental sulfur S(0) was added to the cultures in the amount between 0.5 mM to 20 mM. However, no difference was observed between the amount of sulfur and the reaction rate in the cultures. It was observed that the small amount of sulfur added at the beginning resulted in short time of the reaction. However, more sulfur added over time prolonged the reaction time. The solubility of sulfur is $1.9(\pm 0.6) \times 10^{-8}$ mole $S_8 \cdot kg^{-1}$. Therefore, the cumulative amount of sulfur added needs to be in excess of 0.05 mM/L to affect the reaction if added once. The maximum sulfur that can be added is believed to depend on the density of sulfur (=2 kg/L). Sulfur can be added in the amount between 1 mg/L and 2 kg/L.

The references cited throughout this application are incorporated for all purposes apparent herein and in the references themselves as if each reference was fully set forth. For the sake of presentation, specific ones of these references are cited at particular locations herein. A citation of a reference at a particular location indicates a manner(s) in which the teachings of the reference are incorporated. However, a citation of a reference at a particular location does not limit the manner in which all of the teachings of the cited reference are incorporated for all purposes.

Example 27. Oxidant Enhanced Feammox Activity

Batch Incubations with Elemental Sulfur, S(0).

To set up the incubations, 30 ml of inorganic Fe(III)-$NH_4^+$ enrichment medium (iFeN) was added into 50 mL sealed serum vials. The composition of the iFeN medium (pH 4.5, which was adjusted by adding dropwise HCl) consisted of 69.55 mg/l $NH_4Cl$, 77.9 mg/l $(NH_4)_2SO_4$, 19.8 mg/l $NaHCO_3$, 71.0 mg/l $KHCO_3$, 9.00 mg/l $KH_2PO_4$, 100 mg/l $MgSO_4 \cdot 7H_2O$, and 60.0 mg/l $CaCl_2 \cdot 2H_2O$, in addition to 1 mg/l of a trace element solution and 1 mg/l of a vitamin solution (ATCC® MD-VS™). The cultures were also supplemented with 6-line ferrihydrite ($Fe_2O_3 \cdot 0.5H_2O$; prepared according to Cornell and Schwertmann, 1990), to obtain a final amount of 10 mmol/l of Fe(III). 200 mg elemental sulfur [S(0)] was then added to these 30 ml iFeN media. After inoculating the iFeN media with about $10^5$/ml of Acidimicrobiaceae sp. A6, or with enrichment Feammox cultures containing similar numbers of Acidimicrobiaceae sp. A6, the headspace of each incubation vial was vacuumed and then flushed with a $N_2/CO_2$ (80:20) mixture, which was repeated three times. The enrichment cultures were then kept in dark at 25° C. and incubated under anaerobic conditions. Three sets of control samples were prepared, 1) autoclaved control, 2) no S(0) added control, 3) no Fe(III) added control. Extra 3.0 mM of $NH_4Cl$ was add to the second incubation experiments of enrichment cultures. Anaerobic incubations were performed for 20 days, and concentrations of Fe(III) and $NH_4^+$ were analyzed daily.

Results

Figure 30:
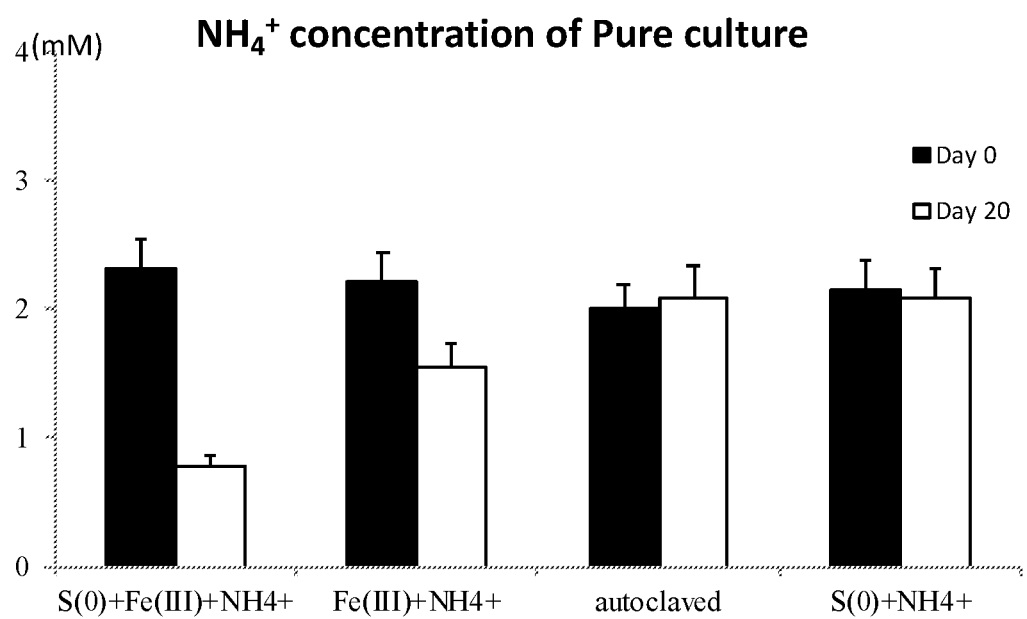
FIG. 30 illustrates the concentration of $NH_4^+$ after 20 days of incubation with Acidimicrobiaceae Feammox bacterium A6 in the presence of elemental sulfur and different controls according to some embodiments.
Figure 31:
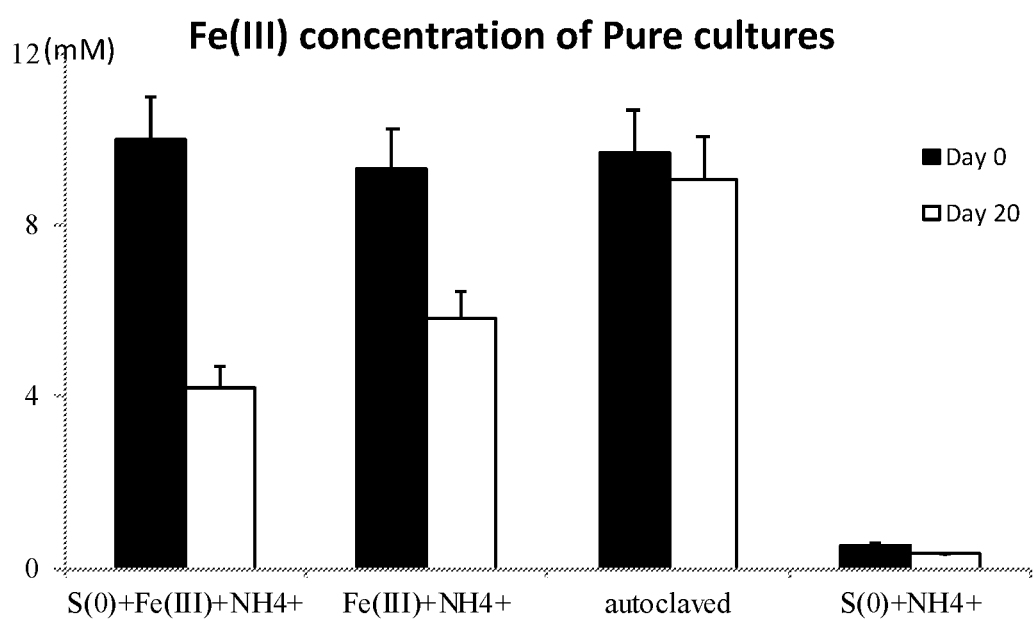
FIG. 31 illustrates concentration of Fe(III) after 20 days of incubation with Acidimicrobiaceae Feammox bacterium A6 in the presence of elemental sulfur and different controls according to some embodiments.
Figure 32:
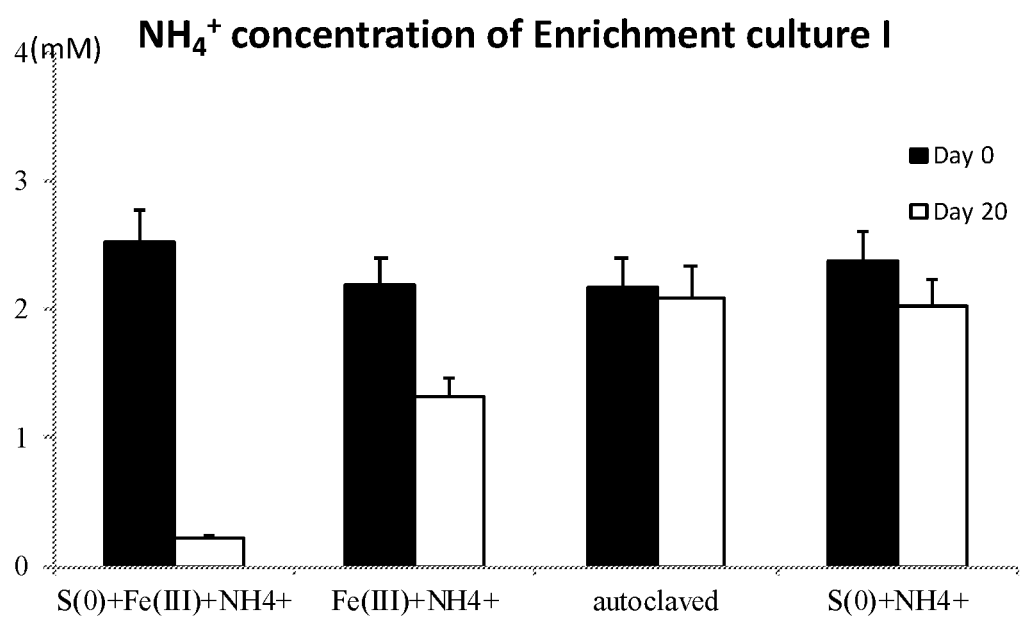
FIG. 32 illustrates the concentration of $NH_4^+$ after 20 days of incubation with an enrichment culture of Acidimicrobiaceae Feammox bacterium A6 in the presence of elemental sulfur and different controls according to some embodiments.
Figure 33:
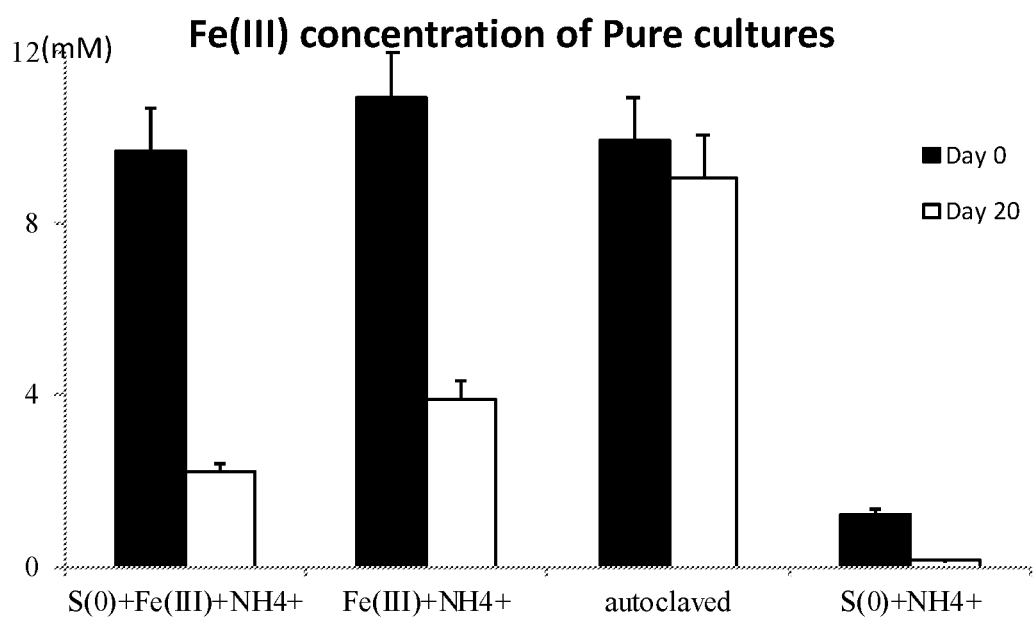
FIG. 33 illustrates the concentration of Fe(III) after 20 days of incubation with an enrichment culture of Acidimicrobiaceae Feammox bacterium A6 in the presence of elemental sulfur and different controls according to some embodiments.
Figure 34:
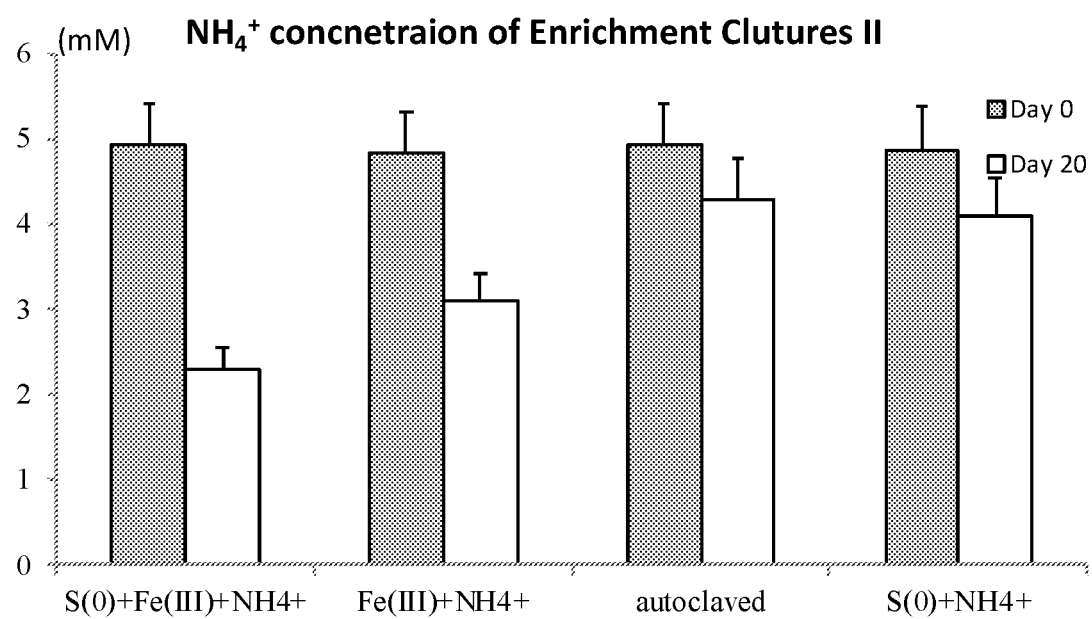
FIG. 34 illustrates the concentration of $NH_4^+$ after 20 days of incubation with an enrichment culture of Acidimicrobiaceae Feammox bacterium A6 in the presence of elemental sulfur and different controls according to some embodiments.
Figure 35:
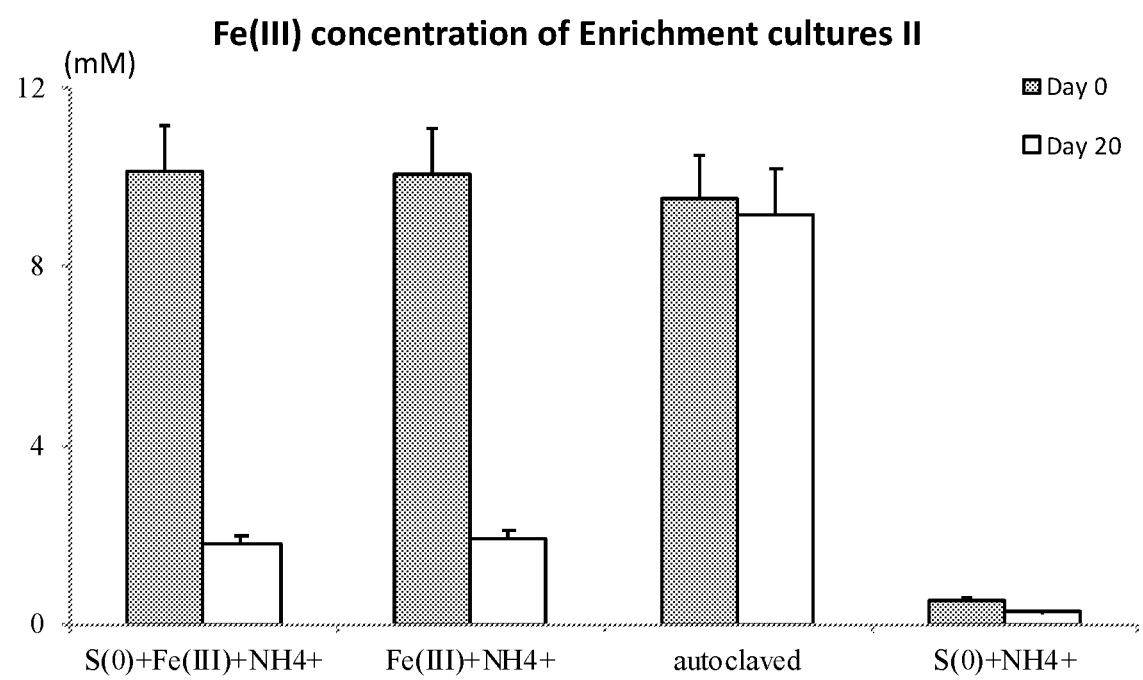
FIG. 35 illustrates the concentration of Fe(III) after 20 days of incubation with an enrichment culture of Acidimicrobiaceae Feammox bacterium A6 in the presence of elemental sulfur and different controls according to some embodiments.
Figure 36:
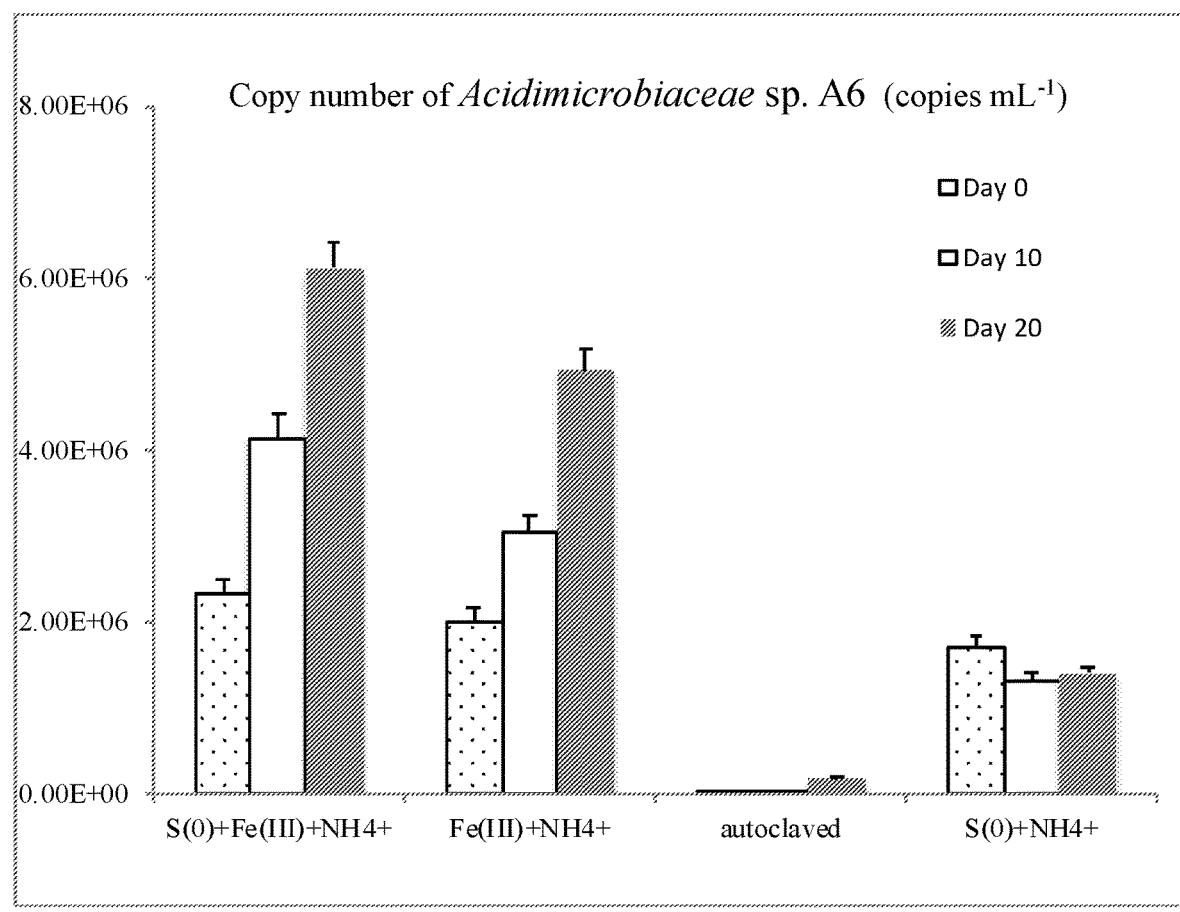
FIG. 36 illustrates copy number of 16S rRNA gene of Acidimicrobiaceae Feammox bacterium A6 during 20 days of incubation in the presence of elemental sulfur and different controls according to some embodiments.

Results of the Feammox batch incubations showing the effect of S(0) addition on ammonium removal and iron reduction with the pure culture of Acidimicrobiaceae sp. A6 are shown in FIGS. 30 and 31, and with the Acidimicrobiaceae sp. A6 enrichment culture (two separate experiments) in FIGS. 32 through 35. As illustrated in these figures, rates of ammonium removal and iron reduction in the presence of S(0) were significantly enhanced relative to the control compositions. The effect of adding S(0) on the abundance of Acidimicrobiaceae sp. A6 during the incubation with the pure culture are shown in FIG. 36. As evidenced in FIG. 36, the abundance of Acidimicrobiaceae sp. A6 was substantially enhanced by the presence of elemental sulfur relative to the various control compositions. Increases in the Acidimicrobiaceae sp. A6 population can also increase removal rates of ammonium and/or other contaminants.

Example 28. Continuous Flow Membrane Feammox Reactor Employing Elemental Sulfur, S(0)

A 2 L continuous flow membrane Feammox reactor (Huang and Jaffe, 2015), was operated under anaerobic conditions by constantly purging $N_2$ trough the reactor's headspace at a room temperature (25° C.), and with a 48-hour hydraulic retention time. A 35.5~40.2% $NH_4^+$ removal, between inflow and outflow was achieved in the membrane reactor during a one-year operation. The medium in the inflow contained the following components per liter: 177 mg $NH_4Cl$, 77.9 mg $(NH_4)_2SO_4$, 19.8 mg $NaHCO_3$, 71.0 mg $KHCO_3$, 9.00 mg $KH_2PO_4$, 100 mg $MgSO_4 \cdot 7H_2O$, and 60.0 mg $CaCl_2 \cdot 2H_2O$, and 1 mL trace element solution (Van de Graaf et al., 1996). 10.0 mmol/l of ferrihydrite were added once every week directly to the reactor. To aid in maintaining anaerobic conditions, 0.10-0.20 mmolL$^{-1}$ sodium citrate was feed to the reactor about twice per month. pH was controlled at around 4~5, and the dissolve oxygen was maintained at 0.10-0.30 mg/l.

After the reactor was running under stable conditions, 200 mg of S(0) was added to the reactor and set up day 0, twice 64 mg of S(0) were added on day 14 and 32. Samples form the inflow and outflow were collected and analyzed every day, and sludge samples from reactor were collected and kept at −20° C. for molecular biology analysis.

Figure 37:
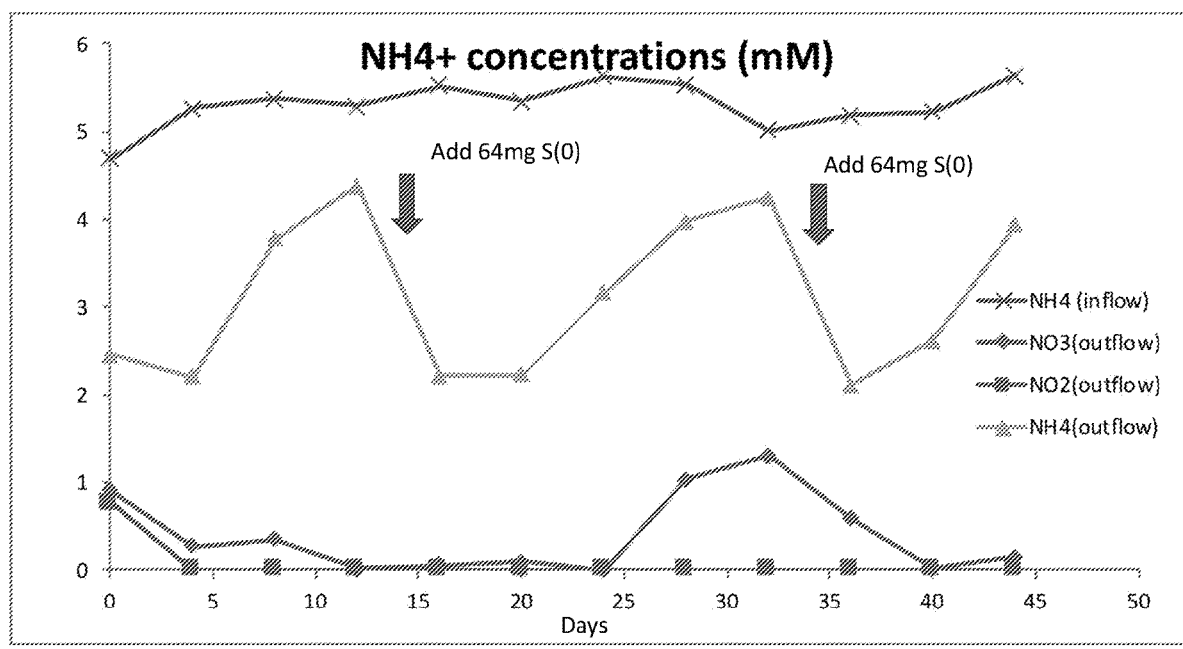
FIG. 37 illustrates the effects of elemental sulfur additions in a continuous flow membrane Feammox reactor according to some embodiments.

As illustrated in FIG. 37, after adding S(0), the ammonium removal rate between inflow and outflow increased by greater than 10 percent.

Various embodiments of the invention have been described in fulfillment of the various objects of the invention. It should be recognized that these embodiments are merely illustrative of the principles of the present invention. Numerous modifications and adaptations thereof will be readily apparent to those skilled in the art without departing from the spirit and scope of the invention.

SEQUENCE LISTING (49 sequences)

SEQ ID NO: 1 - DNA, 2165577 bp, Antimicrobiaceae bacterium A6
  misc_feature (216)..(577): Antimicrobiaceae bacterium genome sequence
gactcgtcgcgtcgacccggagacgttgtccacaggacagtgtccacagctgtggagcatcttgtggataggaggaggttagaggagtgagcgcacccgaggcatcgtgggaggcgatcgcccaggcgttccgaacggcgtcctgaccacaccgtcaccgctcgccaaggaacgtctcgagaccaagtaccgcgacgtgctcgaggacgtgtcggggaagccacgtggctgacgtggttccgaaccactaatctttgaccctgcgacttgccccagccccctggcgccccaggagctctccgaccagcagatcgattcccgttacccagggtcggagggcttcccatcgatcctgaccacaccgtcaccgctcgccaaggaacgtctcgagaccaagtaccgcgacgtgctcgaggacgtgctgacgcccatcatgggagcgcgagtgcctgtcgcggtacgggtccgcgccgatgtccccgacgagacaccgaccacggcgcattcgctgttcgactcctcacccacatcctcgcccacaccgtcgcggcgtaacggtcgcgggtcctcttcgaccttcgatccccgctataccttcgaagcgttcgtcatcgggtcctccaatcgcttcgcccacgccgcggccctgtccgtggccgagacgccggctcgctcctacaaccccctcttcatccacggcgacgctggtcttggcaagacccatctcctccacgcgatcggcaactacgcccgtgagaactatccgaacctgctgacgacctacgtttcgaccgagaccttcctgcctagccctccgagccctcgtcgggacttttcacccaacgagttcgtcgacgccatcaagcgaaaccagacgcccgccctcgaccgcggtaaagtcgattcgtgagagtgagttcaaggcccgctaccgtgcgtgcgacatcctcctcgtcgacgacatccagttcctcgagggcaaagaagcgatccaagaagagttcttccacacgttcaacacgctctacggggcacagaagcagatcgtgctcacctccgaccgtcccccacgtgcgctggcgacactcgaggatcggctccgaagccggttcgccatgggcttgatcaccgacgtgcaaccgcccgatctcgagacgcgagctgcgatcctccggcgaaaagccgaggatgcgggcgtcaccgtacccgcaacggtcatcgagttcatcgccgcctccatcaccgacaacatccgagagctggagggagcactcactcggctcgccgcattctccacgctcagccagaccggcatcacgctgacgatggccgaacaggtgttatcggatctcatctcgcagcacgccacccaacgtcaacgcacgcctgccgaggtcatcgctgcgacggcggccttgttcaacctcacccctgaagacatcaccggcgcatcgcgcaagcggccggtcgcggtagctcgccagatcgcgatgtacgtcgttcgcgaactcaccgaactcagctacccggagatcggccgcgccttcggcggcaaggaccacacgacggtcatgcacgccgtcagccgggtacaagagctgatgcaagagtctgtggagatctacgaacaggtcgatcagctcttcaagagtcttcgaggtccgcggccgtgagcctgtggatgtccctgaggacggacggtggacgaccgcccgctcatccacaggctcgaggagcccgacgagtccttcgaacgacgacggcctcgcggctccacagcactgtgcatgtcctggggacgagttcatggccgctgcgctgggaaaacgggtgtcgtccacagttcacaggccttactaccagtgctaccgtacacatagataggggaggacatcggtgaagtttctctgtgaacgcgacgaactcgcatcggcgctccaggcggcgtcacgagcgctctcgtcacgctcctcgctcgcgggtgtgcgctggacgcttcgaggcggcgaactcgaggtcgagggacgagagagcgacctcgcgattcgcagtgtgctgggtgcgatgggaaccgagggttcgttccagacgccggcgtcgctcgccgtcgatctcgttcgtaccatgccgagcgaccaagtcgaggtggtggtcgaggacgcatcggtcgtgctccgatcgggtcgggccgaagtgtcgctgcagctgctcccgacgctcgaactccccggaatcggagagggcacgacgccgagtgcgacggtgccggctgccgcgctggcccaggggattcgtcaggtggccgtcgcggcggctcgcgacgacggtcgcgacctcatctattccagcatgctcttctcctcgaccaatgacggcttgcggctggtcgcgacggacgggacgaggcttgcgcttcgtgacatcgcgaatctctctgtcgcgggttcggaagctcgcgacgtcgtgatcccgaccagggccgttcgcgagctcgagaggctcgtcaccggtgcgggtgtcgacgagatccacgtcggtatcggcgagcgcgatgccgtgttcgtggtcggcacgaccacgttggccacccggctcgtcgacgagccctttcgcgactatcggcggctcgtggaggccacctatccgaagaagctcctcctggatcgattgtcgctggtcgatgccatgcggcggcttcgccgtatggccaaggaggcgcggaacagttcgtcgatccagatgaacatgacgccgacggcctgcgagctcagcgtgcgcatcccgtccgtcggccaggtgcacgaggtcctcgacgcgaacttcaacgatgccgagttcaccatcaacttcgacccggacatgctcgccgatggcgtcgacggtgtcgagggcgacgtcatccggctcgagttcatcgaggccaaccgtgcggcgtgcgtgagttcggcggacacccgcgagtacctgtacatcttgatgccgatcgtggcccgctgagtatgtgggtgcgcagtctgcgcatcactggcctgcgcaatctcgacctcaccatcgatcacgtccccgacgacatcatcgcggtggtcgggagcaacggacacggcaagacgagtctgctcgagtcggtcagcgtggtcctggcagggcgatcgttccggacccatgatcggtcggcgctggtcagggtgggccatgacgaagcggtcgtcgtcgcggacgtggagcgcgagctcgctccgccggtgcgagtcggccgtcgggtcgatcgggagggacgactcgagacccgtgtcgacggacagcgggagcaacggggcccgtcgttgccggtggtgagctttcatccagacgacgtccagatcgcgagcggcggcccggagcagcgccgtcggtttctcgacgagtgcgtcgtcggactcgatcgaggggcagcgatccggctgcgtcaggcggagcgtgtcctgcggcagcggaccgaggctctgcgggcgccggtcttggacgaggtgacgctcagcatcctcgaagagcggctcgcgcgcgcgtcggtggaggtagccgagctccgggcccgtgctgccgaggtgatcgctccgcacgctcgggcggtgatcgacgagatgctgatgtcggcgggtcgcgtggtggtgacctatcgaggcgctggcgacgaggcgacgctcctcgaacaactgcgtgcgcgtcgcggagacgatcgacgtcgtggcgtcacgagcgtcgggttccaccgcgacgacgtcgagatcctcctcgacggcgagccgatccgtcgcatgggatcgcaggggcaggtgcgtaccgtggtcgtcgccctcaaggtggcgctggcacgcgcgatggaggcggtgacgaaggagccgccggtgctggtgctcgacgatctgctcgccgagcttgatgccgagcgggcgcggcgagcggtcgcgatgatggaggggatgcaggcgttcatcagtcacaccgcaccggtggaggggtcgggcttcgagcttcggatcagccatggagccctcgtcgacgcgtgatcgaggacgagtgccggggcccgtgcccatcgctgaggtgctcgcgaagctcgataccgctcagcgggccggcgtggacgtcgtgcgtcgtggcgaactcaagaccgtcgtgcgcgaggcgctgggaccagccctcgtacgtcgatgctcgttggtcaggctcgccgaggacgagatcgtcctcggcgccggtggtgccggtctcgtcgccctacgtggtgcggcagcacggctccgcgtggcgcttgcggaggcgggttaccagggtgagctgcgtctcgttgcgatcccgggagagccgcgaccctggtcgcagctaggctgaggtgggctcgagcgcccgtgggtgtgagtctgctcgcagtgtgtctgcatcgccacgagcgtggatgacgcatcgagcagcgtaggtggtcgatcgaggaaggatcaagagcttggagcccgaggcaagctacaccgcagccgacatcgtggtcctcgagggcttggagcacgtccggctgcgcccgggcatgtacatcggctccactggtccgagcggactgcaccacttggtgtgggaagtcgtcgacaacgcagtcgacgaggtcatggccggcgcctgcaccgagatcgacgtcaccatcctcgccgacggcggctgtcgggtcgaagacaatggtcgcggtattcccgtcgacccacatccatcagacccgtcgaagtcggcagccgaggtggtgctgacgcagctcaacgctggcggcaagttcggcacgggtggttataaggtttctggcggtctccatggcgttggcgtgtcggtcgtgaacgcgctgtcggcacgcctcgtcctcgaggttcaccgcgacggtagcacctatcgcatggagttcgtcaagggtgggacgccgacggggccgctcgagcggatcggctcctctggaggccggcgaggcacggtggtgaccttctggccggatccgacgatcttcgaggacactgagttctctgcccagaggatcctggagcgcctccaggtcatcgccttcctcaacaagggcgtggtcgtgcgcttccgcgacgagcgtcctggtcgagaacatgaacagacgttctcctacgcaggtggcatcgtggacttcgttcgccacctgaacgagcccaagggacccctctttgcgaaggtgggctactacgccgcgagcgaggaggacatggaggtcgaggtggcgttctcgtggaacaccaccttctacgagacgctgttcaccttcgcgaacggcatctccaccgaagaaggcggcatgcacgccgagggcttccgcaaggcgctcacgcaggtgatcaatcgctacgcgagggcacggaacctgctcaaggagcgcgatgagaatctcgaggggaacgacatccgcgaggggatgaccaccatcgtgtcggtccgtctcgtcaacccgcagttcgagggccagaccaagacgaagctcggcaacgtgtcggtgcgatcgttcgtcgagcgtgtgaccaacgagcacctggcgacctggctggaggagaaccctcgcgaagcgcaggcgatcgttcagaaggccatcgtggcacagcgtgctcgcttggccgcgagacaggctcgcgagctcacgaggcgtaagtcggggctcgagagcgcgggtctgcccggcaagctcacggactgcacctcgcgcgatccctccgagtcggagctgttcatcgtggaggggaactccgctggtggcacgaccatcaagggacgtgatccgaagacccaggcagtgcttcccatccgtggcaagatcctcaacgtcgaacgtgctcgactcgacaagatgctctcgaaccaggagatccagtcgttgattgcggccatcggcgctggagttggtgacgagttcgacatcaagaaggcccgctaccacaaggtgatcatcttggccgacgccgatcctgacggatcgcacatccgcacgctgctgctgacgttcttcttccgtcagatgcggccgctcgtcgaggcggggatggtctacgccgcacagccgccgctgtactccacgttgctcggcacggagaaggtctacatcaagaacgaagccgagcgcctgcgctttctcgaagcccaccccaaccacaagaagccattcctgcggttgaagggtcttggcgagatggacttcgacgagctgcgcgacaccacactccatcaggatcggcgaaccttgctgaaggtcaccatcgagcaggcggcgatcgccgacgaggtgtgcagtgtcttgatgggcgacgacgtcgagcagcgccgtcgtttcatccaggagaacgcgggcgacgcgcgtttcatcgacttctaggtaagcgacatcggcccacgaggagatctgcgtgcctgacgaacccacccccgacgcttcgaacgtcgagctcatcgagttgcaggaggagatggagcgctcctttctggagtactccctctcggtgatcattgcgcgagcgctccctgacgcgcgcgatggtctcaagccggtgcatcgtcgcatcctctactcgatgtacgacgctggctatcggcccgatcggccccacgtgaagtgcgcgaaggtcgtcggggacgtcatgagtcgcttccacccacacggcgacgctgcgatctacgacgcgctcgtgcgcatggcgcaggacttctcgctgctccatcccttgatcgatgggcacggcaacttcggttcgcccgatccgtcgacgggtcccgcggcgtctcgctataccgagtgccgcctcgccccgatcgcccttgagctgctcgcgggtatcgacgaagacacggtcgacttcgtcccgaactacgactcacagaccgtcgagccgtccgtactgccggcgcggttcccgaatctgctcgtcaatggatcacaaggcatcgccgtcggtatggcgacccagatcccatcgcacaacctcggtgaagtggtcgacgcgattgcgtacctcatcgaccaccccgaggccaccgtcgacgagctcatgcgcttcgttccgggccccgattttcccacgggtggcatcattctcgggcgagatggcatccgcgacgcctaccgaaccggccgggggagcgtcaagcttcgcgccgtggccacgatcgaggaggctcgatcgggctaccagatcgtcgtcaccgagattcccttccagacctcggtcgaggtgatcgccgacaagattcgccacctcgtcgaggagaagctgctcgaagggatccgggacatgaagaacttctcggcagggtccgagacgcgcttcgtgatcgagctcaagcgtgacgcgaatccgaacgtcgtgctcaacaacttgtatcgactgacgccgctccagacgagcttcccgatccagatgctggcgctggtcgatggcgcgccgcgcaccttgaacctgcttggcttgtgccagatctacgtcgatcaccaacgcgaggtcattcggcgtcgctccgagttccgtctcggcaaggctcgagagcgactccacatcgtcgagggtctcctctcgtgcatcgaccaactcgacgccgtgatcgcgaccatccgagcctctgaggatcgtgcggctgcccgtgccgcactcatggccgagccgttcgggttctctgagctccaggcgaaccacatcttggacatgacgctcgggcgcctgacccgtctcggacgtgaggagctcgaggaggaggcggcgacgctccgagcaaccatcgctgaactcgaagcgatccttgccgacgcccaacgactgtccgcggttgtcaaggacgagatgctcgcggcgactgccgagtaccgccaggcgcggcggacccgcttcgaggtggacccgggcgacttcgccgcggaggacctcatcgaggacgagcccatcgtggtgctcatcagccgttccggctacatcaaggccgtgcccgagtcctcgttcaaggcgcagggccgaggcggccgaggcgtggtgggggcgcgagtcaaggacgaagacgagatcgcccacgtcatctcgtcgtcgatgctctcgaggctgctggtcttctcgtcgcgtgggcgggtctaccaactccggggttacgagctgcccaagctcgagcgatcggcgcgggggacggcgctcgtcaatctcgtcccgttggccgacgacgagcgcatcacctccgtcatgggcacgaaggacttccccgaggacgctgacctcgtgttcttcacgcgcaacgggatggtcaagcgaaccgccatggccgagtacgcgcgctcgcgtcgtgatgggatcatcgctatcgacgtgcgaggcgacgacgagctcgtgagcgtcgtcgtcgcgaccgaagagcacgatggcgtcgtgttcaccaagcgcggccaggtcctgcgcttcccactcgctgaggtgcgtcgtaccgggcgcgcgacggcgggcgttcgctccattcgccgagcggacggcgactggatcgtcgcgggcgggctcatcgaagacggtgtcgaggtcctgctcgtcacgagccgcggttacggcaagcgaacccccctcgattcgttcccggtgcaccatcgaggcggcgccggtatcagaggcatcggcttgaccgagcgcaagggagagctggtcgccgcggccttcgtgaggccggaggacgaggtcctcatcgtgagctcgcagggccagatgatccgcgtgcgcatcggcgacatctccaaccagggtcgctacgcaaccggggtcaagctcatctcgctacaagccgaggagtccgtggcgtccgttggcgtcgtgccagagagcggtacggacgcataaagattcgaatcggtccgtgccgatgccatcggtgcaagggagtgcgcgatggcacggtggaccgctcggtggcttctacaagtcgcctcgactgtcgcgatggcgggcgtgctcgccgtggtgcccggtgcccgcggctcgggcacaaagaccctgaccggatcacaggtcagttggagcatcgcctgggtgccggcttcggtcccgtcggtcgcgctcccgagcgtgagcttcgccagcttcgaggaccccacgaacccgaccgagggtccccagccgacgttccctcatcccaacatcgctacccccgaaggcgccgccctgtccgtgggccaacccatcatcgtcgcgccacagacgagcgagctcgggacgaccctgtcgggatctgcgaccgtcgccggtgggatcgtcgtcaccgtcacggtgaatggggtggccgagcccccggtcaccgtgtcgaacgtggcgagctacgcgatgagctggcaggccagtgtcgaggacgtctacgtgtcggccggcacggtgccggcgtcggccccgatcctcgctggcacgaacgtgctcgcgcccaccgccaacgacgtcacgccgacaggctcgctcgcaccgggcacgtttgggtccctgtgcgacgctggcgcggtgagcgcatccagtgatctcttctcccgcctcacgccggccctcgcccagtcggcggcgggcaagctcagtccgctggtgtcgacgccgaccagcgaggatccgggcacgtgcgccatcgagttcgctgcaccgtctggactctcgggtggttctacctggaccgtaaacgctcagctcgccgcggccttcaccgcgacggcgacggcacgactccagaccgtgcatctgtccgtcgatggtgtagccgtgacaattcctggcggtacctacagcgacgtgacgctcgacgttccaccttgggtgctcggcccggcgacctccatcgacgagcaggtggccaccgtcgagtcgcttccggtgggcgctgcggtgttcggaggctagggtcgtggccaccatcgcacccggggtcggacgaaccgagagccttgcgcctcgatcgctcgccgagctgatcgagcgcggcccgttcgagcgctacctgcgcgagacgctcacctggtcgctcgtgtcacgcttcctcgtcgatgcgcagcgccacgctgacgacgagcgtcaggccgcagagttcgaccattggcacgagcgttatcgggctctcttctctcgggccgccgacgaggttctccagacggtgagccaggagatgctcgaccacctgagtgtgctcgagaagcgggcggccttcaacgccaactacgtcgccatcggcgagcgcatccggacgctgctgcaagcgcgtccggatgccgacgagatccagcggctgccgaacgtcggaccgctgctcaccatccgtctctacggggagatgttcgatctcgggatcgtgttgctgtactacttcgcgtccgaggtggagaacatccacatcgtcgacgagcgcgtcaccgtctacacgagtgatggtcgagcgtggctctcgatgatcgatgcggccgccgacgggcgcgccctcaaggaccgtggtgcgcagttcgcacagatctccgggggaggcgtacctcaacggttcgaccccgtgcaccacgccccgaacctgacgagcccctacgggatccgcatggcgctccgccagcgcaccactcgatcgggggagtttctcgctgcgttgcgcctgcaccatgcgaccaatatcaccttcgatgccctcatcgaacagggggtcctcagcgaagaagcgggcctcatgctcgcgcaggcggtacgagctgcggtgccgatcctgatcgcgggggcccctggatccgggaagaccacgctcctgcgcgcgctcacgaagttcatcccgcgcgccgaaccggtgctggtggccgagaactacgaggaactgcatctcgaggagctggtcgacgaccgcggcaggccctggttctacgtgctccacagccacgtcgagcaggaggccaacgccgagggtgcgggctcggtcacgatgaagaccatcctcgaacgcggtctccaggaggatgtccgtcggctcgtgatcggtgaggtcaccgacccggagacgatggaggtgctgttgcaggccgccaacacgggcacgagcggcgtgctggccacgatccacgccgagagcgcgctcgacacggtgaaccgcgtcttcgggctgttgctgcgcacgacccgttacacggaccgggccgctgcctatctcatcgagagcacgttgaacctggtcgtgcactgcgccttggtgcgcaacgagcagagccgtcggcgggtcgtcacggggatcgggtgggtcgttccccatccgggccaggtcggtggcatgccacggatgcagatggcgttcgtgcgcgaggggtcggctctcgtgcgtgccgtggaccatgccaacgtcgcgcaccggctggaggagctcgtcgcgcggaggcgctcgtgagcgctcaagttctgacgccgagagtgacgatgcttactacgacgggtggtcaagcatcgtccgtcgagagacggcgcgagcgaaaggagcgtcgaaatgggaaggcgcatggtacgtggcgcagcgtggtggctggcctcggtggttcggtcggtgatggcagtggtcaccggtgggcctgctgcactggtgtcgctggcgagcgacgagtccggggcggagacctcggtggcgacgatcgcctgggtcgtgctcgggctcatcgtggtggcgttcgtcgtgttcttggtgttccagttcacgggcagcgcaaccagcgcggcatccaataccaacaatcagctcagcacccttccacagggatagcgggcatgttcgctcgtcgcctgctcgtcgacgagcaggcgacgagcacggtcgtggggccggtggtcgtggtggtgtttctcatgctcatcgcgctgaccatcggcttcggcgcgttgtgggtcgggcacgtcgaggccgtgtggggtgctgaggcgatcgccgccgacctcgggatcggtggctcgcccgcccaaggtttcgccttcggggtcctgcgcgacgtgacctggtcgatccagccggtcagcgtgagtggtccggacgcgccgggagctgcgtccatggtggtcgtgcacgccgatctcggcggtctcgtgccggtgacgagccaggtcgcgctccagccgcccagccagctcggaacgggagcgtgatgcgacggctcctcaccgacgatcgagccgagagcgatgcggtggttgcactgccagcggtggcggccgtgatggtcgtgctcgcggtctcggtgggcgtcgtggtgtggtgggcggccgcgcaatcggcccaggcgatcgccaatgccgccggattcgaagccctgagtctcccggtcctcgggactccggccgccgagtcggcgctcggtgccatggtcgcggccgagaccgcagcgcgctccttcccgccgctcagctgcgccctgagtgggctcgacgtcgccgccgcccagattccagcgtcggtgaccgtcacggtgacctgttcgacgaccgttcccgtgctcgggttcgtgcacttcgagcggtcggtgacgctgggcctgaacccctcacacctcatcgccgggagtacgccgtgagggcgccgagcgagcagggagacgcgacgcccgcgctgctcgcggtcggatcgatcctgctcgtcatgggactcacggtggcggccctcgtgctcgagagcatcacgatggccgagaccatggcgcgggcggcggcgcgggcggcggcgcacgccgctgccaacgtgctctggcagacggctgggaacgcggggtcgccagggctcgtgacgatgcggaatccgtcgttctacgatcccaacctccagagcgcggcctcggcagcgctcgcgggggtcccacacggggtcggtacgagcgtcgtgtcgtgctcgggcgggctcgtccccaacggacacggcctccagcgctattacctcgacgtacgggcgacctgcaccgtggtgttcgtcccgcccatgagcgatctcatcaccgtggtggccatcagcccgatcacggtcacggcctccgcccacctcgtggggagcctcgcgtgagcgcgcgtcgtgtggccatcggtctcgctgggtcgatcgcggaggtcctcgtcctgacaccgtggtcgctcccgaatgagcgcgtcgtggcccaccccgtcgtcgtcggggccgcggcggtgtgcgccatcgctgcgcttgcgctgtggtggcggtgggtgctggggcgaggtggtggcgaccattcatcgatccccgacggagtccgcgccccggcgcgagcgtcggtcgcggtcgatctcgatctcgacgcagtcccagccatcgaggtgcccggcgtcgggatcgtcgcgatggaacgctcgacgtcgcagtgggtcctcgaggtcgccgccgagcaggagctccaccgcgtggcggagcacgcccggctgcatcggccgcgagggatggtgccgctcgcagtgccagatcgcaacccggccgccgaggacctccgcgccctcgtccgccttgaccatcgcgtccgctcctcgccagcgcacgagggctcgctcacgccgctgcgctctggcgaggtcgtagggggtcagcgccacacacacgccgacgcagggtcggcatgcattcgcgtcgtcgaccggctgggccagcttcgcgtgctcagcggactcgtcggcatcgagcccggcaccggtctcgacctcatcgtccagcatcggctcttgccgtggctggagccggttcgctgtgtcgtggtcgggatgcgacgtgaggaggtcgtggccttggcacgatcgtcggtgctggtcgtgtccgacatccggcgggcacaggcggtgctcgacgaggcagtgagtgcgacgaatggattcccggtgctggtggtcgtgcatggtgtcaggcttgcaatggatgacgtgcgtgcgctcggtgcggccggacgcgtcgtggtcgtcgagacgagtggacctcccgacgtgtccttcgcctccatcgatcgtgggcgctggcacggcgcagtggagcggttgagtacgttcgcgccgaccccccttctgccaggtcaactgccaccgcccccacgacccgggagaccctgggtgcgcctgtgcggcctcgagccacggctcgagggcgtcgccgcgagccgagacgccgcacagttggtcgctgcgctcgtgctcgacggcggccgcgccacgatcgacgcgttggccgacgcgctcgagcgtccggcgcggaccgttcgatccctcgcacgcgaggtgcccacctgtgtggacgacgagcgtgacgggctccggttgcgcccaggtgtgggatccgatctcggcctcgtccaccgggtcgacgaggcgatccgcatcgtcgacctcgtggcgaggccgccacttgccgcctacgagcagccgtggtttcgcgctcgagcgccggtcctggaggcggtcctcgtcgactccctgctcgccaccgcggaggcactcgagcgcgcggacgctcgtggtgaggcgaaggtgatcgtgcggctcgtccgccggacattcggaccgctcgagcggctcgaaggcggcggtctgcgccccgacgggaccacgggtgcagacgagggcgtcgcccggagcgaggaggtcggcacccacgtgccacgagcggcgttggtgaggccaggagccgtggggtcgtggtgagtagcttcgatgagcggcagccatcggccctcgggtgggagggtgtcgatcaggcgccgtcgacgggcctgtcggagaccgaccaacatgtgttctgggtcgaggtcggcgatcggatcggcgaaggcctcggcctgatcactgctcgcagcgaggttgccgaggtggagctcatcgtcgggccgggtgacgagcatcgcacggtggccgagccggtgggcggcgccccgtcgaactggggcgacttcggggatctcggaggggtcgctcgggacgaccgcgacgacgagccgcggaggctggtcgtcgcggcgacggaacccacggccgagaccggaacggtcgcggcggtcgacgtcgtgacggcgccgctgatgacgcgtccgcgacgctcgcgatggcgcacctggtcgatggtgctggcgtcggttgcgctgatcgtcgcggcgcgcctcctgctcttcgtcgccaccaccggcggacggcacccatgatcgcagcggtgtggctccttgctggcgtcggcgtgatgggtgcgcacctcgtcgggcccggacgcgaggacgctcggagccatcgcctgcgccgacgtggttcgctgtggatcgttactctcgtgtcggcgctgtacgccgtcgccggcctggcccttgggttcgagccgcttgggtggctcccgctcgcactcgggctgtggctgatcctcgtcgtcgcgttcgtggtgctcttccagcgtcgtcacgtgggaggtgccgacgtgcgctacgtcggcggggcgctctggctggtcgccgtcggactcggtccggtcggtctcgtgtggttgccgctcaccttgctcggcgcaagcctcgcgcagctcgcgtggtcggcgatctcgggtcagcgagggccgtgggcgatggtggcgtggctgagtgcagcaggactcgtccttgcggtcgttgctctgattgctgaggtggcactgcgataggcgctcaatgggagccgtcgtcgtgccgacagtagtcgagagcgaaggaggcggacgtggctcgagatgacgccgcacggcgactggtgatcaccggcgtcggcatcgcgttcctcggcttggcgatcgccgggacgagtgtctactacctcgagacgcgtgtctttcgcgaggtccagatcgtggaggccgccgccgagctgctccctgggcaaccgatcgctcgatcggagctcaccgtcgtgacgaccccggcgcagatcgcctccgggagcggggtcgtgctggccggtgcgctcgacgccctcagctcggggagctataccgtgtcggtgccggtcgcccccggcgcgccactcgaggttcgcgagctcgccaagcgtcctcctcgaggggaacgcgtcctctacttcacgccgcaggtcgcgccccccaacctggaggcgggctcggtgatcgatatcctcgtgcctcagccgagcaccgtccagacgcagtcgtcggcgcacgtcccctacgacgttccggtcgcgaccggcgtgacggtgctgtcggtgacgcatccctcgtctggatcatccggttcgctcggcatcgaggtcgcactacctcccgccgaagtcgcggccgctgcggccgccgcgaccagctcgcagtgcgtcgtggtgttctcgttccctggtgcccgacccgttccggtgggctagccatgctggtggtgttcgggctcgatgcgaacgtcggtcgcaagcgagtcgccgctgccctgacacgtgctgttccggggacccgcctgctggtcgaactcggcgtgtcgggtacgacgtggtccatggcgggagccgagttccagaagcgcaccccgaccctcgaaacgatctacgaggtcctgcgcgagcgcaacgacggcatgcggcgggtgcgcgtgcacctcgacaccgtggtaggtgcgctgagcgacctcgagagcgcacggcccatcagcgccgccgatgcgtcgcgtcgcgatgtcgtgcccgtggtgcgcgcgcccgtcagttcgaccgaggccgccgagcgcgcgctcgagttcggctcggcgctcgtcgagctgttcgtccagctggaacgctccagcgttctcgggcccaccaccgtgctcgccgacgcgggctgggtggcgccgggtctcgtcgggcaggcggcgtgggccgctgcggcgagcgatctggtgctcgtggtcggggagcggccggtggcgatcgcctcgctcggctacttcgagcgggcgttcccgcaggctcgggtctgggtcgtcgcgctggcggcgggtcgtcgtcgccgtcgtctcgctgaagtggctcgcttcgcactgcgcgcgcgtcacggcgtcgaggtcatcgccgtagaacccgatcagctcggatcggggaccgccctcgagcaggtcctcgagcccatcgtcatgggatcggctggttcgaccctcggggagctcggagcgtgacccgggccctcgtcatgatcgccgggagcttcctcggtatcggtgtcgtgggggcgttgatcgcgatcgccgtggctctccgccccccgagtgggggtcgagtcgaggaggtcgaacgcgtcggactcgtgtcgcgtcggccatcggcgctccggtctgcgcttgcgacgatgcacccattcgccatcgaccatcgactcgccatcggcgtcgcgcttgcgctgctcgccgggctggctggggcgtggttgctggtcgtcccgtcgatcctcatcggctacgtgctcggcgacctgttcctacggccggcgctcgccgagtcggtcgacgagctctcgtcgatgctccagttcatcatcgactttcgctcagggctcctctccggaggtgtgtcggttccggcggcactcgagctcgcgatcgatgcacaaccagcgggtcgcttcacgcgagatcgtcgcgtgccgtaccaacagatggccgatccctccgctcgcgagggggaggctcgtgttgcgttgagccatctcatcgagcgcacgaccaatccgttgatccacatcaccgacgtgttggtgtacctggcgctgcgtgcgacgaacctgcgggtggcgaaccagctcgatctcctcggcgacgtgctgctacagcaggtccaggcctatcgagggctcgtggtcaccgagctgctctcgtcgctcggcgaggtgcggctcatcaccatcatcaccatcggggcggtgtatgcgacgctcctcgcactcggcggctcgctcggcagcgacatcggactgtcactgctcgcgcaggtcgtcgcccttgcagggagcggggcgcagctcttgtgggccctctcgttgcgtcgtgatctcgagttcaaacttcggtacctgtgaggtcgtgacccatggatgcacggtggctgatcatcggggtcggtatcgcgattggtttggtcatcgccggagccggcgtcgcgctcgccggaggcagcaccctacttgcgctcagacgctatgcggcagcgctgccctcgatcgcgtcgcgctcgcgtgtgccgctcgcgcggcgagtcgttgccgccctggcgcgacggcaagccgacttcgatgccacgctctggatcgcgcactggtccaccgaggatgccgtcgcgcgcctccagcagctgtggctggtgctcgctgttctggctggtggcctcgtgctcctcgcgaaggccgtcgtgccgaacctgtcaccgttcgtcctggcgatcgtcgcggcggcggcgctcgcccttgccgcggtcgttgctcgcgtggtgctggtgtggcaggttcgcgccgaggcccgcatcgcgcgccagcgcatcgacaactccctggccaacctggcgctcttgatccgggtgtacgtccagggcggtgcatcggcgaccgaggcgctgaccgccatcagcgagcttcgaggcgtcatgagcgacgccggtgcgcgcgatgtcgacgcgtggatccagggatcccagcgcaacgaccagaacatcggggccgtgctcgagcgcttcgggaacacctatggtgtgccccgcatcgcgcaactcggctcgtacctcgagcagtcgatcctgtcgggtcggccggtctccgacaccctggacgtggccattcgagacgcttaccaggccctgttcgagtccaccgtcgcggcggtgaaccaacgggtacgcatcgcgtccctggtgttcatccctggcgtcatcgcgatcggcgtggtgttcatggcgtcgatgatcgcatcgatgcacggcatcgggcaggtgacgaagctgttcggcggcggaggcctctagcgagatcagttggtggccgtcagcggcggctcacccgggtagctccagagcggctgccagggagagatcgtcggatcggccatcgcggaggccgggctctgggcctggttggcccacttggcctgataaggaagaccctcgaactccacgacctgaccgggttggtacgtgacggtgggctcccaagtcggatcggcccctggaggcagcgtcgggagtgtcggtgcgtgatcgctctccagcaccggtccgaggagttcccatggcgtctggtaggcatactcgaactgctgcgtgggctgttggccctggttgtaccacttggcctcgtagatgtagccaccccacaccaccttgtagccggcgggataggggaaggacgcgctccagatcgggaagggcgcgttggctgggttggcgctcaccgtggtcgtgacctggatcagcccgcgaccgcgttgcacggacgcagggatctgatgctcgatctcgctcgagaacgcgagcggggctgtctgtgcgtcggagcaggtgttcgagtagacggcttcgttcgccagcgatgcggcgcacggcgcatcacggttcagcgaccagaacgagacccgcccgatcgcctgtgacgtcgaccacgccacgagctgcgacgcgccctggaggctcacccgttgaccgacgacgttgttctgaccgatctggaacgtcacacccatgtggttccagatctggtgggagttgagggggatacggtactcggcgaacagggtcgtgagctgctggtgtgccgccgtgagtgcgctctcggcggtttggacgaggcccccgggcgtcgaggtgaagtccattgtcatcacgttgacgccagcgagaggaacccgcttgaggagcatcgcgcggatcgccgcgatgcctgggtccgacagtccctggggtgtcgctggtagcgtgagccagatctggatcccggggtcttcgtgagccacgatcgacagcgcggctgcccgtcggagcgtcgccgcttgactcgtgagcgcggggccctcgatatcgaagtcgacgatgtgttggtcgtactggcggatgatctgctggtacgcggcggccagcgacgtcggcgtcgtgcacgccatcgacaagtgggtgtgggcttggccgccgaaggacacgatcgcggtcccgccgatgctggcgtactcggcgagccgggagttcagggcgaggtcctggttggcggcgctcggggtatagacgccaccccaggtgggtgagcagccgttcgtgccgctcgcgacgacgaacccgagcaccgtctgcttcgcgtcgttctgggtcggatcctggaacgcataggtcggcgacagcgtggcgtcgacgtacggggcgaagtaggtcgcgtggaccggcgctgcgtcgatgatccgctggtggatgcgccacgccgccagcgagccagctccaccgagcaccatgaggcccatgaggatccgcacagggctgtagcggcgcaggcgctccccgagcggcggcttccgatccggaccgtctccctccagctcgtgcggcatcacgagatcactgacagtgatcaaaggctgcaatgagtggtcaccaagcggagagagctcgtcgtgtgacatcgctactcctgtcgaaacgggtcgttgtcggtacggacgagtgtagcgtggagcggtcgtgtcgggccctcgatcaccctccgtggggttcaattctcagttgagcccacaatgtgggttcgagtacggtctttgccctccgcaacaagctacactctgcgtgagggtggttctaccgtggtgggcggtctgcggtcggtctcctacgagcacgggagggagaacaggttgagtcgccaaccagccggtacgcatggacagcgagcgcaggttcggctcgtcggtcaggccgctcaggtccccgagtcccgcatcgtgacggcgcgcctcgcaattatgaccactattggtggttgggtcggttacctgatctactggttctactcacagttcctgcgccaaggggcctacacgacgcaggcgaaggccgaggcgatcgcctacctcgccatgatcaccctgctcgaggcgtcgtcgttggcgtacctcgtggcgaggctcggccatatttaccgagctcgcgagcatcgtcgggtaccgcgggctcacctcgacggctacttctggcagcgtcgaccgagcctcaccatgatcatcccctcgtaccgcgaggagactcgcgtcattcgcaatacgttgctgtcagcggcgctacaggagtatcccgacaagcgcatcgtgctcctgatcgatgatcctcccaacccgacggaggaacgccatcgcgtcctcctcgaagcggcacggtctctgccgagtcagctcgagtcgctcctcgcgtaccctgccaccgcggctcgtcgagcttacgacgagttccgcgagcgtgtcggttccagagtgagccagctgcccgcgatcgttcacgagggtggatcggactccggtgccgcgtgggacggcgtggtggtcgacccgagcgagctcgaacagctcgccgatacctatgccctggcggcgagctggctcacccttcagagcgaagaactcccgatcatcgaccacaccgacgagttccttcgagacgaagtgttcgtccggctggcccacgaatttgcacagatcgccgacacgctgcgagagggcgcgagctacggccgtgaggtcgacgcggctcgcctcgcgcagctgtacgaacggctcctcaacgtctttggcgcgcgcatcacgagcttcgagcgcaagctctacgcgtcactctcgagcgagccgaacaaggccatgaacctgaactcgtacatcggcttgatgggcggtgcctatagcgtccatcgcacgctctcgggtcaggtcctcgtgtccgacgaccccgagcacgcggacctcgtcatccccgacccggactacgtgctcaccttggatgcggactcgaccctgctccccgagtactgcctccggctcgtctacttgatggagcaggaggcgtacgcgcatgtcgcggtcgcgcagacgccctactcggcctatccgggccccgcgtcgcgtctcgagcggatcgcgggtgcgaccaccgacgtccagcatgtggtccaccaagggctcgccaactaccgggcgggtttctgggtcggcgcgaacgccgtcattcgcaagcgcgcgctcaactccttggaggagatcacctgggaaggcggctacccgatcaagcgctacatccgcgaccgtaccgcgatcgaggacacggagtcgtcggtcgacatcgtcgcccagggctgggaaatctacaactaccccgagcggctgagctactcggccacccccccgacttcggtgccttgtgcatccagcgtcgccgttgggctgatggcggcctgctcgtcgtgccgaagctgtggcgttaccacaagcgggccaaggagaccgggcgtcagtcgttcgccgagttcttcctccgcatgaactacctcgcgtcgatcacgtggacgaccgtcgccctggtcgtcctcctggtgttccccttcgcgaacgagctcgtgagtccctggatcgccgtgctcgccctcccgtacttcttcgcgatgtcgacggacctgaagtacgccggctatcaccgtcgcgacatcttctcgatctatggtttcaacctgatcctcgtcatggtgaacctggctggcaccgtcagctcgatcggccaggccgtcaccggggctcgagcttcgttcgcccgaaccccgaaggtgcgcaagcgcacagtcaccccgctcatgttcgtggtggctccgtacgcgctcgtggtgttgtcgatctacaccctcttgcatgactgggagcaccacgcactcaactcgatgctcttcgcggcgatcaacctggtcctcgcggccgttgccatcgtcgccttcatcggcgtgcgcaacagcatccaggacgtgtggatccagatcctcccatggttccagcggcgcacgaagaaccgtcccgtccgcacgacacgccatcaagaggtgcccgtcggagtcgggggcacccaactgggaacctgggagcacgtcctcgatctcggtgcgtcctcgatcgggttgggcgaggccgtcgataccgacgggcctggtcggttgcgcgtcggttcgcgagcagagcgcgaacgggcgcggcgccggctagccgactacgggctgagcgcgctcgcccagccgatccgtgacattgaggccgacgagatcgtcggctacgagatctatcaacgggtcaacggtgaggcaccgccagcccagctcgccaggctcgacacggtcgaagcggccagccttgagcagcggctcctggagcgcgccgcactgctggcacgtgacatccctgagggcgcgtggctgagcgtgaatgtgtcgtcgcgattcttgaccctgatggaagggcggcgacgcttttccctgacggcgcgcgaggggctgttcctcgacgtgtcgttcaccggcgtgctcgacggccctcacgtcgcggccacagaggacacgctctcgcgtgcgacgaaccggttcgcgatcgccctggacgatttcgtccccgatgcaggatccctggcggtggttcgtcgggtgcggccgagcatggtgaagctcgatcccgactgggtgcatgatctccccaagagtgccgcgaagcgtggccagaccgaactcctgctgcgtctcgctgcgccgcgtacgctcgtggtcgccgagggcgtcgaggacgagcgagagcttgcggcgctgcgcgcgctcggggtgcggtttgcccaggggtacctcctcggtcgaccggtcccgctcgaggagaccaagagcatcgctcctcgcgattaggcctcctcgcccgagtgggaccgccaccactcgaggaggcggcgcctcgcctcgtcgggatcgttcagcccctcgtcgatcgtgaggtcggtgaggaagcgcatcgcgcggcccacggcaggacctggtgggatctcgaggatgcgcatgacctccagtccgtcgatcggaggccgacgcgctcggagcgcgtcgcgctcggcgagctcccgtgcgcgctcttcgaacgtcgccatgcgctcggcgaacatgcgtcgtcggcgctcgttgcgggtggtcgcgtcgcaggtggtgagctcgttcaggtcctcgaggagctcgcctgcgtcgcgcacgtagcgacggacggcggcgtcgctccaaccctgagcataggtgtggaagcgcaggtgaagctcgacgaggcgagcgacgtcgtcgacgaggtcgttggggtagcgcagctctcgcaggatgcgacgggccatacgagccccgacaacgtcgtggaagtggaaactcacgccgttcggcccgatctcgcgagtcgcaggcttgccgatgtcgtggaggagggcggcgagcctcaggcggagccgcggtgagcagcttgcggtgaccgcgatggtgtgggcgagtacgtccttgtggtgatggatggggtcctgctcgagcctgagcgccggaagctccgggaggaactcggcggcgaggggcgtgtcgacgaggaaccagagacccttgctcggatcgggcacgacgagcagtcgagagagctcgtcgcggatgcgctcacgcgagacgacctcgaggcgcggggcgagttcgtggaccgcgtcgacgagcgcgcgctgcggctcgagatccaagcgcgcgatgaagcgtgcacagcgcaacatgcgcagcggatcgtcgctgaaggagcgtcgggggtccatgggagtgcgcaatcggcgcgcgagaaggtcctccatcccgccgaacgggtcgatcagggtcgggtcatcgctcgtgacctcgaccgccatggcgttcaccgtgaagtcgcgtcggaggagatcctcggcgagcgccgagacgaagtgcacggtcggcttgcgggtggaggagtcgtaggcctcgcctcggtgggtcgtgacttcgagcggcacgccgtgatagtggaaggcgaccgtcccgaagcggaggccggtcaggttgaagtgcgtcgcgacgggtctgacgatctccacgatctcctcgggcgtcgcgtccgtcgtggcatccacgtcaccgttcggctcgatgccgagcagtgcgtcgcggaccacgccgccgacgaggtagaggtggcgttgtcgttcgtcgaagcgtgcggcaagcggtcggagcgcctcgatgagtgggcggagtagggcggggagcacgtgccgagaggctacccgcgctcgttcgcgagacctcgctcgagtgcggcacgatgcagccgttggagggtcgtcacgagctcgtggtcgacatcgcggctcggggcctcaccgacgtcgaccgccgcatgcaggagcgtcgcgaacgtgaccagcgtcgagtgctcgagcgcttcgaggtcgtagccaccctcgagcgcgaggatcaggcggcctgggggaacggcgtcgcgcgcgatggcgatcaatggtgcatagtcgggggcgcgaaagtcgagttcggtgagcggatcgtcgcgatgggcgtcgtagccagcggacacgatcgcccacgtcgggccgaacgtggtgatggcggggagcgcgatggtttcgaggagtgcccgtgccgtctggcccgacgtctgcggggggagcggcaggttgatcgtggtgccgaccccagggccatccccgacgtcgccgatgcgcccagtccctgggaacaaggggtactggtgtgtggagacgtagagcacacgaggttcgcgctcgaagatcgcggcggtgccgttgccatggtgcgcatcgatatcgagaatgaggacgcgctcgccctggtcgatcagcgcctgggcggcgatggcgacgttgttgaggaggcagaaccccatggcctggtcgaccgtggcatggtggccgggcggtcgtacggcgaggaaggcggcgtcggcctcgccctgtcgaagccgctcgatcgcgtcgagcccagcgcccgcggcgagctgggcggcctcgaacgacgcgtcgttcaccgaggtgtcggggtcgatcggaccgccacccatgaggcagtaacgctccagtgcctcgacgtgcgctggggtgtggaccgcttcgatggcggctcggggtgcaggtgtcggcgtgacgatcgtgacggcgtcctcgaagtggctgagcgcatggcggacgacctcgagtcgctcggcacgctctgggtgccacgctccagcgtcgtgctccaagaaccgttcgtgcgtggcgtagaggatccggcccacagcgtcatcctacgccacgggggcttctcgacccgagtcggaggtcagctaccataggcctcatcggaaccccgttcgctcacccatacccagagccggccaccgtgcaggtcgcgggccgcagtgtccggctgtctccgtggtatggcttcgacggcgccgtgctgctcggcctcgcaccggcgctgtggctgcgtgatccggcgtggctcgacatcgctcgtcgtgcagcagccgcccgcggttggcgccgatttctcgtacaggcgacgactcctgcgcagcgtcttgcgctcgacgcagcagggtgggtcctcgtcgacgaactctacgtcttgtttcgacgagggtcactcgagctcccgccggtaccccacacggcccggggcgtcgagatgcggcgcgggagggcggccgacaccgcagagctgctcgaggtcgaccatcggtgcttcgagccgttctggatgatgaacgaggcggcgcttcgcgaggcgctccaggcaacgcctcgcactcgcttccgggtacttgcgagcgccgacgacgatcgagttgttgggtacgctatcttcggccttggcgccggtgagggctacctccaacgcatcgcggtcgaccctcgctaccagggccgggggctcgcgacgcgattgatcgtcgatggcctgcggtgggcgaagagatggagagcgcgccgagtcggtgtcaacacacaacgatcgaacgagaccgcccttcgcctctaccagcggcttggcttcgagatggagccgaacggcatcacgatctatgcctggccggatcactagtcgtctcgtcctcctcctcgccctcgtcgtgctgggtgtgtggttgcccaggggcgcagcgctcgtcagtaccgcgcgggaggccgtgaccgtggtctcggcgcccggcgtcgtcgtcggctcgcagccgatcgcggcgacctttcgcctcgcgcatcgtctccacgacgcggaggctttcttcgtcgtctatcccgccacgacgtcggtgagcggccttggtgcggtgctctcgggcgcacagctcgggtacccgatcgggatcacccacgccgtcgccgtgtccccgcacgcctcccagatgcacctggtggtgccagacccgatccctgccagcggctgtggcacgagctgcagcggcgtctacccggtgcagcttcgggtcgcgagcgcggtgagcgggcagaccctggcgtccgtgacgttcgcggtgccgtacttctcgacgctgagcggcgtcgttccgctgcacctcgccgtcggggtcatcgccgagacccctgccgtgacagcgtcggcgatcgaggaactcctcgcccgagacccgagcgtccaggtcggagtgagcgccgaaggcccggttggcctcggagcgctgcgctcgctcgcgcacgccgtgcctcttcgtgcatctctgctcgcgcccaccgttggcgtcgcacgcgcgtgtgtgggggcgctcgggcccttgtcgtcgttcgcatcgtcggttcagctggcgcgtaccgtcgttggcacggccagcgcgccgctcgcgttcgccaccgtgccgacgtcggacgaactcgaaagcctccgagcgctcggtatccacgaggtcatcctcccggcgtcggcccttgcgtcggcgtcgccggtcctgacgctcagcaacgcggtgcgcctcggcgcaggtgtggtggcactcggcacctctgcgatggtcagcgacgggctgagctcggtgacgcagcctctcggggcgcagctgctcatggccgaactcgcacaggtctacttcgaagctccctcgagacctgggcgggtactcgcgggtctcgtcgccgtcgcgagcgatgcgcgtatggcggcgttcgctcgcgggttggcaagcctgggcagcctccccttcctccagctctccaccatcgatggcgcgatggccaccgcgagctcgaccgtcgttcggccgaacgtcgccgccgagagggcgtgcccgcgcccactcgaggccctgcgcgtcgccgcgcgtcgtgccgcggccctcgccgaggctgcgcccggggtccgcccggagctcacggcgttggtgctcggtgccctggctcatcccgaggcaagccagctggcgcgtcacgccatcgatcgcaccctggatgcgatcacggtcgcctccgatcagctgacgctcacgagcgctcgcgagacggtgcccatcgacatcacgtcgcatctatcggtccctgccagcatccgagtcgtgctcgtcgacaccaagctccggttcccggagggctcgacacgcacggtcaccgtggcgtcgaagaccgtgacggtgcccatccctgtcgtggcacgcacgctcgggacctcgccgctcctggttcgcctcgagtctccctccgggcagctcatcgggcagaacgtcctcgtggtggactcgaccggtttctcggtggtgggcgtcgtgctgaccggttcgtccgcagccctgctcgccgtgtggtgggttcgcaatcggggtcggcgccagcggggccgacacgcgaagcggagctgatggtgcaggcgcgtctcgtgcggctgctggccggtcgcggtcgttcggtgggcgagaacgccaccgccatggcgatcgggacggcggcaagtcgtctcagcgggttcgtgcgcctgatcgtcctcgcggtggtgctcggggtgcgtccgttggccgacgccttcaacctggcgaacaacacgccgaacatgctctacgacctgttgctcggtggagtgatcagctcgacgatccttcccgtcgtggcggctcggatcgcgagggcgggggagcgagccggcgagcgctcgctcgctgcgatcatgacgatcggggtggtgggcctcctcgtggccacggtgctcttcgaggtcctcgccccggccgtcgtcgatctctacctcatcggcgaccatcttgcggctgcgggcacggagcgcgcggtcgcgatcgagctgttgcgcttgtttgcaccgcagctcttcttctacggcacgatctccctcgccaccgcggcgctcaacctgcggggcaactttgccgcccccgcctttgcgccgatcgcgaacaacgtcgtggcgatcgcggtgctcgtcgcgttcagggtcgctgacggctctgccaccctcgacgaggtcgcctcccgtccggacgcggtgctgctgctcgggctcggaacgacgctcggggtggcggcccagctcggcgtgctcatgccggtgatggcgaggctcggtctcggactgcgtccacgtctgcgcgtcagcgaccccgcggttcgcgaggtcgtctcgctgtccggctggacggcgggctacgtcgtcgccaaccaggtcgctctcttcgtggtgctcgcccttgccgcgacgcgggccggctacgtgtcggcctacaactacgcctacctgttcttccagctcccgtatgcggtggtgtcgctgagcgtgatgagtgcgctccagcccaggctcgcacgctcgtgggcagctggcgatcgagcgagattccggcgtgatctcgccaaggcgctcgccgtcggcgtcggtgccaccatccctctcgcggtgctcgcgtgggtggggggacctgccggcctcgatctcctcgtcggctatggggcggtcaacgagcacggcgtcgccctcatcgcgggtgcgctccgcggcatggcggtcgggttgcccggtttctcgctctttctgatgctgatccaggcgctccaggccatgcgcaatgctcgagctgcgttcgtcgcctacctggtcgagaacggattgaacatcgtcctcgccgtcgtcgcgctcggtccgctgggggtcgagggcctcgggctcgcgctgggactcgcctacaccatcggcgccatcgtcgcgatcgtcatcgttcgctcgctgcggggactcggccccatcgcgccgctcctcggctcgtgggtgcagctcgccgtcgcaagtgtcgtcggtggcgccgtgctggccgcgctcctccctagcacgctcgtcgcgccgaaccttggttttgccctgcgtgtcctcggcgggttggtcgcgggggtggtagtcttcggcgctgcggtgatcggcctccgcacaatccgagtggccgtggcgaggggagtcggacggtgagcgtcgtcgtcgttgcggattcagcgagtgatcttcctgccggggtggcagaggcgctcggtgtgcagatcgtgccgctcaccatcgaggtcggtggtcgggactgggccgacggcaccgagctcccgcgcgagcgtttctgggagctccaggcggcccagtcggagctgccgaagaccgcggccccatcgtcggcgcagttcgcggccgtcttcgaacgcgcgctcggtgagggcgctgaaggcgtggtggccatcaccttgacgcgcaagctctccgcgaccttccaggctgccgagcacgcctcgcgagactatggcggtcgggtgcgggtgatcgactccgagaccctcaccctcacagaaggcctgatcgtcgaggaagcagcacgcctcgctgcgagcggtgcggatctcgaggaggtcgcggcagcggtcgaggacgtgaagacgcgcgcgagaacccgtggcaccctcgacacgctcgagaacctccgccgaggcggacgcatcggcgcggcagcagcgctgctcggcacggtgatgtcgttcaagccaatgatcgacatcaccgacggcgaggtgaagccgggcggtcgccagcgcacgcggcgtcgagcgatcgacgatctcgtcgactgggtcgagggcctcggtccgctgacgcggctcggcgtcgtgcacgcgctcgctgacgacgtcgacgaggtcgtcgagcgcgtcgctcgcgcagcggcagtcgatcccgccacggtggcagttgcggtgatgggtgcgacgatcggcacccacgccggtccacgagcacttggagtctccgctctcgtggcctccaggtaggctgggagcgttccacgcgagagcggccacaccagagtccgtgagacgagcccagagaggagccagcatggcgaccttcgaaacgggaggggagcagccggacgtcgcggctcgcgtcgctacctgggttggcgaagcggtgtcgctcattcggtcgcggaccgtcgatccggcggcgttcgtggcccgtgtgctggtgtacggactgctcgcggctgcggtcggtgtcgtggtgctcatcttgtcgatcgacgccgtcgtgaagctgctcgatgcgtatgccttcggcaatcgagtctggatcactgagttcgtcgtcgcagccctctcgctcgccggatcggccgtggcgtggcggcggatgggacgtgcgcgtcggcgtctcggcgcttgaaccagcgcaccacgttgaggaggtagtcgtgcctgagcacgtcaaggtcgtcatcatcgggtcgggtccagctggcctcactgccgcgatctacgccgcgcgagcgtcgctcgagccggtcgtcatcgagggagagccctcctcgacgtccgaccagcctgggggccagctgatgctgaccaccgagatcgagaacttcccagggttccccgaaggcatccttggccccgagctcatggccaacatgcggcagcaggcggagcgcttcggggcgcgctttcggggcaccaaggtctcccggctcgatcttgcggagcggccgttcgcggtccacaccaacgacgatcgaagcggcgagccggcttatctcgccgacgcggtgatcatggcgaccggggctcgctcgctcatgctgggactcgaacgcgagtacgaactgatcggccacggggtgtcgacctgcgcgacgtgcgacggcttcttcttccgtggccacgacatcgcggtggtcgggggcggtgactcggcgctcgaggaggcgctgttcctcaccaagttcgcttccagtgtgaccatcatccatcgccgtgatcagctgcgtgcgtcgcgcatcatgcagcagcgggccttcgcgaacgagaagattcggttcgcatggaaccgtcgcgtcgtcgaactgctcgagcgcgacggtgtcctggtcggtgttcgcaccgaggacaccgtgaccggcgagcgcgaggatctcggagtcactggactgttcatcgcgatcggccacgccccgagcacggagatcgtcaagggtcagctggagatggacgatgcggggtatctgatcacgaagcctggctcgaccgagacgagcgtcgacggcgtgttcgcagccggggacgtgcaggatcacacctatcgtcaagcgatcaccgctgcgggctctggctgtcaggcggcgctcgacgtggagcggttccttgctgcgcgcgagtagcgggaagcatcgggtcgcagggggcgttcgttgctgatgcaacaagataagggaggtgcgcgatggcgggacatgaggtcatcctcacggacaagaacttcgacgagacggtcaaggcatcagagctaccggtcctggtcgatttctgggcagagtggtgcgggccatgcaagatgatcgacccgatcctcgaggagctggccgacgagatgagcgacaagctggtgatcggcaagctcaacgtggacgagtcgctcgagatcgctcgtcgcttcgagatcatgagcatcccgacgctgatgctcttcaaggagggcgagccggtgaagcgagtgatcggcgcgatgccgaagcgagccctgctgaaggaactccagccggctctcgaggactagcgcctgggcacgtccccgtgccgttcgtctctttgcgagggggcgagcgcagcgagcgtgtcgaggacttgtgtcgacggttgcggcgcctcgggttcgagctcgaggttcgtgacgagttcgacgatgaggtggccgaggccatcgtggccttccaacgacgtcgcggtctgccagagaccggggtggtcgatctcgtgacgtggcgcgcggtcgtcgaggcggggtttcgtatcggtgatcgtctcctctatctcaagcggcctgcgctccgtggcgacgacgttgcctggctccaaggcaagctgggctcactcgggttcgaccctggtcgagtcgacggcatcttcggtccgcgcacgcgcagtgcgcttatggagttccaggccaatatgggcctgcctgccgacggcatgtgtggtgcggcgaccatcgaggagctgcgacgggtcgatctgcatcacggtgcgcacgtacatggcgtgatcgagcgactcagccgcgccgaccgtcactctcggttcagtgacgtcgcggtcgtcgtcgccgccgaggcggcgctcgaaggcgtcgcggatctcgtcgcggctcgggtgcgtcgccgagggggccgctccgtcgtgctcgtcagcgacgtgcagtcggaacttgcccggacgatcaacgatgtcgcgccagacgtcttcgtccatctcgggtactcgctcggtggtcgttacgtggcctactactcgggctacaactacgtctctccggtcggtcggcaactcgcagaggtcgtctcccaaaccgccggtgcggtgcgaggactggtggagcgaggcatgagcatcccgatcttgcgcgagacgcgtgctcccggcgtctccattgcgttctccaacccccacgagtggtggatgctggcccccgatctcagcgacatcatcgtgacgagcgtggaggcggtggtgtgtcgagcgaggccgacgggaaaccatcgcgactgagtggctcgtgcgtcgtcatgagcgaactcccggtccgtgccgatggcacgccttgcgctggtccgcgggcgcgaacgggtatgatcggagatcccggggctatagctcagccggttagagcgcagcactgataatgctgaggtcgctggttcgattccagctagccccaccgtcctgacgagggttgtttcggcggaccggtcggcgatccgggcgttcgcaccgcatcggcaccacacgaggtcgcgggcctgtcgcgggacggctgtgtcggggtgccagctggattccttcgaaccgcagccccagtctgctggaaggtccttccaccctgactgcgatgctcgacgcgtcccgctcgagctgctcggaccgtcgatcggtggccttcccgccgtctgctcgacagtccgaggtgaagccagggccatctccccgcgggcccaggcaagctccgactcgaccggcggcacgtacccgaggcgcgagtgcagccggacagtgttggggcgccggatccagggagcgatgccagagggggccccggcgaggttggcgaagcggccgcaagctaccagctcgcgctcgcaagctcccgaagaaggcctcggccacggcgttgtcgtcgcaggtcgcgatcctgcctaccgactggcgaagcccgagcatcgcgctgagcgcgcgtaccgtacgggagaggcatggctccagtgcaacgaccggtcgcactggacggtaaccgacacgtccgcaccttggaatatcgacaatccgctatggtggcggcatggacagcgtcggcgaggtgctgagggaggcccgacgtcgtgccgggctgacgcaggcggaactaggtcgacgcgccggggtgacgcagagcgtcgtcagtgcgtacgagtccggtgcgcgccagccatcggtgtcgatgctggctcgtctggtcgccgccgcgggcgccgagctgcggatggagctgtccgaacctgcgggggccgcagcgccaggcggtgaactcggccagcggctgcgagaccgccgcgccgagctccagaggatcctggcccgctacggactgcgcaacgcccgcttgttcgggagcgtcgcccgcggcgatgcgggtccagacagcgacatcgatcttctcgtcgacgtgcctggcggagtgggcctcgtgactcttggacgctgccaggctgaggtcgaacagctcctcggagtccacgtggacctggtaccggcgagcgatctcaaggctggcgtcgctgccgaggttctcagcgaggcagtgccactgtgagccctcgggaacgtcagcgccttcaggacattctcgtcgccatcgccgtcatccgctcacacctcgagcgtggtgacctcaatgacgggctcgtcgtcgacgcggtacgagtccggctcatcgagatcggccaagccgtcaaggctctcccccaggagctgctcgcacaggagccagccctcccctgggcgcagatcgccggcatgcgagaccgtctcgcccatcgctacttcgacgcctcgcacgccatccttgccgccaccgtcaacgaggacctccccatcctcgaggcggctgttggccgtctcgagcggatcgtggcggatgcggccgtctggccacggccgtgaacttccgccgagcgagcctcgcagccgagagaccggctggcgaccacggccgtcgctcgggtctggctaggtgtctcgttcatgccttcctcctctcgcaggtgtcaccctggaggggggacagcaacggtcgtgggaggatccgctgcggcgatgagatcgcctccgtggacgccacgccctcgaccatggccgccggtgcctgcgccgtgcgtgggcggcccaggcgatggcgatcgcaggaggtgaggcgggggagcgagctcaccaggggcgtcgtcgacgcagctacgccctctcgcgcagtgcggtgaggaactcgatgagccccgccatgtaggtcgcctggtcgtcgtacatgcacatgtggctcccgttcggacataggaggaactggccctgcgggagacgctctgccatctggcgcatgtggtccgggtccatggtgtcatgagtcgcgccgatgacgagcgtcggcacctcgatggataccagatcgtcgaagcgatcccagtccttcagcgaggcgtcgcccgccatgcccatctcgctcgggccctgcatcggcacgtagatgtcgcgattggtgtgggcgaaggcgcgtaccaccggctcgggccactcgtcgagcggcatgcgcagcgtgtgttcgaggtagtagctccccatgagcagttcctcgtagcggccgctctcggtgtcgccggcggcctcgagcgctcgtgcttcggcgacgatcgctgggtcgagggccgggatgaggacctcgtcggcgtaacggttgtaggcgggagcactcgccatcatgttggagatgaccagccctcggagcgtgtcgccgtgtcggatggcgtactccatggcgaggatgcctccccaggagtgcccgagcagcacgaagttggacgcgtcgaggccgagggctcgtcgaacctgttccacctcgtcgacgtagcgatcgagtgtccagaggctggggtcgtcgggacggtcgctgcggccgcagccgagctggtcgtagtagatgtactcgatcgcagcgagcggcaggtagctgtcgaagcactcgaagtactcgctcgtcgcgccgggaccgccgtggagcagcaggactcgcaggtcaggggcgttgcccactcgcttggtccacaccgagaaggtccctcgaggcgtgtggatcgggatgcggcgggcaccacccgagagagcgtcgtcgcgggtgcgcgcgtcgagatagtcgtgcaggtccatcgctgcccccttgcggtcgagacgtctcgacgctagtgcgacgagcggggcgactggggccgaaacccctggcgagcgatcgcacgtaggctcgatgcatgacccaagcagcaacgtggcgtaaccgtgatgtgtggctgatctcgttgtccgctggttttgccgacctcggctaccaggcgatcgtcgccggagtaccgctgctgatcgtcgtcgacctgcgtgcgagcgccctggtgtacggcgtcgccgccggcctcggctacgggctggggacgttcgcgtcgctcgcgggtggtcggctcgccgaccgcatcggtcgacgtccggttgcgatcggcggcaacctcggcatcttgctcctgtcgctgatcgctctggcgagaagtgtccccatcgtcgtcctgctcttcgtgctgggctggctcgcgcgcaacttccgctcgccggttcgccgggccatgctcaccgaagccgtcgcgccggagtggcgccgcaatgcattcggccttctgcacgccgtcgacgtgggtggcggcgtgctctccgcgcttgcggcggtcgtgctcgtcggtgcgcacgtcgtcggtctgcggggcctgttcgccttcaccgcgatcccgatcgcgatctcgagcctgctgctcgccagcgcgcacccgcaccgtacgggcggcgccggcgcgcgtcgcgacgtcccgacggcgccggcgagcacgcttcgtcgtgcagtcctcgtcgcgaccgccctctatggcttcagctcctatgcgctcggctttccggtcctcgcggtcgcggcgcgctcaggatctgccaccgagggcttcggcgcctatgccttgttcctcggcgcctcggcgatcactggctacgtcatcggtgcgcgccgcgggtccccgatcggttggctcgcgcttggcggctacggcctctcggcacttggctcggcgctcctcgtgcccgagagcgcgatggtctcgatcatcggggttggactcctcggggtggggctcggcgtcatcgagacgttggagccgaccgtcatctcgcgactggcaccggacgcggctcaaggaggtgcgctcggtgcgctctcggcggcgcggagcgtcgggctcttcgtcgctgacgtcgtcgcgggtctgctgtatgcctcccacggaggtgtggcgttcgtctacggtgcggtgctcgcggcggtcgctgcgatcatcatcggcgcccaagcgccgctggcccgccggacgttcccagcgggccagtggtgagcgaagagcgcgtctagcgatcggcgtcgccgcgggcgaactcctccaccgcgcgtcgcgcatcctcgtcgtggagctggcgcggcggtgacttcatgaagtaggccgagggtccttcgaggggcccgccgatgccgcggtcgagggcgatcttggcgcagcgaacggcgtcgatgatgaccccggccgagttcggcgagtcccagacctcgagcttgagctcgacgttcagcggtacgtctccgaagttgcggccctcgaggcggatgtaggcccacttgcggtcctcgagccacgcgacgtggtcggacgggccgatgtggacgttgtgggagtcgatgccgtgctcgatctggctcgtcaccgactgcgtcttcgagatcttcttcgactcgagtcgcgagcgctcgagcatgttcatgaagtccatattgccgccgacgttgagctggtaggtgcgatcgaggacgagtccgcgatcttcgaagaggcgagccagcatgcgatggacgatggtcgcaccgacctggctcttgatgtcgtcgccgatgatgggaacgccagcctcacggaagcgctctgcccagaccgggtcagaggcgatgaagacagggatcgcgttcacgaaggcgacccccgcctcgagtgcggcctcggcataggcacgttgggcttgctcggagccgaccggcaggtaggcgacgaggacgtcagcacgggcctctcgcagacgcgccgcgacgtcgacgggcgggaggggcgactcggtgacgacttggcggtagtaggtgccgaggccatcgagcgtcggtccacgatcgacggtgacacccgcctcggggacgtcggcgaacttgatggtgttgttgtggctcgcgaagacggccttcgacacgtcgaggccgaccttctcgtcgtcgacgtcgaaggcggcgacgacctcgatgtcgcgcacgtggtaacccccgagcgtgacgtgcatcaggcccggtacgtcttggtcgtcagtggcgttccggtagtactcgatgccttgcaccagcgagctcgcgcagttgccgaccccggcaatcgcgaggcgaatcgttcccattctgttccccttctcctttctgagcgccgatggtctgagcgtcgatggctcgccgtcgtcggccgcatgtgacgacgttcgcatcgtcacgaggtcgtcgatgcgccgtagccagccggcgcggcgtcgaggaccgcgagttccgaggccgtgcgtgcccggacgatgtcgagccagaggtcgggcatctcctgctcgagccggtcgagctcctcgagacgctcgacgaggctgcgccgacgaccgcgcagcagtgcgcggcgcgtctctggcgcgaccagcgaactcgccaccagcgcgatggtcgcgatgcgatcgtcggccatgtcggcgaactcgagcgcggtgcgcaggcgcgcacgtccctcgtcggtgatgcgataggtccgtcggctccggccacctgcggtgctggcagccaggaccaactcggccgcgaggacgccggggaggcgagctggatcgaggcgacccaccgcaccgacggaggcgatgagcccactgcgcgccaagcgagcgagcgccggatagatcgaaccgtacgagaagcgaccgatctccccgaaggtcgcctggagccgacgggcgacctcgtacccatgggccggcgccgcctcgagcacgacgagcgtcgcgagttcgaccgccgtcagctctttcgcgcgctcggacgagaccatggtgcgtagcatagtggctgatacgagatatcgattcgatatagcggccgaaaccctgattccggccatcgtgcggtggaggcgctaccatggcgtcgtggatcaaggtcgcgcgcgcgaggtcggtggtcggctggccaccagcgtcgatcaccgcctactcaggtggcgaacgctgcgcgccctcgctgccggaaccatcgtcagagaagacgtgtgtgatgccggtttcgagctctcgcgtgcggcgagcgcgttcggcattccccgaggggtcgtgtgtcctgtgtgtgctgccgatgcgttgcgtgaggttgcattcgccttcggcaaggggctcccgcacgagggccaggtcgtcgggggcacgctcgtcgaggaggcgctcgacgcggtgccggatgttcggctgtttcgtgtcgaggtctgtctggcgtgccgttggaacttcgtgatcgaagagcgcggtcacaccggcgtgcgatagggttggatcgatgccggtgtcacccccggcagagcgcctgtagcgcgaggagcgcacgggacctcggagagggggaaacatggagtcagcgtcgatgagcgaccgtatcgcgacggtcccggccatcgctggatcgaaggtacgctccgggagtcggccactcgtcatggtgaccgcctacgacgcgccaggggcgcgcattgccgacgacggtggcgtcgacatgatcctcgtcggcgactcggtggcgatggcggtgctcggcatgcccgacacgctcggggtgcgggtccgtgacatcgcccaccacgtagcggcggtgcggcgggcgcagccgagagccctcgtcgtcgcggatctgccatggttgagctaccaccgcggacgtcgccgtgcagtcgaggccgccggcaagctcgtgcgcgccggcgcgcaggccgtcaagctggaggggggtcgcgaacgccttgacgtcatcgacgcactcgtgcgcgcgcagatcccggtgatgggtcacctcggcctcaccccccagagcgcgaacgtcttcggtggcatggtcgtccaaggccgttcgatcgtcgcggccgaacgcatcctcgcagacgccatggccctcgagcaggcgggggtcttcgccatggtcctcgagggaattccggccccgatcgcctcggtcgtgacggctcgcgtcggcgtcccgaccatcggtatcggtgcgggcgcaggttgcgatgggcaggtcctcgtgttccacgatctgctcgggttcgccgatggccatcggccgcggttcgtcaagacctatgcggagctcggcgccgcggctcgcgaggcggtcgccgcctgggccaaggacgtgacggagggcgcctatcccgatgacgcgcatgcctaccgcgcctctaccgagctcgctgcgtgggccgagcgacagctcacgagcgaggagcgtcgtgggggcgcgcctcgctcctagtcgctgggcgcgatatctgcgaagcgggtccagtcggcgatgaaggccaggttgacggtgccctggggaccgttgcggtgcttggcgacgatgatctcggcgacgccgcgatcggtggtgtcggggtggtacagctcgtctcggtagatgaacatgaccacgtcggcgtcttgctcgagagagttgtgcacgatgacgccgtcggcgacgaacgcatgcgtctcgggtacctcgatatcgaagacgagctccgtgccgagttcgtcgaccgactcgacgacggtcgtcgccaccgtagtcgcatccaggaggacgtggaccacgtcgccggatacgagggtcccggcctcccgccatcccgacgatgtggcgatcgggtgattgccggtcgcgcggaggatcgagccgttggcgagggtcaggcgtcgcagtggcttgaggccggtggccacgacgcgtgtacccatggcgaccgtcggcacgccctcgggggtgacggatgcgagcggaacggatctcgcccccttgctccagagcatgccgatgggaacctcggtaccgtcggcgaggcgtaccttggcgtcccacgagaggcaaccggactcgcggaggtccgcgagttgcgggcgacgatcgctgcgtgattcgaggttgcgcgacagctgggagagcgcgatgatcggcacgtcgagctcgcgggcgagcagcttgaggccacgggagatctcggagacctcgagctgccgtgactcgctctggcgtcgactgctcatcagctggaggtagtcgatgacgacgagcgagagtccttgctcggccttgatacgccgcgcgcgcgtgcggaggtcgaggacggtcaggttcgggtcgtcatcaatgaggatcgggcgcgtggcgagttcgccggcggcgttggagacctgatcccactcgcgttcgttcagacggccggagcggaggcgttgcgaattgacgcgcgcctgcgacgcgaccagccgctggccgagctcgatgcggttcatctcgagcgagaacagcaggacgggctcgctctggttgcgggcgacgttcagcgccatcgagagcgcgaaggacgtcttgcccatgcccggtcgagcaccgacgatgatgaggttcgatcgatgcaagcccgtgagcagctcatcgaggtcgcgaaagccggtcgggacggcgaaggcgcccagatcgtcggagccggcgacctgctcgagctgctcgaggacctccatcagcacctgctcgaggtgcgccgcggactcgtgactcgtgccccgcgcgacgttcaggatgctggcctcggcgtgatcgagcagcgcgcgtacgtccttcgggaggccgtaggcctcctcggcgatgtcagaggcggtccggatgaggcgccgaaggatcccgtagtcgcggacgatctgggcgtagcgcccggcggacgcgatggctggggtctggatgaccagacggttcagcccctcttgaccaccgagcgcctcctcgatgcccaggcgacggagttcgtcgcccaccgagaccgggtccgtggtctcaccgcgggcgtagaggtcagcgaggacgcgaaagagctctcggtgtgacggtcgaaagaagtcgtcggcttcgacgagttcgacggcgtccccgatcgcttctcgcgacagcagcatggccccgaggagcgactcctcggcctcgatgttgtgcggcggcagccgatcctcgggcccttgcgagcgggccatcgcggaccggggctcagcgctcgctggccgcgaccgaaacggtgatcgccacgtcgacgccgtggcccagcgcgatcacgacggggtgctctccgacctgcttgatcggagccggaatgcgcacgtgctcccgttcgatcgtgacgccggtggcttcggcgatcgcgcgcacgatgtcggcggccgtgatcgacccgaacagcgtgccctcctcggaggcgcgagcactgagtgcgagctcgatgccggcgagctgacgcgccgtggcctcggcctcggcacgctcgcgctcgcgtgcgagctgtgccttcgctcgcatcgcctcagcttggtgggcgatcttcggcgtggcggcaacggccagccgacgcgggatcaggtagttgcgggcgtagccatcggcaacgcggacgatgtcgccacgatcgccgaggccttggacccgcgcgcgcaggaggacgttcatgcctgttcctcctcggctgctggcgtctcttcctcgtcggcgctggtgcggtcggtggcctgggcgcggttccgcgagcgcagctcgcggtcaccgacgggctggtcgccctggttgcggcggcttcggtcggagaccggacggatcacgtagggcagcagtgcgagctcgcgcgccaccttgatggcgttggcgacgtcggcttggtgctgggcacagttacccgtgacccgccgggcgcggatcttggctcgctccgacgtgaaacgacgcaggagatcgacgtccttgtagtcgacccagtccacgtgctgctggcagaaaacgcagggcttcttcttgatgcgcttggtctcgggtgcctcgcggccccgacgcttgcgcttggtcgctgtcttcggcattgcttagaacggctcctcttcgtatcccacgcccccgtcggcgacaggggacggctcgttcgtcacgggtctgcccgatccggtccgacgctcggtgcggtgcacctctgcggttgcccaacggagcgacgggccgacctcttcggccacgacctgaaccttggatcggcgctctccctctggcgtttcccagctgcgctgttcgaggcggcccacgatgatggcgcgagaacccttctcgaggctcgtcgagacgttgtcggcgaggtcgccccagcagatcacctcgaagaacgaggtggactcttcccactcctgggtctgctgattgaggcggcgtcggttcaccgcaatggagaagagcgcctgggcccgaccctgggcggtgaagcgcagttctggctccttcgtgaggttgccgacgagtgtgacggagttacctgctgacatggtggcctttcgctcggttcacccggcctaggcgcggcctggcgcgccgaggagggggatcttgccgttcgcggcgagcgcgtcagggagccgaatggtcttgtgacgcaggacaccgtcggcgatcgagagcacacgatcgagttcatcgatcgtcgctggttcggcgtgcagccgaaggaagctgtaggcaccatcggtgcggtgtgcgatcgggtaggcgagcatgcgccgaccccagtgcgcttcttgggtgatggctccaccgccctgattgacgatggaacgaattcggtcgaagagcgcggtgcgcgcttcctcgtcgagcgctggtgacgtgatcagcgcgagttcatactcccgcatgtgggttcctcctgtggacctgggatgccagggccccatgatggggcagggtggcgccgagcgccacagcgagcatagcgcacctaggagtgcgcccgcgcctgaccgatcggcggttcgtcgtgtcgatggaggggaagttgcgcctcgagctcgtcagggatcagtcgactgagggaatggaagaggaggaacgagaagccgatctggaagatcacctcaccctggaacagaaccatgatcccgtcgttcggcagcgagagcagcgccatgacaccaccgacgatctgcatgacgatcatcgtcgcgttgaaccaggagcgcgcgtagcgccaccagatccaccccgacatgagcagttgctcgacgaagaggatggagccgagggtctggtgggtccagtcgaagagggtgccccaggtgtagggggtgaacgcgatgccgacgatcagcaccgccatcatccggagcgcacggcgcagcacgccgagcccgccggtcgtggggaggtcacgtccagccctccacgagaggacggcacagagcacgaagccgatcgcgagcgggatgaagctgtcgaggtgggtcaggtagtagctgatgccgtagccatcgatcgccgaactcgggtaccagatcgcgacgagcagcagggcgccgaagagggcgaggtcggcagcgaggagccggtcgagtgtcttcgtccgaagcatcgctcgcctcccttcgcggtcaggacttcatcgtcgctgtgccatctcccaataacgttgcattatacaaccgtaatcccgccccgcgaagccacagctggtgttcggtcgctgaactgccagcatggctcatcgatggcgtcctagactcctcgcggaggtggtcgtggtgggacagcggtgggccgccctcggtacgtcgggccggatcgtcacggtcgtctccgtgatcgtgctgatcgctctgttcctaccgtggtacggcgtgagcatcggatcgctgagtgtgtccgtcgatgggttgcactcctacggcctgctgaccgccctcggtgtggtcgtcgtcgccgtcggtgtcggcgcgaacgcgccatgggtgcgtggtgcgcgtcttgccggggtcgtgctcgaggcggtcggcgcagtcgcgttcctcgccgcctaccatgcggcagggtcgacgagcgcgctgtcggtgtcgttcggacccgagatcggggtgtatctcgcgctgctcgcgagcctggttggcgtggtcgcggcgttgaacgaacgccggcgtgccgtctgatgcgtcgcctcgcgtggatgatggttgctggcgccacgctcgcggcgtgtggtactgcgaccgcccaggtgaccggtccggtcgctcgtgcggctcgcgcgctcgcatcggtgccgttgcacttctgtttcgtcatcgacgcgaccgcgcaggacgcgcaggagcgcatctcgggttgtggtgacgagtccgccggtgcccgtcggttggcgctgacgcagaacctcctcgagcaggtcggaagccaacgccagcagagctcggagggtgtgatcgagattggctcgaaggagtgggtgagctcgagcaaggtctggcaactcgtgacgccgaccacgaacgtgatcgagccgctcgccgtcgcggacctcgtcgacgcagcgcccggcttcgtcgtcggccgtggcagcgtcgtcgacggtgtgcaggcgctcgcctactcgacggtgctcgagggatcgtcgctcagtcggacgcttgcgcgccttccggcggcgctcgcggagcagtatcgcggtgagaacctccgcagtgacgacctcaccgtggagctcagcccgcaggggcggttgctcgaggtcgaccagcaccagtcgctcgtcgtgtcgggtcaggcggtgaccgcggtctcggttctggtgctgtcgcgtttcggccagtccgtgacggtcacgcccccgtctccggtcgccggctgagtcggtggccggccagcacggcagcaacggtggagagcagcaccacggcgaggagcgcttcgccgcccgcagcgccgatcacactccgcagcgccgtcgcgatcgcgatcgtgacctcgccgcgcgggagcatcccgacggcgatccagcggtcggggcgtgcgatgagcaggtagaggccaaggcgtgagatggcgagtgcgaccaggaggccgacgacgacggcgacgttcatccgccagagcggaccgagcgagccgagcacgaaccctgccgtcgcaaagaacatgaggccgagcgtccggcgcgaccacgtgaccacggcggctcgaggaacgaggtcgtggaggagcgcaccggcgagcgcaccggcgagcgcgggtgacgtcccgaacgcacaggtcgccgtcacgacgagcgctccgaggagtcgtggtgctcgcgcacccgtttgtcggaggaccagtgcgatgacgacggcgacgacggtcgcgaccacgctggtgggacgggcgccggtcgggagcacgaaaggcgcagcggcgagcagtgccaagctgacgaggtcgtcgccgatggctgcctgcaggatcgacgtccgggagcctcgtggaacgtgggcgagcgggaggacggtggccgccaacgccccgctcgtcgggatggctgcaagcgcgatggcaagggctcgaacggcacccacgccacttacgaggacggcaccgaaggcgccgaggccaaggaggctcgcgccgatcccggcgatggcgaggccgcggcccgcgatcgggtggctgccagagccttggagctcctcaccgatcccgaagagcacgacgtagacgccgagcgactctgcggtcgtcgcgatgtgggtagcgacggccggatgggggagcagagcgacgagtgtcccgacgacgagcatcacgagtgcggttgggatgcggctcgaggagtgccgcagggatccgacgatgctcgcagcgagcaggaccccgagactgagcgccgtcatcgccgacctccaccgtcgaggtgctggcacgcgagattcagagcctagcctggaggggtatgcgacgcagacctcgacgcctgagcgcgcttgtcgtggtggcagcgccgttggtgctggcgagctgtcacttttccaacggcgactacggaccggcgggtgccggtgggggcacgacgtcgtcggcgagctccggtccgatcggcgcgaacacgaccgcgccggacgcaaagctgctaggtggctcagccgccccgaagacagcgtcgacctacgacggtgctggctttccgattccgacgtatccgccggttccgtgcccgagggcaacctgcctcaacgggtcgcctctcgagccggtggagatctcgtggcgcaactcgccgtatgggccgatcctcacgacggcgagcggggagaccctctacctgcgccttggcgacggctttcgggagtcgggctgccatggcatctgcctccgagcgttcccgccgttgctgacgaacggcgccccgcaggcggcccctggtttgctcgcggcggatgtgggcgacttgaccgcgtcgaacgggaaggagcaggcgtcctacggcggtcacccgctctacacctaccgtggcgatacgaaaccgggtcagtacggtgcagagggcaagggcggcatttggtacgtggtctcgatcacgggcctaccggtcaaggcgccggtgcattctggcacctcatcgagctcggccactacctcgacctcgaacggctgatcccgccctggggcgccctcagtcgactggggtcgacggcgtgcggagagcgccgaggagcacctggctgatgtcggcgacccgcacatgctcgggtgcgtcaccggtcgcctgacgagccttcagcccatcgtcgagcatgatcatgcagaacgggcacgccaccccgacgacgtcgaccccggtggcgagcgcctgtgtgacgcgggcgtcgttgacccgctgtcccttcgcctcctccatccacatgcgcgccccgccggcaccgcagcagaagctgcgcgaccgattccgctccatttcgagtggatccgcaccgagtgcggcgccgacgacggctcgcggtgcgtcgtagacgccgttgtgacggccgagatagcacgaatcgtggaaggtcgctgaggcgatgctccctgcctcgaccgggagacgaccgtcgcggacgagctccgcgagcagctccgagtggtggcggacctcccagttgccaccgagggctgggtactcgttccgaatggtgttgaagcaatgcgggcacgaggtcacgatgctccgcgccccggcctcggtgagggtgtcgatgacctggcgagcttgcatctggtagaggtactcgttgcccatgcgtcgtgctggatccccggtgcaggtttcccgcggaccgagcacgccgaagcggactccggctttggcgagcagcgtcgccgtggctcgggtcaccgcctgggcgcgttcgtcgagcgccccggcgcacccgacccagaggagtacctcgacatcagctgggatctggccgtcgaagacgggtacctcgacgtcgagccccttcaaccagtcgagccgatgcgaagcgccgagaccccacgggtcgccgcggttttcgaggttgcgcagcatgccaccggcctcagtggggaaggacgactccatcaggacctggtagcgccgcagatcgacgatggtgtcgacatgttcgatgtcgacaggacaggcggcgacacacgcgccgcaggtcgtgcaggcccagagcacctccggatcgacgacatcgggcacaagggacgtctcttgggcttcagggttcgctccgtgggcgagcaccgcctctcgcaggctcatgatgaggagcttcggtgagaggggcttgcccgttccccatgcgggacagagctcctggcagcggccgcactcggtgcaggcgagtgtgtcgagccggtgcttccagtcgagctgaccgatggtgccgacgccgagcacggtcgcttcatcgaacgcttcggggtcgaggtcgggtgtcgttgcgagcgctcccagggctcgcgggcgccgcgcgaaggcgacgttgatcggtgccgtcgcgatgtggaggtgcttggagtgcacgatgaagacgaggaacgcgaagatcaccgcgacgttcgcaacgaggaagatcgattcgagttcgtagttcgtatgggcacccatgtgccggaatggcagcgccacgatctctgacagccaggcaccggaacggtacgggaagtcgccgtcgttcacctgggttgctcgataggcgacgagggtcacgatgacggcggcgatccacccgagcgtgagccacgccacaccggtgtgcgaaccgtagaagcgcgatgctcgttcgcggcgctggggtgcctcccgaagccgaatgacggcgaagacgacgagcgaaacgagcacgaggaacgccatggtgtcctcgagggcgccaagccagggctcgtggccgatgatcgggaaggcaaagtggcggtcgaacagcgccccaaccgcctccaccaccgtgacgagcaggatcgtaaagccccagaacgtgaagaagtgggcgaggcccgggacccgtttggtgaggagccgacgctgaccgagcacctcgacgacctcggcgcgggcccgtcgcgcgaggctcgctcgacgcccgggggaggcgggcccacggcggacggcgcgtatgagcaccacggcccgtcggatcgtcagggcgagcgcgacgacgatgatcgcaaggccgatcgcaaggcgcatctgagcctccttgggcgtcaggaacgaatggatgttaccactcagtagcttcgtggtggcggcggtcgcccttgatgtcgtcgtgatcgaggtggtaacgagacggcgtcgggccgcgttgaccctggtacttcgaggccagtgcggcactaccgtaggggtgctcggcagggctcgtcatctgcaagaacgagatctgcccgacccgcatgccgggatagagcgtgatcggaagctgagcaacgttcgagagttccagggtgacgtggccttcgaagccgggatcgatgaagccagcggtcgagtggatcagaagaccgaggcgtccgagggacgacttgccctcgagtcgtgcgacgagatcctcgccgacgcgcacgtgctcgatcgtcgagccgagcacgaactcgccgggatggagcatgaacgctcgcccgaaggggacctcgacgagctcggtcaagtcgtcgggaatggcagcaaggtcgaggtggccggctgagtagttgcggaacacccgaaagagtgcatcgagccgcaggtcgatcgatgacggctggatggcaccgggcgagagcggatcgaccgagatccgaccagccgcgagggcgtcgcggagcgagcggtcagagaggatcattggcgctacactatcgcgacgcagctcctgtcgcggaggcagggtgcccgcgggcgtagttcagcggcagaacatcagcttcccaagctgagaacgcgggttcgattcccgtcgcccgctccacgcgtagcaccagctcaggggcatcctcgatagagtgtcgactccgccgagaagccgagcagccctgctcagaccacaaatagaccacatctgcggctgggagcacaccgcgaggtgtgcttgcgcgacggggtgcgcctcgtggcggcgtcgtcggcgctacgaaggagagcgcttccacactgcctggcccgaggttcccccaagacgtcggtcgcttcggtctcgtccgatgggcttgcgtgggcagatgcgaggtccgacagagccgcagcgattgccttatcgcgttccgcggtggcgtgctgatagatcagcgcggctcgtggtgacgagtgtccgatgcgtgccatgaggtcgcgcgtgctcgcacctgtcgccgccgcccacgtattactagagtgacgcaggtcatggaggtgcaggtcagctctcccgatactgcgccgtgcgcgatcccaggtgctctggaggacgtgcacgcgaagcgggccgcccatagcgccagtgaacagcagggcatcgggttctgccccgacatagcggtcgaggtgttcggcgaggccccggatcgcgtgaggaggtatcgcgaccgtcctcagcccggcttgcgacttcgggggccggtgatcacggtgccatcgcgaagctgatggctggtgcgttgaatgcggagcggtccgtgcggcaggtccacgtcggagcggcggagggcgagaagttccgatcgtcgcaggccgctccaagcagccagcacgacgagcatcgcgagcctctcgggcatggctgcggtgagtgcgtccacctcccggatgctggcgatcggacgctccgtgggctgctcgacgcctgcgccctcgacgcggcagggatttcgcgtgatccgctcgtcggccaccgccgtgttgagaattgcgcgcagcaaccggtaggccttcgccgctgtggatggatgctgcccagccagctcggcatgccacgtacggactcccaacggggtgatcttgctcaagtcggttcgcccgaaggctggcaggatgtatcggtccaagagatagcggtacagttcgacggttctcggccgtagatctggacggtgtgcgagccacagctcggcgtaggcacggaatgcgagctgacctagccgcgggtcgacccactctgcccgttgcatgtccgctcccacccgctccaggaagcgacgtgcttcgatcttcgtgggaactgtgcgtccacgttgacgcccgtccggatctcggtagcgggtttcccagcgtccggatggcttgcgctggatgcttgacaccgatcgctcctactcgtgcgtcctcagttgggagatgctgctggcagactgatcgcaaccagtgtcttgtcgtcatggcgcttggcccgagggaggagcgagccgttggggtctcgctcgctctcccagcgatagcaacggtctcgcgcaaggcagccaaccatgtcttcgcccatggcagcggtcgtctcgtgtacggagacgtgcgggggatcgagcaagcgaccaaggggcgccgctcagccggtcgtcatcaacgccgggagccttcgcagtggtcgagaggacgccacgaacggtacctcgacgacaagaccggcctgaaaggagagcacgtagacgaagctgcttcaacgaagacatgcccagcgtgtggagcacgcaaccgaccgagcggtcgggactaccggtgtgcgaacgctgactgtgggtttgcctaccaccgagacgccgtaggagcgatcaacatcctgcagaaagcgatccacgggacctatgtcccaattggaccggatgtcacgatccatgtcacgtatctccgggctgtcgagcgttggtcaccacgccagagcgaggcacaccgcaaggtgcagtaccgaagggcgagagccctgagtagcgcccggaaccgggcttcgtcaggagcagtcccgacgtgcgagcaaaggcaagcccaatcatccaccagcttctcggggccagaccagttagtcgcggtggcatgaggacggcgatgtcgagcaaccccaaccgtatggacgggctagaagccccgtccgtaagggcgggaagggtccccgacggcgcgcctgtgtggctcaagagggacgtggctgctcgagagaatgaggtaaaaggtgtccgaaaagctcttcgaggaggaagcgggttcttgcaggcacgggccgattgggatagacggcttcgagcagcgcaagtccgtccgctgccgtcctcatgccgcaaagaccatagagcagtttgatgtcgtcgacgtcctggtccgctcgcgatgcgaggagtttcatcgccaagagctgacgtggggaggcaacagaaacggtcagacccggtcggcggatgacgacagtcgatgcaggatcaggaccaggaaagaacgccctcgctccgtcgttgagccagtcctccggtagacccatctcgatggctaccgttgatgcggcctcacgaacggttgccttcggctcaaagacggcatccacatcccgcgtgattcgccgagcctcgtacgcgagcgcaagggcgttcccaccgacgacgtagatctcggctacgaccccacggcgctcgagctcgtcagcgagacggttgaacgcttcgagaatgagtgtcgcgttgaagcgtggcctcggttcagacacgatcgaacgcgccttcgttgacgaacacgccgtggcgtttgagctcgaccgggctgtctcgcagggccatcgcctcatagcccggcaagccagccacgaaccaccacggctcgacgtagcgtgtcgcttcggtcgtccacgacggcgcagcaatgccagcctcgttgcagaggaactcaacgatacctgcaagcgccgcgtcgaatcgtgtgtcgccgcacagcggtggcggatctgcgaccagccacgccttcccgagacgggacgatcctcggacgtcgtcgacgaagtcgagcacctctcgccacgccgaacgcacgccctcggtgtggagaagttcggtgatggtagtcgcgacatccgcgactggctttgcacctcggcgcacctgcggacgcaggaccaaatccacatcgaagccagcgacggcaacgatgcgttgcagcgtgctcaacctcggctcgatcctgccgcgttcctagttggcgacagtcggttgcgaggtgcccgcgagcagtgctagctcctcctgtgtgagctgtgcttgggcgcgcaggtcgcgcagcaacacgctgatgcgctgatagctgcgcgacgcgggcatatcagaaagcgtatcgtgcccgatgcccggcactgttgagtctgagtggggaggagcgcctcgacaaggagatccgccgacgtacgaacgtggtgggcatctttcctgaccgagctgccatcatccgcctcgttggctcggtgctcatcggcgagaccgaggagtggatggaacagcgtcgctccatgagcgctgaagcccttgccaaggtgacccgggtcactgtggccgagaccgaggaccccgccacagaacaagcacaacgcagcctgccagagccgatgggggcgtcggctcgagggaggatccgcggtggccaatacaccactcgtttggacgcgacctggcgagtacaggaacaggttggtgggaaggaccggcgtcgtcaggtgcgcacgcacttcgtgcccgaggaaggcgaaggatcggtgccggttgatcgcgttccagaccgatggcttcgtcacaccgatggcttcgtcacaccgatgacttcgacgtccgatcactcgggacgccctcgttgagcgtggcgacgaagttttcaggaccagacgtcggcatggtcttcaggtcagcggtgagctcggcggcggtcagctgcgggtagagcggctcgagccgactgaggtcgatggtgcccgggtgatcgacgcagaccagtccgtctgggcactgcatcgacatcgccggcacggagaatccgagcggcaccgtgatgtagagcgggtcgaaggaccgtgccagcggcgcctcatagggtgcaccgacctcgcagcccaatgatgcctctgagctcacgtgcaggtcgcagtagaggcctcgggtgtgcatgaacggtgcgaggtgaccgtcgcagagggcgtcggtcacgccttactcgttgacgccttggccggcccgcacggcgttgctcgggggcggcgtggacgccgccgccgttgcgatgcctgcaccggtcgcaagggcagcagcgaaggcgactgctccgttccgcattcgtcgtcgtgcgactcgtcccatctgtcctcctcttccctccgtcggggtctcgtgggatccggattcgaggcggtccttggatggagccagaggcgccgttgaggcggaagggaccgaccttggagcgtgcggtgaaccgctgggcgtaggtgcggcgcgggtgagtgctgaatactgctacagtacgtcacgtaatgatatgcggagagcatggaatcgagagggtcgacccctctgcaaccacggctcggcctcgaccgggacggcctcgggatcggcgtgtcgacgcctccgtcatgggcgcaaccctggcccttctcgacgaggtgggctacagcgcactcagtctcgagatggtcgctcgtcgtgctcgtgttggcaagccgagcatctaccgtcgctggccgggcaaggcttcgctcgtcgtggacacgatcgtcacgatcgcgggcaccgatccggcaccggacaccggttcgctccgcgacgacctcagggcggtcgccctggctatggctgcgctgtatcggacgccgctcgctcgcacggtcgtgctaccccttctcggggatctcgccgacgatcctgatcttggcgagcgcttcaggcggcgctacgtcgcgccgaggcggggctcggtccaccgggcgctcgagcgtgcgcaggagcgcggcgagatcccgcgggtggacgaccccgagctcatctgcgatctgatcgcagggccgttgttccaccgtgcatttcttgttgccggagagatcgacgaccgcttcgccctggcaacggtcgacgcggtgctgatcgtgctggagtcggggcaagccggcgaccgcaactcgggaacaggaaaaggagcctcccagtgagcgcagatgcccagagggcgttagaggcaaccagagcgcccggtacacgtccgccgctgtggcttcgaacgtcggtaccggtcggggttgtgtcccagtgcgccgccgcagcgctcggcacggggctcatcgcggttgcggccgactcgtaccggctgggggttgacctccgaggggcagcgctgatcgttgggttcatactcatctatctcaacacccatgcggtggctcactggttcgtcggccggatcgtcgggatcaggtttcgaggcttcggactgcgaggaacggatcacccggagaactatccgccgggccttcgccacctcatgggggtactgccgatgtgggtggcgatgaccgagcccgagagtcggcgccgcgcgggtccccgagcccgcgcggcaatgtacgcagccggggagacgtccaccacggtgtgctcggtggcagcggctgcggctgcgttcctcgcgcacgcaccatgggcgcgcggcctgctcgtcttcgcggtcctgtggaaccttggtgcctcgattgtggtcagcatgatcgacaagggggactacgcgaaggcgcgtcgtgccctgcgggcgcggtagcacgtgcgccccactcgggccgtacttcttgcgatcgcgttctcgttcaagcggaggtttcgcggcggttcgtgtcccgcctggcgccttgtgagtgtgcggctggacgagctggacacggggctttgccgcctggcagcgtgctcgatgagggctcaggtcgccgctggcgagtaggagatgagacggccgtcggcggagctgcgtaggtgcagctcgaaggtgtgtgcccgcaggatgagtgagaaggcgtcgaagggctggcgcgaggccgcgtaggcaacgccctcgatgtcgatcacccactcgctgcgcgcgagcccgagcacgccacgctcctgcccctgtggtgggcgcgccaccagccactgctcctcgtgggtctccgcgagcccgaagtggtgctcgagggcggcagagagcggatccctcgatgggtcgaacaccgcgtccagggatggggcgaggaccgtgggcacgagcgcgcgctcaagcgcgatggggtgcgccccccgcagacagcgcagagacctatcgcaaggcgcaagtcctcgctggatgcaggggagtcccgggcgagcgtcatcgtcgtaacctgctcttcgtgcaggtcttccggtccgggatcgcctggatctggagtcgtagcggcgtaccgacgtcctcgggatggcctctgatcgcagtgctgtcatgcaactgcctgacctagtgacggcgaggccacgactcgcaatggcccaggcgctcgaagacccgcaatggtggtcgctcagaccgacgagctgcttggggtcgtggtctgcgttgggaagctcgccgctcgggcttccggaggtgtgcatggttgggttcgggtcgggtcgtgcggaggcaacagaccacgtcggttggcgtaactcgacattcgggtacgcgttacctgccgtctgtgcgcttcgccgaggtcgcgagggcgtggctcacgctgcccgacgcccgaagccaggtagcaggcgctcgacggacgaggtgacgagatgcaggcccgcaaggccaggaaggcgttcgatacgacgatcgatgcgtgcgaccacctcgggtcctcctggaccggtgaagagtgtgctgatgagcgcacgtacttcctcgttcgacttgacccccgaccctacgggtgcccaaaaccgcgcgagagccgatcgtacgatgcgctggtcgcggggacgctcgagcagggcgcgggcctgcatggtgtagaagtcgatgtggcgaccctcttgcttcatgatctcggtgagcacccccgtgagggcggggtgctccgctcgtgccacgagccgcgcgtaaccagcctgcgtcgtgagctcgttgaccatcccccatgccatgaggagcccgggcaacgccggagcgatgggcgagaagacggagaagccaacgagccggagccaatctcgagcgcgacgagcgcgtcggagcgttgcggccgcatcgggggcacctgccagcccatgcgcggtgaggatcttcccgatggcgtcaccgtgaaactgctcttcgtagacccagcacgcaagaaaccgcgtgatcgccgggtcggcgtggacgggtgtggcgaggagttcgcagaggtagcagaccgtatggctctcgatgtcacacatgtaacgaaggcatgcgaggctcgcgtcatccagcgggtgcgatcggaacgcatcgatgtcgatctgctcgacctcaatgcgtcgagagcgtgcgacgagggcatccaaggttgtcggcatacgtacctacttcggagcaacggtcggccgtggatggtacgaggactgtaggcaccggccttcttttgacccgagatcaccggtcagaactgacccatccgcgacacacgtttaggtgatgaccttggggtcggggtgctcggcctcacctccctgtaccatgccagcggcttcctgccgcagcacggatgggcttgtggagcgagaaagcgtagcggtgccgcgcaggacagcatgggctgacttgctcgccgcagacgggagagcacgtcaaggaagcgggggccgtaggctgcctcgagcgagggcacggctcgtcgcttccacgaccaggcctccctcgaatggccgcccggcctcggtggcaatcagggagggaaagccgcaccctccatcccaccaggcccacgccgtccagccgatgccgtgtccggcgaggaagtccacgatgtggcgttccaggttgagcgggtaggggttgctgcagccgaggacgccgaactcggtggcgatgactggccagtgtcgccacgtcgaaccgagctcgtgctgccagagcgcgggccctgtcggttgtgctgcttgtacgtagaggtgcagcccataggcgacgttggtaccggccaggtgccagcgcgtcaggcccgcaagcgtccccgcccaatcgatgccgtccgcgatcacgaggtttcgcgcacccgtggcccgtacggtgtcgaggagcgtctgttcgccgatcgcgtcatagcgtcgtccggtcgctgggcaggtgatcaaccctccgtcgcgccacgtcgaccacgtgatgtcgtggggttcgttgtagagctcgaagaccaccccgggccaggtgcggaagcgctccgcgagggtcctccagaatgcgatgctcggagggtctggcgcacacgaaggccctgctgcggccggggcagtcgaggtgtcagccccgatgacggtgtgcaggtccaagatcacgacgagaccgactcgtcgtgcggcacgaaccgcgcgctcgacgagttccccgtactccggatcgtagcgtggggatccgcgtaggaggaaggcctcgttgagcgcgatgcgaactgcgttggcgcgaaagcgcgtcaccatcgagcggagctcagagaggtccaggcctggggctccgtcggcgtgctgccctgcgggtgcccagtcgagactcggccagtcgacgccatggaggtagatcggcgttccgcgctcgtccacgaccaagggaccccgactcacgagctggccggtgacggcacccggcggcgaggggctgaaggtgggccgcctgtgggaatgcagcacgacaacgaggagggttgcgatgccgagggcgaccaacaccacgagcgccgccacaccgcggcgtctgcggacgcccgtcatggtcggtagatgtcgatgcgggagagtccggagccgaactgcgcgacgaggtggtcttcatgctgaacagcgctaatgaacggtaactgtgtctgcaccgcgcgcatctgaggagtcacgacaatgaggtgcatcgccttccagccctgagggttgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcaggtagcgacgttcgacctccgggtccgtcgtgatcttccaataccacaccacggcctggtaggggtgccaacccatgtcgacgacgtcgacccacatcgtatcggcgacgaggatgggggcggaacggtcgccatgggcgcgtagccaggcctctgcggcaagctgggcctggtctcgaggggcgagcaacgtctccgcgtcccgggcggaccaggcgaaacctaacagcagcgtgagtgtggtgacgagcacaccaagggcggttcgagccaggcgtcgccaggagacactctggctgaggagggagtcgaagagcccgccaccgaccagtgcaaccgctgggaacgcctcgactgggtaggtcgaggggagatacccaggacggaaggccatggcagtgtagacgagcgcagcgatcccgaaggggcgcgttcgtcgagcgatgacgccgatgcacgcggccggcaccaggaggacgagaaccgggtcgaggtgaagccacccctggagcaggccccaggcggccgtgccgtggcggaggatgaagccgctgcccgcacgctcgaagacttgccacgctgcgctcccgagcaaactcacgtgaccgggtccggggaggagtgctcccttgagcgtggcgtagagcaggtacaggctcccgatactcccggtgacgaggagaaaggtccacattgcgaccgagcgccgttcatcgcggtagcgccgagcgaggagccagagcacggtgggagtccagaggagggccgtctccacggacaggatcgctgcgccgaacgcgatgccagcgatcacgacggcgtgcaagcggcgccttggatccgagagcgaccagatcgcgacgagaaccagagccatcgcgacgttgtcgagttcgacgaggcgctcgagcgtgatggcaagcggggacaggccccagaggatgacggctatggcggcagcaccagggtgccagcggagcctcttcgccgctccgaccagcgcgccgagcgcgacgagcgaccagatccacatcgcgaagcggagctgggcgacggcgtcgaggccctggggcaggacatgggcaaggagccaccacatgccggcaaggaggatccacgcgagcggtggatgatcgtaccagtacgtgtaaggggcaagccgcccgaggtgcagcagagcccacgcctccgcggcataggtaccctcgtcgagcatcggggtcgggttgtgtgcggcgcccgcgacgtgaacgagagcgacgatggcagcggttccccaggcgagcgtgttgcccgccaccgaccaggtgccccgagccgcggtctgtgtcgaatccggggcttccggaacctcatgcgttcggacgagagtctcaaccacggctacgccacctgctgttcgctcaggacctcgtcaggagttgacaagcgacggtgtgcgccgacatgctccgtctttgcccaaccgcgctcaccgcggagctcgcgcaccagcgctacgagcagggcggtcacgagcacgagctggtaggggatgagaccgaggacgagggagagcgcatctcggatgcgtggccgctcaccgcgtaggcgacgcaagcgagctgcggcgatgacctcgaagctgagggcgccgagctccgcgaagagagataggaaggcgaagaggacgaggtcgacggggagtcgacgtgtcaagccccaggcgagcattgcgaccgggatcagcacgcccgtgagggcttgctggaacggtgccgccaatgtgaagagcgcaagtgcccttctccgccaggggagtttgcgccaagagcccttgcggagcacctggatgaagccctggtcccatcgggtgcgctggcgaacgaaagcgcgcaggctaaggggtgtctcctcctgcgtggcgagtgcctcctcaaagcggactgcgatctgagcgccgcaggtggcgagtcgaattcccatgtcggcatcctcggtgagcgcgttggggtcccagaggccgacctcgtgcagggtatgggagcgaaagacgcacgtgttcccaccgagcggtacgacgccgtggcgggcttgccacggaaggcggctcgagtaccacaggtagtactcgaccgcggatcgggttgcgaaccacgagctggacaggttgacgaggaggacgcctccctgaagcacgtcgagaccgggacgcatggcgaactcggcggctgcaagcgcaaagaagccttctgcgacgtcatcctccgcgtcgacaatggcgatgagctcggcgctccccgccgcctccatcccagtgatgagggctgcaggtttcgatttaggccagtggtggtcgacgacgacctcgatgcgatcggggtgcgccgaggcagcacgttccgcgaccgcatgggtggcctgatcatcgtggccgacgatggcgatgatccgcagcgcgtcgtacggttgtcgcgcgaggcgctcgagggtcgccccgaggaccgtctcctcatggcgggctggtatgagcacagccatcgtcggcagggtcgtcaaactgtcggcgctgatttggaaggatagctgacgtcgaagctgtgggtcttcccacccgaatgctgcaagtgcaacagcggagagcgaggctgttagcacgattacagcgccagtcaggtagagccaatccccgatcgtcattgagaactcctcgatccccaggtcgtccgctgacgtagtgtagagccagctcagaggggatggaactccaggcagatctcgcaacgatgtggcaatgaaagtcgggcactggtgcatgggatgcgcttgtggcctctgcacgtgatccatgaacaactcgaaacagattggtgaacagtcgcaatgattgtcatcaaatcagtcggatcggcgcggcatatggccgtgaaatggtcgctcagagtggtgagttggctgcggaaggtcatgcttccagatgcgcaccgccgcagcgacggcggtgtcgaggttgaacgcatggtgatcccgtgggcagatgcgacgagtgaatccgcatcgatcgacggtccttgcgacctacgagccgtgatgccgttggtatcggcgatccttcgtcgctcgttccgatccgtctgcaccgccgaagtggtcgaaacgccccaactacggatgagaggcgtagcggagttggtgatgaggcatgtggggtcagtccaagtgacgtggggtgaggtctcacctgccacgtggcgtcatcggttcacggagagcattccctgggtcgcggcatcgacagcgctctccgatcggcgacgacccagcgaaggccctgtccgtctgcgcgtcgaggtggtgaggagtgtcacgggttggtcaagggcgaggcatcagctgcacgaacgtggcggcggcgaggatactcctgctaacgcctggctaacgctcgtccaggtgagccgctggcgagcgaggtaggacttgagtcccgaggaccgatcgagggaaggggggctcatgcgcaggtgggcgggtgtgccggtcgtgaagaagctggcaagtatcggagcaggactcgggctggttggcgcaggtctgtcggtgccgttgacccatgcggcgctcgcgggttcgaactcgtcgagtgagacgttctactacaccgggagtcaacagacctttactgtgccgatgggggtcacacagcttgactacaccgtggctggtggggcaggaggagcaggttacgcagcgctcgcaggcgagttaggtggctcgggtggcgacggttcggtcgtcaccggcacgctgacggtgacgcccggagagcagctgatcatcgaagtggggtcttctggtgcgaacgcgagttccaatcagcagagttgtggtggtcccttcagcctctatgtcggaggtgccggcggatcgaacccggattcgagcttcagcggtggctcgggcggcgacggcaattgcgacctcttcaattctggcggtggtggcggcggtggtggagcggcgagcgccatcctcgacagtagtaacgctgcgctcgtcgtcgcagcgggcggcggtggtggtggcggcgctggtgcggccgcgggttacgacggcggcgcgggtggcgccaatgcctctggtggccccggagggggcgacggagcaggtagtgggggccaaatcggtgctgccggcagcagtgctggtgggaccggtggatacgacgacgtagcgggacatgagtccggtggtggcggcggcggtggtggtggcctcgacggcggtgacggcggcagcgcaggacagattggtggtggcggcggtggtggcggcggctccgggagttcgaccacgggtagcggcgtcaccgtgtctgcgaccaacaacggcaacggctacgtgacgctgagttggtccacctctccaccgccccccgcgctgagcgccacgctgagcgccaccagttcgccgagccctgcctatgcaggggacaccgtcagttttgcggttcacgtgtcggggagcgggtcgtcaagcccggtgactggggaagccttcattgaagccccgggcaagaccgatcagacggaattcatccccgttgccgaggtcccgatctccgacggggctggaaccgttcaagagtcggtggatcaggtggcggcggtactcgaggcggagggcgagagcgttccgtacgggacattgaccctgccggtctacttcatcggttcgggggcctggcagggggtcggcgcgacaggttccgtcggtgtcgacctgtccatcgaccccacgaccacgagcctctcgctacagccgtcctcgccggtcgtcggccagccagtgacgctcacggcgacggtgacgaaccagtcccaggccgcacccggccttccgccgaccgggagcgtgaccttctcggcgacggacagcgccggcacgacgacgaaactcggtacggcgtcggtcgacggttcgggccaggccacgctctcgggcctggagctgccagcgggtgcggacaccatcaccgcgagttactcgggggatcccacccacgatgcctcctcgaccacgagctcgatcgatgtctcgaacgcgctggcgctgttcgcctcgagcaccccgtaccctgcgtacttcggcaatgacgtggccgtcaccgccaccgtggccgggggcgggtcgctcggtgcagcgaccggcacggcgtgcatcgagggtccgtccggaggagtgacgcttggctgcttcgtcgtcgaccagggttccgggagcttcacgatcccggtcgaggaagcggcgacgctgctgggtgcgagccgggcctacggtccccgggcgttgcccgttacgttcacgggttcgggcgcctggcaaggtgtcgacctcaccggctctgtgaacgtcgacctctcgctcgaccccacgaccacgaacctctcggtgcagccgtcctcgccggtcgcccgccagccagagacgctcgtggcgacggtgacgaaccagtcccaggccgcacccggccttccgccgaccgggagcgtgaccttctcggcgacggacagcgccggcacgacgacgagacttggcacgtccacgctctcgagctcgggccaggcgatcctcaccggcatcagccttccggctggcgtgcacgtcgtcaccgcgagctactcgggggatcccacccacgatgcctcctcggcgtcgagcacgatcgtggtgacgacaccggtacggctcgacctcgcggcctcaccgacatcgtcgtccttcggttctgcggagacgctcaccgccaccgtgcatggccaggcgcgtgggtccgtcaccttcagtctgatccagggcaggaagaccaagcggctcggcacagcgccggtgacctcgggccatacggcgcagctcgtcacctcgaacctgcccgtcggcaccgacgagatcgtcgctacgtacacgccgtcgagcggctccgacgtcgcgcccgcctatgccgacaccacgttggtggtggtgcaggacgtgcccgcgatcacgatcctcggaccgacgagcgtggcagcggggtcgtccgcgtcgtacaccatcctcgtgacggcgaacgggagcccggtcgacggtgggacgctgctggtccagctgggcgacacatcatccaccgcgaccgtggacgccaacggactggcgaccgtgacactcaccttccccaggaccggcggcacgcaggtcctctctgccatgtacctggggtcaccgacggtggcaatggcgtcgaacaccctctcggtgacggtgacgtccccctccccatcgacgtcggcgcagagttccagcacgccgcccgctggctcgtcgtcgagctcgagtacgaccaccgcgtcgtccaccagcacgagcacgtctccgacgagcccgggaacgaccagctcgacctcgacgcaagcagtgcggccggtgacggcgagttcggcagtgacggtcccgaccgcctcgaccggagaacccttcgcgtccccgtggtggtgggctctctccgggttcggcgtcggaacagggtcgacgctggcagcggtccagatccgtcgccgccgcaacacgcgcgaggccgtgtaagcggcagcagggactcagccggtcgtctcgcggttcggccgtggtggctccagcatccgaccgagagctcagtctggttcgtacagccgaagcctctctatcaaggggttgagggaactcgagggcttcgtcgttgtggctgagcgcgtaacgtcgtgccggagccggcggtctcgcccatgtctcgagcaccggctcccgggtgacgagctcgtgagcggacctgtccggtgtcggagacgcgcactcaccgcggagtcatcgaacgagtcgatgcgcccgaacgtgagcacgtcccgtacgctcgcaccacgctcgccgctggggcggggacggagatcgtcagcccggcctgcgccttcgatgtcgcggcatcctcgagcgctcgcgggccgtgatcgccgagggtccccagtggatctccgagtccgtcgagcatcgggaagctcgtcgaccgagcagtgaccgatcgggccttctagcaggtcaccgacttgctacagtccgtcctgggggtgatgcagggcggcggagggtgcacaggtggcgacttgggtgttcgcagatcggaagcacgggacgcggaccgctgcgcacgacgcacggtgaatgggacagtgttccaccgatgcggcacgacgatgccagcgatccggaggtgaccgtgcgtcagcccatgggggcgtacgggcgcagcgcaacagggcgacggacgggtggtccgcgggtgaaggtgcgtgtcctcggacagccgcgcgtagagaccagtctcggatccatcgcggtcggaggtcagcgggccaagttcctcgtcgggctcgcagccgcaggaggcgtcctcagcgtcgaggaggccgcgacgcttctctggccttccgtacgtccaccgagctggcgcggcgcgctgcgcgtcctcgtccatgagcttcgcgacgcgttctcgcgagttggcgcaccacgggggctcgtgcagcgttccggccccatcttcgtgctcgatactggcgatggtgaggtcgacgtcgacctctggtttgcgagggacgccgcgcgggatggacgtgcggcctgggaggcgggcgacttcgtgacggcacgcgcgcgagctgaggatgtcgagtcgatcctcgccgagggtgtgctgcctgggctcgatgacgaggccgtccgtgacctgcgcggtggcgtcacggcggagcgcatacggaacctcgaggtgctcgcacgcagcgcggcagcactcggcgactgctcgagtgcccttgagactgtcgagggtgcgctcggcctcgaccccaccaaccagcccctgtgccaagtcgggctcatggccgcggagacattgggtgcagtggctcgcgggctcgcgctctacgcccgtctacgcgccgccctcgcatcgggcctcggcgtttctccgagccccgcactcgccgcaagctacgcgcgtctcattgctgcgcaaggtgggcaagcgcgaggcgccgacgagccccactccctgcccgaggccatgaggtcccgtcaccgtgtcgttggtcggacgaccgaactcgctcacctcggcgtgttgtggggcagggtcgagcgcggcgaggggctcgcgtccgtcgtggtcggtcccgcaggcatcggcaagacagccttgctcggcgagctcggtgcggtcgtcgtgagtcgaggaggcagggtgctctacgggcgcgagtcggatccgccttcgcatgagctcgcggcgatcgtcgaggcactgcgcgcctatcagactcgctgtgcgcgggtcggcgtgccttgcaacctcggaccgctcggagcggacctcgaaaccctgctcggaagcggctcggacaacgttcgtctcgcaccgcggagccgacgccttcgactctcgcaggcagttcgcggatggtgggcggcagtcggctctgagcgcccgacgctggtcgtcttggacgatctccactgggcctcggcgacgacgacagccatcctggccgatctcgccgtcgatggcccccctgagggtgttctcgtcgttggcgccgcacgctcgacgggatcggcgctgccaccgagcatcgggtcattggtctcgtggggcgctcggaccatcgaactcggaccactggcgctcgacgccgtcgccgacctcctcggctcgaccggacatgacgccgcacgagtcgctgcggaagtctggctcgcgagcgggggcaatcccgagagagtgtgggaactcgctgagctcgtcgtgaatcccggagcccgaggtcgcagcggtctcgcgcgcctcgacgtcgatcgcctctccccacccgcacgacggatcgtccgagctgcggccgtgctcggtcgcgcaacgcccgcgtccgtcgtgttcgacgttgccgacactgacgatgtcgccgcgctgcaggaggcgcaggctgcgggcgtcctcggcctctcgcaggggggttccgtcgtgctacgacacgacctcctccgtgaggacgtcctcgcgcaggcagggaccgatgagaaggtccgcttgcacgcccgagcggccgaggcgcttgccaagggaggtacgtcgtcgcacaccctcgtccaccacctcgctcgagcggcccccgtagtgtcgcccgagcgactcgccaaggcccgtctctcggcggcgcgcgaagccgccagcctcggcgcgtacgaggatgcactcagtgcactcgacgcttggcgggtggagcggtcggacggtggagccgatgacctggatgccctcgtgctgcgagtggagtgcttgagtgccctcggcgatccacggctccgagacgccgtggtcgagctcttggagcgtgccgtggttctgcgtcggatcgctgcggcagcgacggctgccgagatcgtcaccgcggcgctcatcccgaccctcgtgggtcgagaggatcccgccatcaccacgcggttgcaggccgctctcgagcgagcccgtcgaccggagcacatcgcctccttggcgtctgcgcttgccctgtcgcgggtctggacggcgtcggccagggatcggcgagcgctggcgaggcgtgcggtcgcggccctcgaccgtcgcggcggccagggtgccgacgccctcgcactggcgaccttgacgcgagcgcacctcggcagcctcgaggcagcccacccagcccatcgcctcgccagcgctcgccgcatcctcgcgcttgcgaggtcgactcatgacatcgagggcgttgctcgcggccatctactggcgcacgacgcgctggtggagctcggtcatctcgacgaggccgacctcgaactccaggctgcccggctgtgcgccgcagctctcgacgaccaggtgcgctgggaggtggagatccgtgaggcaggacgtcggctcatggcggggaggcttcgcgatgccgaggcagccgctgagcaggcgctggtcacggtccgggccgagattctccgcgaaggcgctgcggcggtctacggggcccagctgatgatggtgcgcgaggccgagggacggcttggcgagctcgcggacgccgtcgcagagtttcgtcgggtccagcacgagtggacggtgtgggacgctgccgaggcgagaatcgcggtcgcgctcggtgatcaaggccgtgcgcgcgagctcctcgcgcgcggtgtcgccgagctcgaggatcctgtgcgcaccgacatcacgtggctcgcgcgtgccgtgcagtacgcgtgggtcgctggcgacgtccgcgacgtcgagatggcgcagcgcttggtggcactccttgcgccctaccgagggacggtgcactggtcggtgtgcgtcagcctcggtccggtcgacctactcctcgcacggctgttgatgctggccgacccgcgacgtgcctcgacaccgctcgagcgtgcgcgtcggctcctcgccaacgatgggctcgcatactggcgcgcacggcttgccgacctggtgagctgagtcttggcgaggtgctgagcgctgtcggtcgtcctcggcgctggcggggcgttgtctcgtctctgggccttcgctctcctcgcgcggacgctgccccgtgactaccccttggcaggggcgtgtcgcgatgtcgccgagcgcggcgtgatcgtgtcgtccccggggccgaccggtgaccccttgtccttggcgcgaggcctgacgcgcacggtgccgttagtgcgccgttagcgccgacccgcggaactggatcggagacgttgggtgtgagtctcctgcgagcacggtccgggcggtcgcgtgcttgattggcgaagatggtcgcggtgctggaacgtgcgggactggggcagcatcgagggcgtcgattcgtcacgcgtcacccgaggtcgcgacggcggttcgctgtggcgagcctcggctttgtgctcgcggggcttggcaccgcaggcatcgtgtggccggtgacgtggctgcagcacgccgaggcgcgcgggacggtgtcgattcgacgcgtcgtgcggtctgagtgtgacgccgtaccagcgggagcgatcggcgtgttggccatcccttccgtaggcgtcgttgcgccggttgcccaaggactggcccaagcgaccctcgcgtgggcggtcggccatgatccctccacaccgttgccaggtgaactgggcgtctcggtgctggcagctcacgacgtgagctacttcgcgtcgaacgcaacgttgcggaggggggccgccgtgctctacgcacagggttgccggacctacgtctttaccgttgcagatcgcttggttctgcaccctggccaactcattccgccgccaggtccgcgtgggctcgccctcgacagttgttggccgagcgacgcactgttcctgacccctgatcggctcatcgtcacggcgcggttggtggcgatcacccggggcgatcgactcacgctggcgagcacaggcgtgacgccaagcctcccagccggtgtcccccagcccccgaacctcttcgcctcggggtggcttggcgggacgctcaccatcctgggcgcagcgtcagtaaggtggcgagacagtcgtgctcccatggcgtgggaggccgaggcattggccagcttgtcagccgcccgggtgggcctcgcgcaggacgcgcgctggacttccctcgtcgtcgcggccgggaccgtgcgcacggggctccttctggctccgtatacgtccgggacaccagtgagcgtacgtgaggtcgtcctaggggatcgcgttctctccgtcgccgtcacggttaccttgggcggcaacccgctgaccgtgaccgaggttccgagcgcgggcacgctccgcatcgtctcggtcgatcccgtctaaggatccggcccctcgctcggcctcggagacgacgccatcgagtgtcgatggaccaggtccggccacgtggcgggtgtcccgcgacgctacggatgggtcgtgatgtcggtggcgtctgcactgggacggatgggccgtagcgacaggtggccacccgtgcttcggcccagccacgtggtcggacccgcacgaagacgccccttgcgatgcttacgcaacggacgcggcctctcgcggaccgtcgccgctcgtggtccccggtcgtcgagatggcgcggttcgactctgtggaactgccgtggacgccggttccgtcgccgttggcggcgtcgagcggttctggcactcggaatgcgggcggtgcagagtgcaacagcggcctcgagaccggtcgcttcacgatcgtggtcttgaccagcagctggggggtccggcttccgaggacgaaggttgtgctatcggctccggggaggtaccgccgaggcggcgtgcgtccagacggcagaggcgcccgaccacggcttcgcgaaggcgcgcatcgagggacgccgggacggccctcgacgtgggtacccgagaggtggcaacggctggccggtcgtgcagcagccgctgcctccgtctcgttcagcgtgcggcttctcgtgcgggcgtgccttccagtgaggcggcgagggtccgcaccgccgtccgatagcccgactcgatgagcgtcgatgtctgagagaagtcgagggcatcgagggcgttggcggccgggcactccagcacgatcacctcggcacgttctcgtgcccacgcgagctcagtggcgagctgtgctcgcttggtgagcgtgatcgagcgcaccagggcctcgagagggcgctcgtggacagggagcggatcggcgagcgtgcccgtcaggagcacgacgatgcgcgtcgcaccgagatcggcggcccttgcgaccggggtgtcgtggaggacaccaccgtcgacccattcgcgtccatcgtgaacgagtggcggcaggacgccagggatcgcggcactgccgtagagcagggcgacggcgggaccttgacgctcccatcgtgcttcgccggtgcgcgggtcagccaagacgagttccatcggcaccgtggtatcggcgaggtcgacgaccggcacgtgggctgcgataaaggtcatgagcggttcggcggggaagacgctcgcccggcgcgtcgcgtaccggaggagtgtcacgagcttggtcgccgggaacaggcgcgcggctctcagcgactgccagatgctctcgaggcgctcgacactgcgcgacgtcgggtcggctgcaacgatcacgccgttcagggcgccgaccgatgcgccaacgacgagatcgggtctcacccctgcttcgaacaaggctcgtagcatgccgacgtggcatgcgccccttccaccgcctccggcaaagacgaacgccgtgagctcgtgctgctcgtctcgcatgcctgcaacgctagctcaggacgtcggcgtgtctttcgcagtctgtgggcccttggtccgctcgtcgtcgctgccgcagttcgcacacgaggacgcgacgtcgagctcgcggacgaggtccgcgaggagggcaagcagcatctcgcgacgatccggtccccagttctgcagcgcgcgctccagaactgcatggcgccgagcgcggagctcttcgaggacctgcttaccgctcggcgtgaggcgtaccttggcgacacgtgcgtcctcggcgtcagcgaccttctcgatgaggccacgatgcgcgagggccttgagctggcgtgagacggtggagatgtcgaggttgagttgggtggcgaggtcgctgactcggatctcgccgtggtgggcgatggcgacgagctgccagaaaccggctccgatggcgtaggtaaacgtggcatgctcgcccgagctcacgcgaagtcgacgcagtgactgccccagtcggaagagcagttcgtcgagcgtgcgcgaggcatcggagtcgggggatgacgccatcgggtccgagcatacccgtcgcctcgatcgacgctcgggctcggcgcctcatgcagtgttcgcatactttgagggtcgctaggatcgccacgtcttccctcaccagagaaggaggggtcgtgcaccgactcgatgatgaactccggtcgctccaagcgtcgatcgttcgctacgccatggaacgcattgctctccagccaccaccgctcgacgggccgaagagcgccgacgaactgcgcgcgctctacggcgcgaacgtcaccgaggacggtatcggcggcgaagaggccttgcgccgcttcgtcgagggctacgcgccggccaccctcagctcggatcaccctcggttcttggcgttcgtcccggtcgctccgaccaaggcagcggtgctcttcgacatgatcgtctcggcctcgagcatctccgggacctcgtggctcgagggcgctggcgcggtgtacctcgagaacgaggcgctgcgctggctcgccgacctcatcgggttccccgagacggctggtgggacgttcctgtcgggaggttcgctcgcgaacctttccggtcttcacgcagcgcgtcaggcggccaaggagcgcctcggcggtgtgcggcccgatcgctaccgcattcttgcctcgaccgaggcgcactcgtcgattcgcacggcagctgacgtcatggatctcgaggtcgtcgaggtcgaggtcaacgatccgggacggttgcgcggtgaggacctcgtacggacgtgggcaaagctgaccgatgccgagcgcaactcggtggtcgctgtcgtggcaacggccggcacgacgaacgcgggcctcgtcgatgcacttgacgaggtcgccgactttgccgaggtcaacgggctctggatgcacgtcgacgctgcctacggtggtgctgcgctcgcgtcccatcttcgcgagcgctttcgtggcatcgaacgtgcaggctccgtcgtgatcgacccgcacaagtggctgttcgctccgttcgatgctgcggccatcgtctaccgtgacccgaacgttgctcggcgggccctgacgcaagaggccgcctacctcgacgagatcaatcgtgcgcccgactggaacccgtcgagctacggctatcacctctcgcggcgagttcgaggtctgccattctggttctcgctcgcgacgcacggcacgcgccgttatcgcgaggccatcgaagcgtcgatcacgcttgcccacgagagcgcccacgagatcgagcgacgtccctacctcgagctcgcgatcgagcccgaactgagcgtcgtggtgtttcgacgcctgggatgggatgccgaagcgtacgagcgatggtcgcggcaggcgctggtcgacggggtgggcttcgtcctccccacggcctatcgaggggagaagctgttgcgcttctgcttcgtcaatccactgaccaccctcgacgacgtacgggccatcctcgacacgctcgcgatcgaccctcggccctggtgagagccgtgagctgtccgttgtgcggcgcggcggcgagtgcgctccgccgttcgaccctcgccgcggtcgtcgcggatcgctatccggtcgcagcgggccacctcttggtgctgccgctgcgtcactgtggccggctcgtcgatctcgacgacgaggagcgagcggatctctgggcgttggtgcacgacacgctcgatgctccaccgccggtcgttggtgaggcagatggctggaccgtcggtgtgaatgatggagcggcggcaggccaggtcatcgatcacgtccatgtccacctcattccgaggcgagctggcgacgtcagcgacccgcgcggtggcgtgcgctgggtccttggggcgaaggcgccgtggtgggacgacgtcggagtcgacgacgcctcgcgtcaccgttgacgtcggcgagctgccagggcgagctgtcagcgatatcagggaggggccgcggctcatgcggacccgagtcgccggctcgacgatcggccccgacaccagcagcggagcccccatccccgctgctggtgcgtgcgccgcgacccatcggcagcggcgcgtggccccccaaaggctgcctaggcgatgcccttgagcatcccgtgccagtagagcgcgggcagtccgtagcgcttgagcaaccacattgagtagtgctccttcgtcgtgtcgatcagcggcacggtcgggtgcggattgccggtgtagtcgaactcggcgagcagcatgcggttgcgagcggtcacgagcgggcacgacccgtaaccgtcgtagtgcgcttcgggtgtgcgccctgccatcactgcctttaggttcgcgaccacgacgggtgcctgcttgcgtacggcggcaccggtcttggcgttgggcgtgttgccggcgtcgccgagggcgaacacgttgggatagcgcacgtgctgcagcgtctccttgttgacctcgacgcagccgcctggcgtcccgtcggacagaggcgtcgccttcaaccagtcaggagcgctctgcggcggtacggcatggaggaagtcgtaggagatggtctccttggtgccctccttgttgtcggagatgacgacctcgcgcttggtgccgtcgatctccaccatctccgattggaaccgaacatcgatgccgtagcgcgcaacgaccttctcgagctccttcgcccacaccggcacgccgaacatcgtcggtccagggagcacgaggatgacgtggatcttgtcgagcacgccctcgatccgccagtagtccgccgcgaggtaggcaatcttctgaggcgcgccggcacacttgatcggtcccgagggcatggtgaagaccgccgtgcccgagcgggtccgctggatgaagtcccaggtgcgtggcgcgagatcgaacgtgtagttgctcgagaccccgtcgtggcctaccgcctcggtgagtccgggcactcgatcccaattgagctgaatacccgggcacacgaccaggtagtcgtagtggacgggaatgtcgctctcggtgctcacgacctggttctccggatcgatggtgaccacccggtcacggatccacttcacgccacgcggcatgaccgaggcctcggagcgcacggtctcactcgccttggcgagccctccccccacgacggtccacagtggctggtagtagtgattctccgatggctcgatgatcgcgacgtcggtctcgcctgctcgtcggaggcgtgccgccaccgtgatgcccgcggaacctccgccgatgatgaccaccttgtggtggagccccttcgcttcggccatgtcccctcctcgacctcatgaaggttgtgctgataccgacaagggtacaccactgagggaccttagttgaatttggttcgggactttcgtcccttgttcacgtcgattcaggtctgcggtcggctcggagcctggtgacgtagcgcgacgggcagtcgtccatgacgacgatgagaccgccctcgcgcgcgatggcggcagcctcgtccgagacgatcccgagctggagccacagtgctcgagcgccgacaccgacggcggcgcgagccaccgcggggcacgcctccgggcggcggaagacgtcgacgaggtcgatcgagtgctccgcggcagcagcctcgagcgtggggtaggcgggcaggtcgtgcaccatggtttcgcgagggttcaccggcagcacctcgtagccgaggtcgaggagctccgccatgacgtggtgggaagcccgccacgggttcgaggacgctccgaccatggcgatggtgtggaccgagcggaggacgtcgatgggctgctcggcgccgatcacgatcatcagtactctcccctcacgacgttgagcaggggaagtccggccatgtagcggcggacgttgcgctcgacgagcgccgacgcgcgcgtctcgaggccggcgacgtctcctccgacgtgcggggtgagcacgacgttcggtaggtgccacagcggatggaaaggcggcagcggttcggggtcggtgacgtcgagaccggcccggagccgaccgctcgcgagctcggcgaccaacgcttctgtgtcgacgactgggcctcgggcgacgttaacgacgaccgcgccgtcggggagcctggcaaggagtgctgcgtcgatgaggtgcctggttgcatcggtgaggggaaccacgacgacgatgccggcgagcgtgggaagaatcggggcaaattcgtcgaaggcgaggacgtcagggttgaaccggggtgtacgagccactcggacgatctcgacgccgaacggcgcgaggcgagcctcgatggcgcggccaatcgcgccgtagccgatgatggcgacgcgcgcacccgcgaggcttggcatgacacgacgctcccaccgcccctcgtgttgggccagggcgaactcggacaagccacgcgtcgcggcgaggaggagcgccaccgccaactctgcagtcgcgtcatcgtgcacgccgcgggcattgcagagcgtgacgccttcgccgatctgcccgacgacacgatccacgccagctgtcaggagttggaggacttcgaggtgacgcatacgcgggagcggctcgagggcggcgccgccggcagcgtaggccggcacgaagaaggtcgtcatggccaatcgatcatcgatcgggtcccctggatcccacgtcacgatcggtgcgtctgggatgcgtgtgatcagttcggtgagggctgtcgggaccacgatctgcatgaatcggagcctaggccctcacctccacagaaggtcagctgatgggcgtggctgaacggggacgtggcaactcgccacgtcgtgctgctggggacgtcgtcggtgcgtgcagcgtgagccggctgcccactcccgcttcgcctccgcgacgacgatccgcgtgtcgcccacacctggttcggcttgaccgctccgtcgcgtcgttctcagctctcggcgcccacgcacgctgctggccttctccctccaggttgacacctgcgatcgggggaatggatgggccagcattggaaggccagcattggaaggccagcattggaagaggacgacgcccttcgccactctgggcagactcgtggtcgatcgggaacggcccttgttcgtacccacggacgacgggccgcagttcgcgaagcggtacctctgacctgggagctggcggggatggcgtgtggtggttcgctgatgctggtctgtacggctctcaggatgtgactctcaggatgtgaactgagtccgcctcgcgctggcgatcatcgcccagatgaacctctcggtccctggtcatcacgcagcagcgatgagccgcggttcgcagcgccgagccgtcgagcagcgcggcctcgggcgtcttggtgcccgaggccgtccctgcgacgcggccgctcagtcgccgagctctctcgggatcgcggtctggaagctgcggaacagctgcgtgaggtccgcgtagccgaggcccgatcccggattgaacacggcgccttgtgagccggtgtagaagtcgttcgtgttggtgaactcaccggagatcgcaagctgggcgttgccgatctggccgctgtagtaggccgagccgtcgatggtgttcgaatcgagcggcgtgaacggcgacgacgtcgaggtcgcgaagcggtagatgttcggattccagaagccgagccgtacgcccccgagggcgctctcgtagacggcgtcggtcccgttgagctgaggcgcgatgaagctcgtgccaccgaagtccaccagctttgacccgtagacgctctggaactgtgggtcgtagaccgcatagccggtctgggggtcggcgttgaacgccaggtccggcgtgacgcggccaccgctcatgcccgtctgaagcgtcggggcagggttgaacgagaactgcgtcggctcgacgaggcctggtgcgacctgctgtggatcgatcggcgtcaagaactcataggccgagtagctccctgcccccaccatctgaccctgttggtagagcggacggccgaagagggtggagtagccaccgcctgatcccaccggcaagctcgtggctgcttgggcctcgttctggaagccgagtgcgatgtacatcggccacaggtagtcccagccccaggtcatctgctgcgggatggtcaccgactcggtgccgacttgggtcccgttcgccatgatcgggtaggtctgagtacccgggagcgtcgtgccgccagcggcggtgtcgtagggggagtcggaggggttgtcgataccgaggttggtggtaccgatatcgccttgagggtcataggcgccgttgtcgccgctcgcgatgaagttcgactgtccctgcgccgccatctcgaggaaggcctggttgaacgaggccgcataccccggtgactcctgcgctgcgtccaccgcagcttggatcgcggtctcggactcaccccagctcgacgagacggagccggcgacgttctggctggccgcctcgtagaaggcgtcgacgaagccgtagtcggtgttgggcgcctggtacacgacgatcttggccatcggcgcgatcgtgcccgactgctcgacgtcgagggtggtctcgtcggagccagcgttcagcgacaccggccctgcaccgccgtcgacgttgacgagcgcaagacgattcggcaacgtcacgacgtgcgcgatgttcctccagaagtacatcggcaccgaagggttcacgctcgccaaggtcacgatgccgatggtctgcccctgaccgaggtagcccgcttgctggagcggtgtgaggttgtagtcgctcgtgaaggcctgcggcagctgatcggtgggtgctgcggtttgcgacgacccagccgtgggtgcgacctggttgatgccgggcaccgcgagcgactcgtagggcgcgtagttcgacaacccgagcacggccagaatgttcgacgccaggttcaacggcatctgcggcgcgctgcgcgtcccgtagaccgtctgggtcgtcgcgggcgcactggctgcgggcctggtggtgacggtgaagttctcgagcaagatcccaagggccttgtcgtactgtgcggccgtgccctgcgaggtgacatcgaggccatcgctcatggcctgggagctgatgccgaactcacggaggaacccacgcagcgcgaggatgtactcttcggtctggccgtactcgagcgcgaactcatggggcgtcaggtacggaccacgccaaccagcagccacccgagaggcaagctgtccctggttgcgcatcttcaggatgaacgacacccgcatcatcgtcgacccagccgtggtgcccgtcggggtggcgtgcgagagcacatcggcaccgatgccctgcgacaccggcaccagcggatcagacgccgacgcgagcgactgcgcgcctggcatcgccagtgcagcgccgacgaggccgatggatcccaaggtaccgagcatctgcagacgacgactgatacgcctcatagcccaacccccctcatacctgagcgcagcccacacccatgcaggacctgcatcagcgcgacactagcacgcgaagtatgccgcatcgttgtcgagacggtccgtctttcggttggctcgactaccgagcgtgctggtccgtcgcggcggatgcgtcgtgggttcggtcgtgacgtgctcagtgcatcaggagacgcggctcggcgtcgacaccgagtgtgaggtgccagaaggagtcctgcgatccttccgccttgagttcttctgccgcgagtgcaaggcgcttcatcggggagcgcgccgtgtgatcgtgtgggagcagggttacgaggtagccgtcgcgacggaagtgtcgagccatccgcaacgcctcggcaatctgagtcgtcgggtcgaagatgagggtgaggcggcgtcgcggcgtggcgaggtggatgccgagctcttcgagcagggagagaatgcgctcgaacccaagcgagataccgcaggccggctcgtcgactccgaagcgtgcgaggagtccgtcgtagcgcccgccgccgccgatcgacgacgaccagtgagggtgaacgatctcgaacaccgacgaggagtagtagtccagccctcgaacgatgagcgggtcgatgacgacctccgtgtcccggaccgaggtccgcacgtgcgtcgcgatcgcgtggaggctctcgagcacgcttgcatcgacatcgagggtctcgaggacatcgaggggatgctcgttctcgacgatgtcaccgagcgttgcgaggacgtggtcggcgagctcctcgccgagcccagccccgaccatctcgttacgcacagcgatcggcggctccttgtcgagcttgtcgagcgcgacgagcacactgcgccaatgatctgccggcacctcgagacgctccaggacatgctcgacggcccgtcgatcgttcacgtgcagctcgaagccctcgaggccgagctggtgcaaggccgccgtggcggcgatcagcagctcgacctcggcgagccagctcgcctcgccgaggatgtctgcgtccgcctgcacgaactggcggagtcggccgcgctgcggacgctcggcccgaaaggcggggccgatctgcatcgcaagaaagggcttgggcagcttcgactggttcacggcgtagaagcgagcgagcggcaccgtgaggtcgaatcgcaggcccgcatcgacgaggtcgtcggggctcgaggcggacccgaggtcgagacgctcgccgcgcttgagcaccttgaacatcagcttcgcattctcgcccgccccggaggcagccagtgcttcgagggtttcgacgatcggggtctcgatctcgaggaagccgtgcgaccggtacgtcgagcggatcacagacgctgcggcagagcggacctcgtgctccccggggaggatgtcgcgcattcctcgaaacggacgcacctggagcattggactcctctctgactcgggcgccgatgtgctgtcatcaggcagtgtcatcctacgcctcgatcgggcccgaaccgtggcccttgggaagggatgcgctctcaccggtgttgtccggacaaaggaggggagccatgcgcaagtccttgcacgtccgttccgtggttaccgtcggggtcttggcgagccttggtgtcgtactggccgcctgtgggtcgacgtcgtcgacgtctacctcggcgaagacgtcgtccagctctgcgaccgtcgccacgtcgtcctcgagctacggcaccatcgtgacctcgggttcgggagtcacgtactacgtgttctcggcagactcacacgatcattcggcgtgcacgggttcgtgtgccgctgcgtggcatccggtgctcgcgacgcaccccacggtcggtggctcggcccaggcatcgctcgtgagcacgttcgtgcgcccaggcggagagcatcaggtcgcctatgacggccaccctctctacaccttcgtcgacgactcgggcccccacgtcatcagcggccaaggcatcaactcgttcgggggttcctggcacgtgatcgccccgagcgggaccccgatcaccgctgcgtcgagctcgtcgagttcgtcctcgagcggctatagcagtggctactagacggcgtccgcaccacgaccacgacgcccggtggctctaggctgcgagcgcacggcaccatgagcgtgccctgtgcctgatcgacgaacgaggaggccctggtgcgcagcgcttcgccacggcacgacagtcatatgatcgccctggcgcgaggtgacgggaacgtcgacctcgtcatcaacggtgcggaggtcttcagtcctctgacgcgaacctgggtctcgacgtcgctcgcgatcgccgacggggtggtggtcggatggggcgagcggccgaccaaggagcggctggacctcgcgggcatgatcatcgtgcccggattcatcgatgcccacgtccacatcgaatcgacgaagctgtggatcgaccgcttcgtcgaagcgaccgtacctatggggacggtcgcggtcgcgagcgatccacacgagatggccaacgtaaaggggctcgagggtgtgcgtgcgatgatcgcagccgcccatgatctccccatcaccatcggagtctgtgggtcgtcgtgtgtgccagcgtcgcgattcgagagtccgggggcgacgttcgaggtggaagcgatcgccgaggtgctcgccgagaccgacgcgctcggtgtggccgaggtcatggacttcccaggcgtgatcgctggcgacgagaccttgctcgccaagatcgcgctcgctggttcgcgtcgcgtcgacggccacgctccaggactgcgcggttcggatctcgatgcgtacctcgtcgctggcgtggaatccgatcacgagatggtcagtctcgaggaggtcgacgagaagcgtcacaagggcatgtgggtcttcctccggcacggatcggcaagccacaacctcgctgcgttcgccccgtcggtgcgagcctacggaacgaccaacgttgcgctttgctccgatgaccgggagccggatctccttctcgagcgcggtcacgtgaacgacctcgtcaggatcgccctggaggcgggcatcagcctcgaagacgcactcgtgctggcgacgttgaaccctgccacctaccacggtctcacccatctcggccatctggggcccggccgtcaggccgacttcgtggtgtatcgatcgcgcgccgagctcgaggcgggacggcctcccgccatggtgttccaccgtggtcggctggtcgccgaagatgggcggctcgtcgtcgagctcccccgtcgcgaggtgcccgagaccctcctcgccaccgtgcgtcttgctcgagcgctcgtcgagggggactttacgaccccgatccccgagcgcgttcgagtgatcgtcgccaacgaccactcgctctggaccaaccagcgcgtcacgactcgtgacgagctcaccgggatcaatcggctcgcggtcgtcgagcgacaccacgcgaccgggcgcatcggccatggtctcgtcgagggtttcggcctcgagcgcggtgccatcgcgtccaccgttgcccacgacgctcacaacctgatggtggtcggtgcgctcggagccgaggccgacatggcgaccgcagccaatcgcgtcgctgcgctcggcggcgggcaggtggtcgtcgtcgatggccaggtgatcgcagaggtgcccctcccgatcgccgggctcatgagtgatgcgccgattgccgagacggcgcgcgcggtcgtcgaggcgacgcaggccgcccatgcgctcggatcgacgctggaggcgcccttcatgacgctcgcgttcttgggtctgtcggtcatccccgagctcaagctcactgaccagggactcgtcgacgtcggagcgtgggacgtcgtgagtctcgaggcctgacaagccaccgctcaccccggccggtacgctaggagcaaggccaaggaggtcacccgatgcgtgatgccgtcatcgtcgatgtggttcgaaccccagtcggtcgtcgtaatggtgcgctctcgggctggcacgcggtcgacctcgcctcgacggttctcgaagcgctcgtcgcacgaacgggcatcgacccggcgctcgtcgaggacgtcatcatgggctgcgtctcccaggtcggagagcagggcatcaacgtcgccagaaatgccgtcctcgccgcgggttttcccgagtccgtccccggcacgacggtcgatcggcagtgcggctcgtcacagcaggcggtcgcgttcgccgcacaaggcgtgctcgccggtgcctacgacgtcgtgatcgccgccggtgtcgagtcgatgtcgcgggtgccgatgggctcgaacggggtgggccctgggtcgccattcgggccccgtgtcgaggcgcgctacgcagcgcgtggaggtctcgtgcctcaggggatctcggctgaactgatcgtcgaacgctgggggttgacgcgccaggagctcgatgcgttcgcgcttcgatcccacgagcgtgcttggacggcgacgacggaagggcgtttcaagtcggagatcctgcccatcgaggggcgtcgtgccgacggtgcagccgccccgaccgtgctcgaggcagacgagggcatccggcccgacacctccctcgaggcgctcgggagtctgaagcccgcgttcgtgcccacagggacggtaacagcgggcaacgcctcgcagatctccgatggcgccgccgctgctctcatcatggacgccgaacgggcgcgtcgccttggcctcgtcccccgcgcgcgggtcgttgccttctcactggcggccgacgatccgatcatgatgctcaccgcacccattccagcgacccgtcgtgtgctcgaacgcgcccatctcagcctcgatgacatcgacctcgtcgagatcaacgaggccttcgcatcggtcgtgttggcgtggggtgctgagctgcatcccgactgggatcgcgtcaacgtcaacggtggggcgatcgcgcttggccatccgctcggggcgtctggggcacgcctgttggcgaccttggtgaacgagctcgagcgccgtggcgggcgttacggcctccagaccatgtgtgagggcggcggcatggcgaacgcgctcgtgatcgagcgcctcgggtagatgagcgccccacgcgtcctcatcgtcgacaacgtcgactcgttcgtccataatctctatcagtacgtcggcgagctcggcgcagatccagtcgtggttcgtgacctcgagattcgagatcgtgtcgatccgcgcagtttcgacgcgatcatcatctcccccgggccggggcatcccagggcgtgcgtcggaggacggtggatcctcgaggatgcagctcgcgaggtgccgacactgggtgtgtgtctcggccatcagctcatcggtctcgtcttcggtgcaaccgtgacccacgcaccacgcatcgtgcatggtgagacctccagcgttcgccacgacggtcgaggcgtctttgcggggctgccgaatcccctcgtggcaacccgctaccattcgcttgcgatcgacccgacctcggttccggacgagctcgtcgtgacgagctggagcgaggacgacgtgatcatgggggtgcggcaccgatcgttcccgatcgagggcatccagttccatcccgagtcctacgccaccgacctcggccaccagctgatcgggcgattcctgggtctcgaggtgcctgcccgcactcgctgatccttgtgcgggcgtcgttcgctcggatggccaagccggcgcgccaccggagctgctcagggtggcgaccttcgccgtggtggcacttggcacgaggaaggcgggcatgcacgtccgctgcggtggcgttgacaccgacccgggcgccgcgctcgtctggtggcgctggccgtgcgacggcacgggctcagcgccgagtcggatcagccggctgacggggttggccccccgctggcaggaccgcccgaagcggtcgtcgtccacgtgatggtcacgctggacccaaccggtgcctgggtccctgcggccggcgacgtcgactcgaccaccgcggcagccggagggttcggctgcgagagtgtgtaggtgaagccagcgttggtcaggtcttgctctgcggtggcgaccggatcgccgacgacgttcggtaccgtcgcctcgttgccctgcgacaccaccaacgcaacactcgatcccggcgccaccttcgtccccggagcggggctcgtcgagatgacgtcaccattcggcacgctcgagcttgcctggtacgtcaccgtaccaacagccaattggtcggccccgagcttgttggacgccgatgcgagcgagagaccgacgacgttcggcaccgcgatcgagctcggaccgttggagacggtgaggacgacggtcgaaccgtgcggggcggacgtcccgccagtcggcgactcggcgaccacggtgccctgcggcgcgctcgctgcctgatagttggtggagacgttgaagcccaacgcgagcagcttcgcctcggctgtcgatgcggtctcaccgacgaccttcggtaccgtcaccgccgccggtccgctcgagaccacgagatcgacggtggagcccttctgaaccttggtgccagcccgtggcgattcggcgatgacggtacccgaggaggccgaggccgcccggaacgacagtgcactttggaggccaaggttggagaggacctgcgctgcgccctgctcctgggagccgacgacgttcgggacggcgacgcgagggagcggcgctgcgacgtgatggttcgagccggcgagcttcgcgtacagaaggcctcctgcgagtgcgagcagcaccacgatgacgagtaggatccatggccagcgccgccgccgacgagctgtctcgaccggcggcgtcaccgccgggatcgatgccgtgtcctcgacacgactgagcaactgggtccgatcgccaacgccctcgaccgctccgatcgccatcgtgcgctcgccgagcgcggtctgggtggtcgtcgtgcgcaggggacggtgctcgagcacccgctgcagatcgacacgcagtgccgtcgcgtcggggtagcgctggtcgcgctgcttggcgaggcagcgcatgaccacggtctcgagttcggcactcacccgagggttcacgttccggagcggggtgggcgcctcggtgacgtgcttgtaggcgacggcgatcggtgtctcaccgaggaagggtggcgtcccggtgagcatctcgtagaggacgatcccgagggagtagatgtcgctgcgtccatcgagatcctcgccacgggcctgctccggcgagatgtaggtcgcggtcccgaggaccgagccggtctgggtcaggtcctcgtcgttggcgaccgcacgtgcgatgccgaagtcggccaccttcacgatgccgtcctcggtgatgagcacgttggagggcttgatgtcgcggtggacgaccccgtggcgatgggcgaaggcgagtgcgagcgcgacgtcggcgccgatcgaggctgcttgatcgggggggaccaccccgaccgtgcggatgagctgcgccagcgtctgaccgctcacgagctccatcgcgatgaagtaggtgccgttcgcggggccccagtcgtagaccgacacgatgttcgggtgcgacagcgccgctgccgactgcgcctcacgccggaatcgctcgacgaacgtcgggttcgtcgacagctccgcgaagagcaccttcagcgccacgaggcggtcgagcaggaggtctcgcgcttcgtagacgtcggccatgccccctcgggcgatcttcgcgatgggctggtagcgcgtcccgaagacttggagctggacctcttcggtcatgtctgcctgccttcattcatcacagaggcacgctcggagcgcgcatctcccgtcatgacgacctcttccgcttagcgtgcgccgtggcggttggtgctggcgctcgcgcgatcaccaatgtcacagctgatccaggggcgacctcggtgcccgcggccgggcgcgatgcgagcacgtcaccgctcggcacggtggtgctcgtttggtaggacaccgtcccgaggacgagttggtgggttccgaggaggttcgaggcggccgcgacggagaggccttggagggtcggtacgaccacgcgaggtggtccggaagagacgatgaggttgacgcgagatcgtatcgcaacggtggtgtcggcggtggggctggtcgcgatgacctcgccgggtggcacggtggtgctggcctcggtcgtcacggtcccgaggacgagttggtcggcaccgaggtcgttggaggctgctgcctctgacatcccacgaaggcgcgggaccgcgacgaccgcgacggccgtgaggcggcttgcgatcactccgatcgcgacgccgagcccgagcaccacgaccagcacgatcgcgagccacggccatcggcgcgaccgtcggggcggcgttgtggaggctggcgagctcagcaactgcgtccgatcgccaacgccctcgaccgctccgatcgccatcgtgcgctcgccgagcgcggtctgggtggtcgtcgtgcgcaggggacggtgctcgagcacccgctgcagatcgacacgcagtgccgtcgcgtcggggtagcgctggtcgcgctgcttggcgaggcagcgcatgaccacggtctcgagctcggcactcacccgagggttcacgttccggagcggggtcggcgcctcggtgacgtgcttgtaggcgacggcgatcggtgtctcaccgaggaagggtggcgtcccggtgagcatctcgtagaggacgatcccgagggagtagatgtcgctgcgtccatcgagatcctcgccacgggcctgctccggcgagatgtaggtcgcggtcccgaggaccgagccggtctgggtcaggtcctcgtcgttggcgaccgcgcgcgcgatgccgaagtcggccaccttcacgatgccgtcctcggtgatgagcacgttggagggcttgatgtcgcggtggacgaccccgtggcgatgggcgaaggccaatgcgagcgcgacgtcggcgccgatcgaggctgcctgctcgggagggacgaccccgaccgtgcggatgagctgcgccagcgtctggccgctcacgagctccatcgcgatgaagtaggtgccgttcgcggggccccagtcgtagaccgacacgatgttcgggtgcgacagcgccgctgccgactgcgcctcacgccggaatcgctcgacgaacgtcgggttcgtcgacagctccgcgaagagcaccttgagcgctacgaggcggtcgagcaggagatctcgcgcctcgtagacgtcggccatgccccctcgggcgatcttcgcgatgggctggtagcgcgtcccgaagacgtggagctggccgtcgcgtcgagttcggcgtcctcggtccctgcgaccgagcgagaggggggcggtcgactcgtcggtcatccctgccctcccgtgataccgagcgcagcttccagcatcgccttgacgaccgggcccgcatactgagcccccgtcgggttcgcggacagcccaggctgcttgggtacgacgacagcgacgacgacgcgcgggttctcggccggagcgaaggcaaccatccagttgtccgatgcaccaaggaccgaggagtgactcgtcaacgtggtctgggccgtaccggtcttcgcagcgatctggacacctgggatctggatgccgaccgccgtcccgtagcggacgacgtcgatcatcagctgtgtgacctgtgcggccgtggacggactggtggcgaccctccaaacgtgcgggtggtaggccgtgacgaccgcgtcttgaggattgaggacacggttgaggacgtgcggggtcatgatggcgccgtggttggcgataccggctccgaccagcgccatctgcaagagggtcgcggtgacgttgccttggccgatcgcgctgaaggcgagctgggggagattctgcttgaagaacgatgcaggtgggaaggtcgacgcagccgctccgggcaggtcgatcggaggaacctgattgaatccgaaggccgtggcctcctcgctgagcgcggtcgcgccgagcttgaggccgagctgcgcaaaggcggtgtcacacgacacagggagcgtctgggtgagcgtaccgccacaggactcgtaggcgtaattgtggagttcgtgcgtggtctcaggcaaggggatctgcgacactgcagggaagttgatcagggcgagtttcgggtcgtggtcgaagattgccgaggtcgtcaccatcttgaaggtggacccaggcggataggcgcgcgaaatcgcccgatccaggagcggatcacccggattggcgagatcggccttccaggccgcgatctcggtcgtcgtcgactgtgccgcgagcggcgcaggatcgtaggtggggttcgatgcaagggcgaggatcgcaccggttcggggatcgagcgcgatgaccgctcccttgagtgacccgagcgcctggtacgccgtgcgctggaggcgcgagttgatggtggtgacgaccgagtcggtctgctcgctcgacccgaggagctgcgagatcgagtcgggtaccaccacgtgcgggacgaggtagcggttgagctcgtactcgaggcctgacaggccgtagatgagcgagaagtagccggtgatgtcgccgtagagtgatccggccgggtaggtgcgctggtagctgttgccaccgggaagcggcacggactcggccatgacctggccatcggcggtgaggatcggccctcggttctccgagaagatgcgctgcatgcccgcggtgttaccgggcgcgtcggcgagcttggacgcctggaccacctggaggttgttgagctgcacgaagaccaaggcaaaggcgagcagcagtacgagcgtgacgatcccgatgcgcctacgcatgcagcacctccaccacgccgaacgcggcaagggatgcgtgctgctgcgcggcctcgcgtgtcaagttggcgacgagcgtccttgccgcagccagcgatccctcttggacgccgtggccgagctgcaggcggagcgctggcgtgagcgcgcgctgctggagggatgtcgtctcgacgacccgcgggtggaaccagaggatccctccgatgcgtccccgctcgatcacgacgtgacctgcgacgatggtcacgatgtaggagtggtcgttgtagagcgcgaccacacccaccaccaccgccgctaccgcgccgagtgccacaatgagggccgcgagtcggagcgccgaacgtatccaggtcggacgttcggtcatctgggagggaagaggacgggggagcttggttgcgagggatgggtccttcggtgccgacgacgatcgcctcgtccggcccgacgcagcgcgggaagcctcggacacgaccgaggtcgacgctgtgtccgcggggcgggcgtgcgagagctcggacgtcgcgccgagtgcgctcgaggctcccgccggcacaccgtcttcgtgcgcgctgacgacgatcaccgagacgttgtcggagccgccgtgctcgagcgccgcctcgaccaacgccgagacggcgtgctccgggtcatcgttactgagcaggtgcgcgatctcggtctcggtgacctcgttgacgagcccgtcggaacagagcagcagcgtgtctcccggtccgagcgtgagctcgaagtggtcgggttcgaccccttccaccacgccgagcaccttcgtgaggacgtgacgcgcctggtggtgctgagcttgctggcttgtgatcgtcccggcatcgaccagttcctggacgaacgtgtgatcgttcgtgatctgacggagttcgcccgcgcgcaacaggtacgcgcgtgagtcgccgacgttggcgagatcgcagcgcccgtcggggtcgacgatcgcgagggttgcagtggtgcccatccccgcgagctcgggttcgtcctgggagcgctcgaagatcgcgacgttggcggctcgcagcgcgtcgactgcgctcgctccagcggcgacggcgtcggcgatggcccggatcgcgatggacgaggccacctcacctccgacgtggccacccatgccgtcggcgacgacgaaggaccggccgtcggcggcgacggcgtcttggttggacgaacggacgcggccagtatggctggcggctgcccaacgcaactgcatcacccgaccacccgaaaggcgctctggccaacctggagcacgtcgcctcgcgtcacgcgcatcgagccttcgacccgctcgccgttgacgaacgtcccgttcgtggacccgagatctcggacgatgatccgccgtccctccttgaccacctcggcgtggtggcccgagacgaagcggtcgtcggcgagcgtgaggtcgcaggatgcatcacggccgatcgtcgcgggggtggcgagttccagtcgacgtccctccagcggccccgccaccgcgagcacgacgagcgccccggtcttcggaccgccgctcggggtgactcgagctgcggtctggtgggcctctgcctgggcgcccgagcccgccgaggcgaccactggccgagcattcacgctggccggggtgcgctgggctcgacgcgtctcgcgccagacggcgcgcagtgcgaacgcaaagaagatccagatcaccacgatcagggcgtacttcaggatggtcaggaggacgacgctcatggaatcagccgcgctccactcggacttcgaccgcaccgagacggaggacgtcgccggcctggagttcggtcggtcgagcgactcgctccccgttcacgaacgtcccgttggtcgagccgaggtcggtcaccgtcgcggtgccttcggcgatcgtgacctcggcgtgtcgacgagagacgcggttatcgtcgatgcggacgtcggcaccgctctggcgcccgatgatgtaggacccaggtccgagctcgacgggtgcgccgtcgggcaggatgaacctccaccggttgcggtaggtggcgtcttcgacgaaggccgtgtcgatgtagaaggtgccggccttgagctgggggtcggcgtcgatggtcagcgcgatcggccccaggagctcgaagccgttgtcgtcgaccgtctcgcgcgcgagctcagcgagttcctcctccacgcgagctcgcaacggcccgagctcttcgaggtcagagggtgcgagcgcgacgacgatgcggttgggagcgatctcagagcgaaccccgatccgcacgtcacgctcgatctcgcgcaccaagcgtcgcccgatctctgccggttcgatcccacgcggcgcgcccttcgagaaaatcgactcgaccgcgctcgcgatgcgacgctcaaactgttcgagtgccaccccacctgcactataccgagcccacccgcgtacccacttaggaatccccagggagctggcgcgcctgcacacgcgcgtgagctccctcgctaagctcttggcgctcccgggcgagtggcggaattggtagacgcgcaggattcaggttcctgtgagggcaacctcgtgggggttcaagtcccccctcgcccaccgcatcggctctctggcatgggcgtcggtcgacggattgggcatcgccgcggtcgcgcgtgtgcgaagctgaaagcaacccgaggagggcggcatcggaactgtcacgctcgcagccctggtggtggcgacgtccttcgtcggggagctgcccgacaagacgatgatcgcggcggtgatcctcggccggcgtcaccacccgacgaaggtcgtcggcgcggccgtgctcggtctcggcgcccaggccgcgatcgccgtgaccctcgcaaccgtggcccgacgcctgctcaaggcctcggtggtccatcaggtctccggtgcgatcttgctcgtggttgcggccgtgctcgtgtgggtggcgcttcgggccaaggaggacgctggcgacaccatcacgccgaaccgccccttctggcagctcgtcggcgtgttcttcctcgctgaactcggtgatgtgacccaagcaaccacggctggcttcgcgctgtcgtcgtcggagcccgtcgtggtcgccgttgcggcgacggccggcatgacgctcgcgattgcgatcggcgctaccgcgtcctcagcgctcagtcgcattcccgagcgcgcgatctgggcgagcgccgccgccatcctcatcctcttgggcgtcggcgagctcaccggcgttctcatcctctaggtgctgattcctcgggatcggcctcgagcggccaggtcctcgccaccatcgtgagcacgtcgtagcgagccacgatcgctccgtcgccatcgcgtgtcacctcggcatcccaccgaacctcgtcgtagggcatccccgcgcgaggcgtgatctccttcgcggtgagcgtcaccgagagcgcatcgcccgggcgtaccggtgtgaggaagcggaggttgtcgaccccgtagttcgccagtactgggcccggctctggatcgacgaagagtcctgcggccaagctgacgacgagatagccgtgcgcaacgatcccgccgaagagtgggttggccgcggcggcctcggggttcgtatgggcgtagaagtgatcgccgctgagggccgcgaaggcggcgatgtcgtcagccgtgacgatccgcgggcctgcgctgatcgcgtctcccagctggagcgcggaggtgggcttgcgaaacgggtgctcaccgaggtgccgcggggcgcctggaacccactgggcggcgatgcgaccaagcacgctcggtgtgccttggaccgcggtccgtgcgaggtgccgcgtgacggctcgcatccctccgagttcctcgccgccaccggctcgtcctgggccgccgtggaggagccgaggcaagggagagccgtgtccggtggacgcgggagcgctggtcgcatcgagcacgaggatgcgaccgtgccagggcgcaagctccatcacgagctcgtcgacgacgcgcgcgtccgcgctcaccaccgaggccaccaggctgcctgccccgcgcgcagccagcttcgccgcgtgctgtgggtcctgatagccgaggacggtcgcgaccggcccgaaggcctcgatgcggtggggctcgtcacgatcggcgtcgcgcgcgacgagcaacgtgggggcgacgaaggcgcctcgctccgggtccgcgccgaggacatcgtccaggtcgccgccgaccacgacgtctgctgcgcgggcgagctcgtcaatccgggcgcgcacctccgcacgctgggcgaggctcgccagcggtcccatcaccacgtcgggacgtcgcggatcgcccacggtcacggccgagagccgctcggttgcggcctcgaccaccggtcctaccaggcttgccggcacgagcgcgcgtcgaatcgcggtacagcgctgccccgccttgatggtgagttcgtccacgagctgggagacgtagagatcgaattcgttcgtgccggggaccgcgtcaggcccgaggatcgatgcgttgagcgagtcggtctcgacggtgagatgggtgccgcgggtacgaacgctcgggtgcgagcggagcagctcggccgtcgccgccgaaccggtgaaggcgatcgtgtcctgaggcccgaggtggtcgaggagatcctcggcgccgcccgccaccagttggagcgcgccgggcggcaggaggccgctgtcgatgatgagctgcacgagtcggtgggtgaccggggcggtctgcgacgctggcttgatgatggtcggcatccccgcgagcagggctggagccagcttctcgagcggcccccagacggggaagttgaaggcgttgatctgaacctcgacgcccctgcgcggcacgaagatgtgacgccccgcgaagcggccaccgcgatcgagccgttccacctcgccgtcacgcaggacgttgccctccggtagggatcgcttggcgaggcttgcgtagctgtagaggacgccgatgcccccttcgacgtcgaaccacgcgtcgcgagccgttgcgccagcgacggccgatgcgtcgtggagggtgtcgacgtgctccgagaggtacgccccgagtgcaccgagcagtgcgcccctgtcttggaatccgagggcgcggagcgccgggcccccgacatcgcgcgcgaagcgcaccatcgcctcggtcgggagtcctcgcgtcgcgaggcgagccacctcctcgccggtcgtggcgtcaaggacgggttgcccgggatccgtggagaaccaccacgagtcctcgacgaagctgccaagcgtctgcatcgatcacctccgaggccgcgcccgaccgaccggtcggtcggggtgatctgaggctatcgcagactgggccgcctcaccgcggccttgtcgtcgtggctcgacgcacgtgtcgccgccggcgatctgcgtgcagctcggtgctccgggagcctgcggtccgaggtgcgatcagccagcgtgaccgatgcacatggcgctagacccgatcatgaggcacggatcgttggcggagagggagggatttgaaccctcggacccactttcgcgggtcaactcattagcagtgagtcccattcggccgctctggcacctctccttgggctcctaaggctagcgcagcttcggccgccgattcgccccggtggcccagacggcacgggctacgggccggcgtgtgtcggcggcggtcggatcggtgatggcccatccacggagcggggtggtctcgaagaccatgcgacgcccagcgatcgtggggcgggagggagaccacacatgagttggatgagacgacatcgcgtgcgcctgggtctggcggcgcttggggcggtgctcgcaacgggtgcgggcgtggcaacggccgcggcggcctcgccgccgccgagcaacgctgtcgttccaggcaccggggtaggcgagtacgggatgacgagcgccttctacgacggtcacatcgtgcacttcacgtattcgcgtggcttctactgcgacctgcacgtgtcctcgggcgcatcgtccgggtgtgaggtcggcgcgaactacgtcgtgccgccgtcgaagtcgttcgacccgctctacatcgcggtcccgatcgggatctcggtgccggccatgtcgatggactgcccgagcggcctcgtctgcgtcgatcaccccggtaccatcgacctgagcaggctagagcctgcgctcaagccgttgtatccgaacctctcggccgcgcagctgaccgccgccctgaagaacgtcccgacgccagggcacgagcacttcatcaccaccgtgaacgaccgcaagcctgagtggtgggatgtcaaggtgatcggggtggagaagctgtcggtgtggaacgccatcaatcggcatcgctcctttgccttcctcgagaaggaggttcgcgcaggacagaccacgccgatcatccccaccaacctcttcttgtacttctcggttaactaggcgtaaccgccccggcggtgctgcgtgcaccgccagggccgaccggagctcaccacccatgcacctcacacgtcgccgcctgcaacttggcctcggatggctctggctcctcgacggctgcctctcgttgcagggatcgctgctcggaaagagtttcgtcacggcggtcctcgagccaacgctcgcacaccagcccgcgatcgtcgccgcaccgctgcgaaccgccatcgaactcgtcgcaccgcacgctgcgctcgctggcttggcaatcgcgctcgtacaactcggtctcggccttggcctcgtcgtcgctcgcgacactcggcgatggcttgcgctctcgattgggtgggccctcgtcgtctggtggatcggggagggactcggtggcctcctgaccggggccacgctgctcagtggcgctccaggggcggcactgctctacgcgctgatcgcggccgcggcctggccgcggcggggccgacaggagcacgttccgccctcgccgttcgccgtcgcggcgtggagcgtcctgtggatcgtgaacggcgtcgcgcaagtcctggccgatcgttcgagcacgaacccgatcgcctccacagcgcagatgggccaagttggcgccccatcgtggatcgcggccgtcgaccaacgactcgggacgatccacggcgatgccctcggcacgatgctgatcgtgctcgaggttgccgtcgccatctggggactcgtgcctggcggaccacgcacgctgtcggcgctcgtcggatcaggtcttgcggtcgtcgcctgggtgttcttccaggggatgggggcactcacctcgggcctggcgaccgatccgaatacgggtccgctgatgctcctcctcgctggcgccgtcgtcgcggctcgtcctgcgaccggcgctctcacggaagcgatcgggcgacgccgggagcggagggcgccggtcggcgcccacgtcctgctcggcgtgcaccgtggcgagcgttcctcgtccatccccgcccagacgaagtgaggtgtgtccagtcgggtcgtgagcgtctgcgtgctgctgtcgatggctccgggggcatcccggctgtgcaggcagtccgtggaacgacttgcgtgtggcgcactgcggctcgcgccatggcgcccctccgcctccggcgacgtcgggtggcgtggcctcgcccgcctcgctgccgtcgtcggctcaccgcgaccgcatgcggggccgttggcatcgctggcgcaaccttgtgccggcccggtccacgccacctggtgcactgccatcgtgacgatcctcgactcgggcgctcccttgcggtctcggtgcccatgggggtcgatctgggctcgtcgatgaaggctccgtcggatccttcgtcgtcccagccgaggccgcggcgcccccgcagttcgatgcgccatactcagataggagcacgatcggtgctcacgagggtccggggggccaccgtcgagcaacgactggagagcacacagctaaccgccgatcacgactctcgagctcatcggtccgccggctgggatctgtgaggcccgtgcgagccgctgccggcgtcgccgcccatggtctcgcgaagcccgtctcgagtccgcagctgtcacctcgcagcgcgagcctcagctcgtgcgcaccaggtactcgagcctgggccgtggctggtgcgtgtctcggtgtcggcgaagtgccaacattgagccttgtgttgcggagggagtgggattcgaacccacggggctcgtggcccaaagcatttcaagtgcttcgcattcgtccgctctgccatccctcctcgaggacgcgagcctagtccggcgagtgcaggctccgcgggaggctcgggtcgagcggaaccggcggtggcgatggtgccgcctcttcgcggtggcgggggcgtgcactggcgaacgagccgagcagcttcgctcgtacgccgctcgcggcgaggtcgtcgagtgcactcgccaccgctggatcggtgacgtgaccctcgagctcgatgacgaacaggtaggcgccgaggctggttcgggttgggcgcgattcgagtttggtgaggttgatgccgcgagcagcgaaggcgctgagcagcgcgagcagtgagcctggtcggtcggtgacctgaaagcacgccagagcggtgcgatccgatccggtgggttccgggagcctgcccttggcgagcagccagaaacgcgtctcgttgcgcgggtcgtcctcgatgtccgacgcgagaacgtcgaggtgccagaggtgtgcggccgtcatcgttccgatggcagccgtggttggatcgttggcgtctgcgacggtgcgagctgcctcggcggtcgaggccaccgcgacgcgggtggctcccgggagcctcgtgcgcaggaacccgcgcgactgcgagagcgcttgggggtgagagaggacgcgggtgatgcgatcgagggaggacccgacgacgccgagcagctggtgatggaccgggaggatcgcctccgccaccgcaaggaggtcgaaacgatggaccagggcgtcgagcgtcgcgagcaccgctccctcgagcgcattctcgatcggcgagaaggcgaggtcgacgtcgccgtggtcgaccgcttcgaggacgtcctcgatggtggggtaggcgaccggctcgacgcgatctccgaaggaccgccggagtgcttcctcggtgaaggtcccggtcggccccaggtagctgacgcggtgggtgggcatggccggagcctaccgagtgggggtgaggtgcctcgccctaggctcggcgtgtgtgcagcccatgagtgaggacggtctcgtccgtagcgatgccggttggttcgacactgcacgccggaggcggatcggcctgccggaggccatctacgcaccgggcaaagccgagaccgacctcgtcgccctcatcgagcagagtctcgcctccggcgagccgaccatcgtcacacgcgtcgagcgcgagctggccgagcggctcgtcgaccggttcgaccttcgcccgtatcccgcgctcgaacgtcgtgcacccatggtggcgctcgccggcaatccggtgccgtcgtcgtcgctcgaacgcgtcgggctggtcgggattcttgcggcggggacctcggatcgcccggtcgctgccgaggccgcgtgtgtcatcgagacgctcggccacaggacccgcttcgtgctcgactgcggcgtggctgcgctcgcgcgatcggtgcgcgccatggaggaggtggccgacgcggacgtcgtcgtggtcgtcgctggtttcgagggtgcgctggccagcgtggtcggcggttcgatggcccaaccgctcattgcggtgccgacctcgaccgggtacggggcagcccgtggcggtgagaccgcgttgtgggccatgctcgcgacgtgtgcccaaggggtctgcgtggtgggggtcgacaacggattcggcgccgggtgcgctgcggtgcgcatcgtcggtgcggctgggcgcaacgcatgagtcgacgtaccctcgtcgtcaatgctgcggcaggagtcgcgggcgacatgctcctcgccgcgctgctcgcgctcggagcatcgagagagcacgtggaacgagcacttcgaccggtcggtctcgacaccgccctcgagacctcgctcgtggaccgagcaggcattcgcgccacgcagctggtcgttggcgacgacatcgagcacacccccctcgacgaggctgggctgcgcgcagcctgtgaggcggccagcctcgggcctcgtggacgcgagctcctctcgcgcgcgctcgatctggtgctcctcggtgagcgcacggtccacggggggcatgggcacgctctgcacgaactggggtcgctcgataccgtcctcgacctcgtcgggacggcggccgcgttcgaggcgctcgacgtggatggggtgctcctcggccccgtcgccaccgggctcggggcggctccgatggcccatggggtctacccgatcccggcgccagcggtcgcggcgatcgccgccgcgacgggcctcgtggtcgaggtccgttccggtgcagaggccaccaccccgaccggcgctgcgctgctgggtgcgctcacgatggtgcgggtcgccgaagcgagcggggccgttgctgccgtcgcctacggcgccggtacccgcgatgacccggaccgggccaacgtgctccaagccctcctgctcgatgggagcgacgcggttgccgagcagatcggcgtcgtcgagacctggctcgacgacctgagcggtgaggacctcgggcgcatcgccgacgaggcgatcggccagggcgcgctcgatgcgtggttgcttcccggactcggcaagaagggtcgtccgggtttcgagctgcgtctcgtgtgcgcaccgtctgccctcgagagcctcgtggcctgggtgcaccgacggacccagagtccgggcgtgcgtcatcgtctccaagagcgcagcgtgctctccgcgtggttcgacgaggtcgaggtgcacggcgtgtcgtgtcgcatcaaggtgacgccggtgggggccaagtgcgaggacgacgacgcacgcgaacttgctgcggtgctcggggcatcggtggcgacggcccgtgcgttggcattggcgaggtggcgagagagcggtgtgtctcgatgaccgcgactggagggagcgacgtggcacttgacccgacgatcgcgagcttgctcgaacagctcgccgcaaccggagcgacgactccggtgtacgagctgtcgctggccgatgcgagggctggcctcgatctcgtcggcaccatcgggatcgcaaatcctcctgcggttgcccgagtcgagcagcggaccatcgacgctggcgaccacgccatcgcggcggagctggtttggggctctgaggcgccacgggctgccctgctcttcgtgcacggcggtgggttcgtcctcgggagtctgcgtggctacgggccgatggtccgccatctcgcggcctcgaccggcgcgttggtcgtgtccctcgactaccggctcgccccggagcaccgtttcccggcagcggtcgacgacacgctccatggtttgcggtggctcgcggccgagcgagatgcgctcggcgtctcggtgctcggtgtcgtgggggactcggcaggcggcaacctcgcggccgtggcgagcatcgccgcgccgtccgaggggatcgacctcgcgctcgccctcgagctctatcccgcgaccgatctcagcgaggacctcgcctcgctcgagcgcttcggcgagggttactacctcaccgccgaggaggctcggtggttcgcgtcccagtatctcggcgatgacgaacggctgctcgcagattggcgtgccaatcccatggccgccaccgacctcgacgacctgccactcacgatcgtcgcgaccgctggctacgaccccatcggtgacgcgggccgccgatgggcagctcgtctcgcagcgctcgagccgcgcggtagcgtgcccgacgacctggacgagcgtctgcgacaggcgggggtcgaggtctcgggctgggcccgcggtcgggtcatctcgctggactttcccacgctcgtccacggtttcgcatcgatagcccagctcgcaccggcggcgggggccgcgtgcgagctgagctatggcctggccgcctgggtgctcgaacgggcgtgagcggcgtcgggacgcctacccggagttcttctggacggtggcgatcgcattgatcgatcgcaggacgagggtgagatcatcggggttccgggaggaccgccacgcaccgagcgccgtcacctgcaacgggttcagctctgcgaggacgcggttgcgcacggtgagcgagtcggcgagcgtcggactccaggcgaggagtcggcgctgacccgtggcgcggagcgtctcggccacggtgcgctcgtactcctcctcgatcaccgcgaagatcgccgctgcggtcgtcggatcgtctgcgaggtcgaggtagcggcgggccaagcgcatgtcggccttggcgagcgcgatctggacgttgtcgagcatgccggcgacgaacggccacgaggcccgagcctcccggatggcgtggtcgccgtgcgcctcgcgtgctgtggcgagaccggtcccgatgccgaaccacgcgggcagcgtgtgccgtgactgggcccacgcgaagacccaggggattgcgcggatcgtggcaagtccggtatcggcctgatggcgccgggcgggtcgtgagccgatgcggagctgggtgagctccggaaagggcgtgaccgatcggaaataggcgtcgaaaccggcgctcgtggtcaaggcccgataggcgtgctcgctcgagcgtgccaccagttcggtgaccatgaccgcgcggtcggtgggtgcggtgtcgtcgtccgcgccgccgaaggctccgagcgcggtgagcaaggtcgcgctggcgcgatcggtcgtggcgtagcggtgcgagatggtctcgccctgctccgtgatgcggatggtgccgcgcagcgcagctcgcgggtgcgctcgggccacctgggcgatcggtccgccaccacgcccgacggtgccgccacggccgtggaagagttcgacggtgatggcgtggcgttctccgaggccgatgagcgcctcttgcgcccggtagagcgcgtacgcggacgccgccatgccaccgtccttggtcgagtcggagtagccgagcatgacctcttggcgcagcgcccgacgctcgaggtgggccaggtaggcggggagggtgaagagttgctccatgaccgactcgagacactcgaggtctgcgatggtctcgaagagcggggtgatgtccagatggtcggcgccgagcgcacgggcgatgacgaggaccgcaatgacgtcggcagcgtggtgggtcatcgagatcacgtaggagccgatggcggcgggcccgagctcggcctcgacggtggtcagggtgtcgaacagggcgacgaggtcggcaacgagcgtggtcctcggcgtgcgagcgtgtggcggatgatccaggcaggccagcagcatcgacaggcgatcgtccgcgtccgcctcccaatagccagccaggcgaggatcgtcgccaaagagttcgaggatcgcttggtggtggaccgtcgactcctgccggatgtcgagtgatgcgaggtgggtgccgaacgtcgcggcttgccacacgaggtcctggaggggcccctcagcaagcgcggtgtcgccgtgagcagccagcgagtcgcgtatgagtcggagcgcagtctcgaggtcggggccgaccaggggggcgatgtcgagcgcctctgggtcgttgtggagccgatggagctggttgtcgatacgcgcaagcaggtagtagatcttctgacggtagggctcgtcgacgtagtgggtgcgcacgtacggtgcgaggtggacgaagtcgtgctcgtcgttgcggatcgactccacgatcgcgtcggagacggcggcgaagtgcatggagtgcgtgagccgtcgcttgacggcgtcgagtcgcgagcggaacgcctcgaggcacgcggtcgcgttcgcgacgaaggcagccttggtgacctcggccgtgaccaacgggttcccatcgcgatcgccgccgatccacgaaccgaagcgcacggggacgccgatggcatctgcatcgaccccccgtgctgccgcgagctgtcggtacacgactgggatggcgtcgaacaggctggtggtgaggtagaagaggccggtgtgcacctcgtcggcgacctcgagtcgtcgggagcgcagctcctcggtgaaccacaacagacggaggtcggacgggtcgacggcgttcggcgcgtgcgcgatgcgctgcagggtgtgcaagatggtgcgccgcttggtctcggtcgggtgcgcggtgagcaccggagtgaggcggatccgtccgagactcctcggtgcgagcttggcgaggtccgtcacgtcgtcggcgccctcggcgacgttgaggacgttgaacacgacgttggcgaggcgcagaagctgctccgtgtcgttgcgatcgagcggctcgtgctcggggccatcaccgagcgcgaagcggagcgcggcgaccgcccgcggcgtggcgagcgcccacagcgcgtccagcgggagtgaccacaggtactcgttcgtgcgcgacagcgactgcctcctcgcgggccgtggcgaccagtgcgcccgggcggcgagtgcgccgcccgggcccgagcggaggaggtgggattcgaacccacggtgggttgccccacacgcgacttccaatcgcgccgattcggccgctctcgcacccctccgtgcccgtctcggtgcacccaaggttcgggctgctacgctagcctacggtctacatcgcgcccgggccgccggcgtgggcgcggaagccgggccccacgcggcgggtccccgtgaaccgggtcagggccgggaggcagcagccctcagcggagcgattcgggtgccgtggccagcctggcttccgcgcaacgccggcggcctcgtaggcctgtccggggctgaagctaggatgccaccgtggccgagccttaccagtcgctgtatcggcgctttcgaccgcggcgcttcggcgaggtccgaggtcaggagcgcgtcaccgagaccttgaggcgcgcggtggccgaggggcatgtctcgcacgcctacctcttctcgggcccgcggggaaccgggaagacctcgactgctcgtatcctcgcgatggcgctcaactgcgaggcgcccgtcgatggtgagccgtgtctcgcctgcgcgtcgtgcgaggccgtcgtgcgcggcagctccgcggacgtcgaggagctcgatgcagcgtcgaactccggtgtggactccattcgatggatcacccagaccgttgcggctgcgccggtcgggcggtggcgcgtctacatcgtcgacgaggtccacatgctctcgcaggcagcgtcgaacgccttgttgaagacgctcgaggaaccgccggcgcacgtcgtgttcatcctcgcgacgaccaacccggccaaggtgctcgcaaccgtgcgctcgaggacgcagcacttcgcctttcgcctgctcgacgacgcatcggtcgatgcgttggtcgccgaggtcctggaggcgctcggcgccagcttgtccgacgaggcgctggcctacgtgcgtcggcggggcggaggatctgcgcgtgacacgctctcggttcttgagcaggtcctcgcgctcggaggcgtggtgaacgacgcggccgacggcgccgtcgcgctcgcacaggcgatcgcagacggtgacctcgcgtccgcggtgcgcatcgcgagcgatgccttcgagggcggcatcgacccgacagaactcgtcgccgacaccgtgggcgatctcggtcgacggttcgtggccgaggcgctggccggtgcgcgaggggcggagctcgctcggctctcgcggccgctcgagaccctcggacgcttgggggcgggcctgcgcgatgcgttggacccacaggtggtcgtgctcgcagggctcgccgaggcgctggcgccggacgcgaggctcagcgcgctcgaggctcgcgtggccgcgctcgaggccgacctcgcaggagccggtcacatgccgagacccaagccaccgaccggcgagccactgccggcccggaccacgagccccgagcccgccgggcactcggcgtcgccaaacgttgcggagcctgagaccagccagccagagacccgggagcgagcgtcccgcgcaccagcgcgcggactccaagatgctcggcgtggtggcgacgagcatcctggtgcgtccaccgagcagcggccctcgtcgctcgatcgcgtgcgtgctgccttcgcgaggaatcagcagcgggccgatgtcgaccgtggcgagccatccgagcccgtcgcgaccaccccggcccctcatggagacgatgaccagcccgcggcggcccccgacgcgcacggctccccggtgccgagcgggctcgctgacgaagcaacgcgagccgctgggcccgcgtcgctcgaggcccgtcggcagcgactgcaggcacgctggttcgacgacgtgatggccaaggcgccccgggtcctgcgtccgctcctcgcgcacgctcgtctcgcgatccgagacgagcgcatcgtggtggcggtcgacaaccgaacggttgccgagcggctcgtcccccatctcgccgagatcgtcgcgctcgtcggcccggacgagtttgccgagccgcccgagatcgtcgtcgaccctggatcgagtcagacgtcgtcccgggcgcccgctgcgagcgtcgacgatcgcgatccaggcgacgaggacggcgtcgatctcaccgacgccccctcgtccgatgcgacccccgtgcgcgacctcagcgagtcggtgatcgaggccaacgtccgcagcatcttcgaggatgctcgacggctcccatgaactcactgcctccaacgctggacgcgctcatcgaggagctcggtcgattgcctggcatcggtccgaagtcggcgcaacgcatcgcgctggcgctcatcgtgcgcggcccggccgctgcgcaccggctcgcagacgtcctcgtcaccgcgaccgagcggctcggtcgttgtgaccgctgcggggcgctcgcagagggggcgcgctgcccgatctgcgacgatccggcccgagatccgcgcatcgtcctcgtcgtcgagggcgatcgcgacgtgtgggccttcgagcgggcgcgacgtttccgagggacctaccacgtcctcggcggcgtgatcagccccatggacggcgtcggacctgatgatctcgccatcggccggctcatcgctcgcgtcgaggccgagccgatcgaggaggtcgtggtcgcgacctcgccgaccgtggagggcgagacgacggcgacctacctcgccagagtgctggccgggcgcgtcggtgtctcgcgtcttgcgaccggcgtgcccgtcggcggcgagctggagtacgtcgacgagctgaccttggcgcgcgcgctcgagggccgacggcccttcgacgacgcggggccgcgccgctagtcagtcggttgcaggcggttcttcgacgaactcgatcaggacgccaccggtggagcggggatggacgaaggcaaccgtcgtgccgcgcgatcctcggcggggtacctcgtcgatcgggtcgaagccctgacgtcgagcctcctcgagggcgtcgcgacacgattgcactcggagggcgaggtggtggatgccgggccctcgacgggcgagaaagcgagcgaccggcgagtcctcgcgggtcggagcaaccagctgaatgaagctcggcccgaccgcgagcatgacctcctcgatgccgtcggagtcgacgtgctcgcggtgggcgagtcgtgccccgagcgcctcccaccgggcgatcgccgcgtcgaggtcgtcgaccgcgatgccgacgtggtcgatctcaggctcgtccatcgtcgcctccgcgctgttcgggtgccgtcgtttgctcggccgcaaagcgcgcgaagagtgcgatgcggtcttcgccgatcgcggtgcgtgcctcggggtcgtcgatgccgagccccggcgtgggcgagaggcagaggatcccgaccttgccttcgtgacggttctggcggaccgtgcgaaccgcttcggcgacctcctcgagcgggtacgtggccgacaggaccggttggatgcgtccacgctcgatgagtcgattggcttcccacgcctcgcgatagttcgcgaagtggctgcccttgatggtcttcagcttcatccacaggtggcggttgtcgtaggagatccaatgtccgctcgtggcagcgcacgtcacgatcgtgccgccgcgcttggcgacgtagacggacgcccccatggtcgcgcggcccgggtgctcgaagacgatgtcagggtcttcgcccacgaggtcacgtatgtcttggccgaagcgtcgccactccgtttcgtcctgcgtgtcgtcgtcgcgccagaactggtagttccgctcggaacgatcgatgacgtactcgcagcccatgcgtcggagcagcgctgccttgcgcggcgaggagaccaccccgacggggatgcctccgccgttcaggacgtactggacgccgtaggagccgatcccaccggtcgcgccccagatcagcaccacctgtccttgacgcatctgggcaccgttgggcgagacgagcatgcggtaggcggtcgagttggtgaggggattgacggccgcctcttcccagctgagatggcggggcttcggcatgagctgattggctcgcacgatggtgaactccgccaagccgccgaagttggtctcgtaaccccagatgcgctgctcgctggcgagcatcgagtcgtcgtgggcgctcgggtcttggtcgtcgaccgcgttgcagtgcacgaccacacggtcaccgatctgccagcggcgtaccgcgggtccggtgcgaacgatgacaccggcagcgtccgatccgatcacgtggtagggcaggttgtggcgctggtcgagcggccgcggtgagcgtccgagtcgggcgaggaactgaaacgtcggcaccggttcgaagagcgccgaccagatcgtgttgtagttgatcgagctcgccatcaccgcgacgagcacttcgtccggcccgagctcgggcatggggacatctccgatgtgcaaggtggtgccggggtcgcgtacggcaggatcgaggtgggcaacacgctcgatgtcggactgctggacgtagcaggcccggtagtggtccgggaccggtgtcgccgccaactcggcgggatccgcgccagcgagcacagcctcggtgaggaacgacggcatgctctgacgttagccgctggcgacctcggcgtgtgggcagcccatctcgacgctgcgacgccggtgttctagactcgcgaggtcacaaccgtgtgctcgtgctggcgccaccaggtcaggcactcggaaggttggaggaggtcgtatgtcgaggtcggtcattgtctcgtacgctcgcacaccgatcggcaagctccagggtgcgttggcgtcgctgtcggcgatggagctcggtggtcgcgccatcgcgggcgcgctcgagcgagcgggagtcgccccggactcggtggactatgtcttcatgggccacgtgctccaggcgggccaaggccagatcaccgcgcgtcaggcggcggtggccgccaacattcccatgaccgttcccgccaccacggtgaacaaggtctgcttgtcgggcttgaacgcagtgttcctcgccgatctcctcctcgcccaaggacgcaccagtgtcgtggtggcgggcggcatggagtccatgtcgcgggcgccctacgtgctccccggcgcgcgaggcgggctgcgcatgggcgacgcggccctcatcgactcgatgctctacgacgggctcttctgtgcgttcgatcgcatggcgatgggtgcctcgaccgaacactactgccgggtggatcatccggtgtctcgcgatcgccaggatgcctttgcggcacgttcgcacgaactcgctgctcgagcggcgaaggagggccgtctcgccgacgagatcgtgccggtcacggttgcggggcgccgaggcgaggtgcacgtggtcgaggacgacgagggcatccgtcccgagaccacggtcgagacgttggcccgtctgcgtccggcctttgccgaggacggcaccatcaccgctggtaatgcgtcgcagatctccgacggcgctgccgcgctcgtcgtcatgcgggccgaggaggcagagcgacggggcctgacccctctcggagagatcctcggttatgggcaggttgccggtcctgacgcgtcgttgctgcaccaaccctcgaacgccatccgtgctgccgcgagcgacgccggcctcgacccggcctcactggacctcgtcgagatcaacgaggcgttcgccgcggtcgcgctcgcgtccatggacgatctcggtatcgatcccgcgcgtgtcaacgtcaatgggggcgcgatcgcgctcggccaccccatcggggcctctggtgcgcggatcctcggctcgctcctgctcgagctccgtcgtcgtggtggcggtgtcggcgcggccgccctgtgcggcggaggaggccagggggatgcgatgatcgtgcgcgtgccccgcaccgagtcctgactcaagccgccagaggggcggtcgatgacctcctcgggaggtcccgcatgcgtatcttcgtcgagggggcaacggcccacgacaactcctacggcatcgtgaacctgcgccttgccgaggcgctgcgcgctcgtggtcatgcggtgtacgtgcgcccgtgggaccaatcgttgcggggagctggcacgagcgcacgtgagctcgacatcgagcccttcgatctcggcgtcggccacgccgacgtctgggtgcgacaggtgtggccgccgtcgttcgagcgtcccgacgccgagcgcgccttcgtcatccaacccttcgagcttggcgcggtgccggcgaggtgggtcgtcgaggcaggtcagctcgatggcatcctcgtcccctcactctttgccaagcaaacctggctccaaggcggggcggatcatcgccacctctgggtcgttccgaacggcgtcgtcgtacctgccctcgtcgagtcctcagaaccgaacggtgatcgcctgacggtgggctacgtgggcggcgccatctggcgcaagggtatcgacatcctcatcgctggtctcgacctcctcgatgacgccacgctgcaacggatcgagctcatcgtcaaggtcgcaggtcatgacacctactacgccggccagtcgttgctcgagcgcgagctgctcgcccatcctcgtgtcgccgctcggacggagatcattcgcgcgagcctgtcgcaggcgcggctcgatgccctctaccaacgcttcgacgtgctcgcggctccctaccgtgccgaggggttcgcgctgccgatcctcgaggcgatggctcacggggtcgtcccgatcgtgccggacgccgggcctgcgccagagttcgtcgaccggagctgtggcgtgttgctcgcgagtcgccccctcatggtcggtggccctgccgatgagttcctcggtccggcgctcggaccacggtgggccatcgaggtggacccctgtgacgtcggctccgctgtggccgcgctgctggaggaccccggcgcccgggctgggcgtgcgcgagctgggcaggagcgagcccgggcctggagctgggatcgcgccgcaagcatcctcgaagacgtcgtgagggcgctggacgccgacgaggcacccaccgatgcgtcgtctcgactcctcctccgtgcgacacggggtggtccgcaggcgatcggtgcgctcgtcgagctgggtgacctccacggcgcccgcgagctcgctgcggtgaccccaggcgccgaggcggtgcgagcgagactggaggggctcgcggccactcgcccggacgtgtggtggggtgcgcgccatcgcgcgccgatccccgctcgggccgaagcacggtcgtcgtggcacgccggcgaaggcgacctcgccatcgtgacgcgtgtcgcgcgctacctcgctccactgcttgcgatcggaggcggtcgcgtcctcgacgtcgggagcggccatggcgcgatgctcggtcagctccggtcgctcggggttcgtgcacttgggatcgaactcgatccagcgagagtggagcacctgcgtgcgagtgggttcgacgtcctcgagggcgatgcgctcgaggtgctcggcaccttggagacggggagcttcggcggagccttcgtgggccacctcgtcgagcacttcgcgccccaggaggtcgtcacgttgctcgccgagctcgctcgtgtcgttcgcacgggtggcgtcgtggtgatccagaccccggatccgcaggcagagggagtcatgcagcagacgttctggctggatccgacgcacgtgcgcccgtatccggcgatgacgatcgccgcgatggcggccgaggccggttttgccactgttggggcactcgagcgatcgctcgcaccgctcgtcaccgacacgctcgtcgtgctgcgtcgtcgtgccgatgcgcccgtcatcgcgcctcggagggtggcagcggtggcgccggcggtggtcgtggtggccgaccctcacagtggattccggcgagccagcgacgcgctcctcggcgagctcaatgcgatgggcgtgggcgtgcgggcagagcccctcgtggggccgcggtcggaccgcgtgttcatgcacgatctcccgattggttcgttggccagcggcctcgtgggtacggcgctcgttgcgcgtaccgcgtgggaggcgaggggcctgccacgagagctgcgccgtacgctcgcgcgctatcgccgcatcctcacctactcacactggagccgcgacgtgttcgtcgaggccgggctcgcgcccgaccaggtcggcgtctgggcgccgaaggtggccctggacctcgatccagcgtcagtgcgagccctgcgaggttcgagggagccctcggggcgcgtcctggcggtcgccgagtggggcgctcgcaagaacatcgaggccctggtgcgcgggttcgtcagggctcgtggtcgtgtcggccagggttcgctcgtcgtgaagctacgacggatcgaggccgagagcgcggcgcgctggctcgagcggatcgtgagcgaggagcggggtgaattggcggcgatctcgctcgtcaccgacgacctggcgcctgcggcgctgcgccagctctatctcgatgccgacctctactgcatgccgacgcgtggcgaaggcttcggcctccccttcctcgaggcgatgagctacgggtgcgccgtcatcgcgccggccgacggcggtcaccgtgacgtggtcgatgcgtcgcaatggctcgttcccggtcgctacgagcctgcgcacgtcgatcccgcgtctggctacgccgatagcggggtcttccgaggagccgagtggttcgagatcgatcccgacgccttcgtcgaggttctcgccgaggcgctcagcgacccggacgcggtgcgctcgcgcgccttggctgcgctcgggctcgccgaggctgccgctcaggcctcgatcgacgagcacgagctgaacgtcgtgcgcgcgctctgggaggacgcggtcagctacgtggatgttcgatgatcgtgacgtgctcgatgaccgggacgcgctgtggccgaccctcgggagtgccgagcgcgtcgaggcgtgcgagcgtctgcgaaccgtcggtcatctgaccgaagaggctgtaggcgggcggcagtgcgacacccgagggtccggagacgatgaagaactgcgagccattcgtgttcggaccggcgttcgccatggcgagcgagccgatctggtaggcgcccgctggcgggagctcgtcgcggaagcggtaaccaggcccacccgcgccggacccggtgggatcgccaccttggacgacgaagccggggatgatgcggtggaacccgatcccgtcgaagtagtggtagcgggcgaggaagacgaagctgttgaccgtcgtcggcgcgcggtcggcgaagagctcgaagcggagctcgccttcgctcgtcaccatgagcgcctcgtaggatgcaccgtcggcgaggcagaagctcggcggcgcatcgaaccgctgtgtcttcgggctcgagccgtcgggctcgggacaagggtacgaacggtcacgacgtccgaacgccacgggggctcctttcttcgtgctcaccgcacgacgtgcggcacgtgccacacgctcgggtggactacgagctcgcgatgtgccagtggatcgacacgatccggtaggtgtgcttcggggggatgccgttgttctgggccgagccggcgtcgttgatggtggtgatgacgttgaggccgctcgtcacctggccgaagaccgagtagtcaggggggagctgctcgcctgcgggacccgacacgatgaagaactgcgagccgttcgtccctggcgccccggagttcgccatggcgagcgtgccgaagcggtacgagccggcaggagggttcttgtcggcgtaggcgaagcccggtgatccggtgtcggtgttcgtcgggctgccaccttggatgacgaagcccggaatcactcggaagaaggtcgtcccgtcgtagaagtgatacaggctgaggacgtagaaggcgttggcgctcttggggcccaggttcggctcgagtcggaaggtgaacgtgccggcggtcgtgtcgacggtggcggtgtaggtatcccctgcgacgaggcactccttggggtaggcgccaaagtgcgttcgcttgggtgcggacccgttcgggttgggacagccgttggcgaggaggcccttggcgggctttgcggtcgggcgcgtgagctcgtagatcagcgcgaggagggcgacgaggatgacgaggacgatgactcctcgtcggatgaggcgggtgcgacgctgacgggctgcgcgctcggcgcgcagtcgctcttggttggcccgaatacgggctcgcttggcgcttggcacctcggcaaggctagtcgccaaggcctcgggactggcgcgaccacaacgcgccgcgcgtgctcccgcctcgaggcgggaggtaagcggcgctctcatgctggtcggcgctgttactcgacgtagtggcactacctcgaacagcccctccttgcaggtatgacgctgacgagcgttggtgacgtgggcgagtacgtcggtcggagctaccggctctccccgagcccgcaccaggcagccagaatgaccacctgggcacatactcgccgtgccattcacaacctcgccatcgagcatcggcaactggcgtggtcaagagcgagggcgcaggtgacgtaccgcgaacaatgtcacgagctggctgaactgcgctcgtgcgtcgagtgggtggccgagccaccggcacaccttctccaacaagcacttcgtgacgtggatcgggcacaccagaactggtggcaaggacgcgcccgtaagccagccttcgagaggcgcggccaactccgcttccggccctcggcctccgatctccagatccgccacctcaaccgaaaatggtccgaagtgcgcctccccaagctggggtgggtccggttccgacgctcgcgctcactcgatggtgagcttgcctcggccacgttccgctgctcggtggcgtgtggcaggtgaacttcaccgtcctcgccacgacccaccgcgcgcccgtgaacgacggacccacggtgggcgtggacttcggtattgcctgcgccgcctacgtcgctggcgagtctgccccgaggatcatgcccccgacgctcaccccaggcgaagagcgtcggctccgtggcctggaacggcgtaaggctcgccagctcacctacgcgaagcgtcacaacggaggccggtactcgaaccgactccgtcggacgatccgtgagatcgcacgtctccgggctcgccaagcccggagacgccaggacttcacccacaagctcacgagcgacttggccaagaaccacagcctcgtcgccatcgaggacttgcgggtgacccacatgacgagctcggccaagggcacggtcgaggctcccggcaccagagtccgtcagaaagccggactcaaccggtccatcttggacatagctcctggcgagcggcgtcggcaactggactacaagtgcccgaagtacggctccctgctcgtggcggtgccaccggcaggcacgagccagacctgtcctgcatgcggggtccgagacccagcgagcaggccagggtgcgggagatcgttcgcatgcgtgcagtgtggtcataccgcacatgcggacgcggtggccgcacggaacatccttgatcgggccatcgccctcgttggtggtggtattgccgtggggcgcacggtggacagcgcgggcagggcttctggcccgagtcgccgccgcacggcggcaggcgtttccgcgaaggttcctcctgcggtaggagccacaggtgcgtgaacagcgcacccgaagcccccgccttcaggcggaggtggagtcacgagccgctagccttgggtgcccgtggccctgctcgtccagaagtttggcggaacctccgttggcgatgtcgatcgcatacgcggggtcgcagaccatgtcgcgcggacggtacaccgagggaacaaggtcgtcgtggtcgtctcggcgatgggcaagacgaccgacgacctcattcggctcgcgcacgaggcgacggacggccctgcgcccgcgcgcgagatggacatgctcctgaccgccggtgagcggatctccgcggccctcgtcgccatggccctgagcgacctcggcgtggaggccgagtcgttcaccggctcccaagccggcatcatcactgacaccgaccacacgcgcgcgaagatcctcgagatccgcccccatcgtctcctcgaggccatcgagtcccacatcgtgccggtcgtcgcgggattccagggcgtctcgacggagcgcgacgtcacgaccttgggcaggggtggttcggacacgaccgcggtggcgctcgcggctcggctcgacgccgacgtctgcgagatctacaccgacgtctcgggcgtgttcaccgccgatccgcgggtggttccgcgcgcgcgcaagattccccggatctcgttcgaggagatgctcgagctcgcggcctcgggagggcgggtcctggcgttgcgctcggtggaggccgcgcggaacttccgggtcccgctccacgttcggtcgagcttcacgtgggagccggggacgtgggttgtggaggaggagccatcgatggaacaggccgtggtgtccgccatcgcgcacgacgcgagcgaggtcaaggtgaccgtggtcggtgtcccggatcaccccggggttgccgcccgtctgttccgccacgttgcggagcaaggcgtcaacgtcgacatgatcgtccagaacgtctcgctccaggggcacaccgatatctcgttcaccgccccgaaggccgatcgcgctcgcgcactcgaggcgacccgtgctgctgccgcagaggtgggcgccgtcgacgtcatcctcgatgaagggatcgggcgcgtctcgctggtcggagccggcatgaagacacaccctggggtgacggcccgcatgttcgagaccctcgccgagaaggggatcaacatcgagatgatctcgacgtcggccatcaggatctcctgcgtggtgcgggccgaggtactcgaggacgcggtccaggcgttgcacgaggccttcgaactcgatcgtgaggtgcaccaatgaacgggctcgccctcggggtggtcggcgcgacgggccaggtcgggtcggtgatgcgtcggatcgtgctcgagcgcggtctgccgattgcgtccgtgcggttcttcgcctcgtctcggtcggcagggacgcagctcgacttcgatggcacctcggtcgaggtcgaggacgttgcgacggcggacccgagcggcctggacgtggcgttgttctcgatcggggcttccgcggccgagcgctacgcgccgcgcttcgctgcgagcgggtgcgtggtcgtcgacaactcctcggcatttcgtatggacccagcggtaccgctcgtggtggccgaggtgaatcccgaggcgatcgaggcgatgccgaagcggatcgtggcgaacccgaactgcacgacgatggtcgcggtcggggcgctcgcggcgatccgtcgcgtcgcgggccttcggcgcgtcatcgcgtccacctaccaggcggcttcgggtgccgggcgcacgggggtggccgaactcgccgcacagctgtcgcgccccggcctcgaggcgctcaccttcgacgggaaggccgtcgacttcgggacgccagcggtcttccccgcacccctcggggccaacgtcgtacccctcgcggggtcgttggtgggcgacgacacgaccgaggagcgcaagttcgtcaacgagagccgcaagatcctcggcatggaggacctgcgcgtgggcgcgacctgcgtgcgcgtgccggtctttaccgggcacgcagtgagcgtggtcgccgagtgcgagcggcccgtcgaccttgccgcggtgcgtgctgccctcgaggcggctccagggctccagctcgcggacctcccgacgccgctcgacgcggcaggtcgcgacgaggtgctcgtgggtcgggtgcgcgccagcgacgtcgtcgacaacggcgtcgcgttcttcgtcgcgggagacaacctgcgcaagggtgccgcgctgaacgcggtccagctcgctgagctcgtcatcgagcgcggcctggtcggctgagcaatcctcgcgagcgctcagagaagctactcaagttcgagatcctcgtcgtcgatgccttgaatgcgcatcacggaaccaccgtggagcgtctatggacagcgggcattcaaggaggatccatgtccctctcggtcaacacgaacctctcggcgattcaggcctacaacaacctgaatgcgacgtcgaaccagatgcagaccacgatcaatcagctgtcgtcaggtctgcagatccagacggctgcggacaacgctgcgggctacgtgatctcgcaggggctgcagacccaagcgaacggcctcggtgtcgcgatcaacaatggccaggacgccatcagcgtgctgcagatcgcctctggtgcgatgaaccagcagatctcgatcctgcagaccatgaaccagctggccacgcaggctgcgaacggcggcgcgaacaactccaactcgctgagcgcggatcagcaggagttcgcggcactccagagccagctcgaccagattgcgaactccacgagcttcggtggcacgaacctcctgaacgggagctactcgaacgaggtgttccagatcggggcctacgcgagctcggtcgaccaggtctcggtcaccatcgcgaccttgaacaccacctcgctcgggatcgcgtcctcgacggtgtcgatcggcacggtgtcggcggcgatcagcgccatggctgcggtgcagtcggccatcctcgcggtggcgagtgccgaggcggtggtcggtgctgcgcagaaccaggtccaagcgatcatcgcgaacgacacggtcgctcagcagaacgtgcagtcggcgaactccacgctggtcgacaccaacatggcgcaagcgatgaccgcgttctcgtcgcagcaggtcctcatgcaggccggcgtcgcgatgctgtcgcaggcacaggcgctgccgcagctcatcctcaagctcctcccgtagcacatccgatcatccccggtcgttcgtcacgggcccaggccgtcggggcctgggcccgtgatcgtgcgatcaggactccgaaggaggccccatgtcgtcgatcctgccaacctcatcgacgagctcgacgtcgtcgacgtcgagtggctccaacgtctcgacctactccgacccgggcggtcccccgatcacgttctccagcctgttctccggtatcaacacccaggcgatcatccaggcgctcatggccgcctacgagcaaccccaggtcgatctcgccaagcagatccagtcgctccagacgaacctgtcggactaccagaccatcgtctcggacctcagttcgctccagacccaagcgaacgctctgctccagccgtcacagctctcctcgatgagcgcgagtacctccgacgctgccgtggccacagcaaccgcaggtcaaggcgccatcccgtcgtccttgacgttcaacgttaaccaactcgcccaggccaacatcctcgcctccagcggcaccgtgtcgtcgctgtcgtctcaggtcgcctccgggaacttcctcctctcctcgagcgcagcgggcgccggcgtcacctcgcttgctggctcctcgctccaggtcgggacgcactccttctccgtgacgagcgcgctctcgggcgccaccgcgacggggacgtcccctcttgcctcgtcgatcaccatcggctcgtccaacgacaccatcgccgctaccgtcaacggcaccgccgagacgttcaccatcgcctcggggacctacacgccagctcagctcgccgccgcgatctcgcaggcgagttcggtctcgggaacccccttgctgcaggcgcaggtgaacgcccagggccagctcgaactcggcacgacgctgctcggttcgagtgcatcgctccagatcaccggtggtaccgcactgtcgacgttgggactcgcggcccaagcgagtgcgtccgtcgggaccgcggggtcggtcacactcgatggcaccgtcaccgccgtgaacaacgtccaagcgggtcagacggtcagccttgccgacggcaccggggggtcgatcacgatcggtatcggatcgttcggcctcagccagggcagcttcaccgctaccgaggtggcggccggcaacgggtcgctctcgcaggtggtgagcaacatcaatgccgctggcgccggtgtgacggcatcagcggtccaagtctcgagtggtacctacgtgctccagctggtctcgaaccaaacgggcaccgcatcggccatcaccgtcgaacaggcgcccttccagagtgccctcggtagcttcacgaccattgcagcggcacagaatgcccaggtccagatcggtggccagagtggttacctggtgagttctcagacgaaccaggtccagggcgtgttgcccggagtcacgctcaacttggtgtcggcgcagcctcccggctcggcgccggtcaccgtgagcgtcacccccgacggcaagacgctcgcctcgtccatccagtcgctcgtcaacgccgcaaaccaggtgctcagcgacatcaacacgtacgcgggctacaacgagcagaccaacaccggcggaccgctgatgggcgactcgacgctgaacgggatcacgagccaggtgctcggtgtcatcgctcagaccctcggcgaggggggcatcaccgccgcccaagccggcatcacgctgaacaagaacggtaccatcagcttcgacgcgcaaaccttcgcccagctctacgaccagaacccgaccgccgtcacgtcactattcgcccagtcgggcaccttcaacccatcgagttcgacctacgcaggcgacgtcagtctggtctacgcgggtgatggcacgcaagcgggctcctaccaggtcgtggtgagccagtcggccacccaggcgacggacagcgggtccgtgctcgcgagcggaacgatcaccaacgccgagacgctcaccgtcgcccagggttcgcagtcggtgcagtacgcagcgagcgcgggcgagtcgctcagcgccatcgcccagggcctcaatgccgcgttcgcccaggcaggcatggggatgcaggcctccgtggtgagctcgtcgtcgggttcgcagatcgtgctcaccgcgagtgcgtacgggacccagggcgacttcacggtgacgacgacggcgacgggatctgggcagaccgggctcgcaacgagcgcgaacacgccggagtcgttcaccggcttgaacgtcgccgggacgatcaatggtgtggcggcgaccgggaacggtcaggtcctcgccgcgccgacgacggaccccacgctcgccggcttgtcgctgcaggtgagtgcgagcgggatcacgagtgcgacgaccattggctcgttcgtgtattcgccagggatctcgggccagctcgccctcatcgccaacggcgccacagcacccgtgaccgggagcctcgaggcgcgcatgagcggtatccagcaacagatctcgatgctgcagcaacagtacaacggctatacgccgatgatccagaacgagcagaagatgctcgagcaggagtactccgcgatggagtcacagctcggctcgctccagagcgtgggctcggagctcgccgggcagattgcacagctgccgtagcgcccgccggacgggtgctgtcgacgacgaccaaggagggagaccgggtgccttcactggctcaacgcgcctacgtcgagaacgcggtggaaaccgcgacgccggcccagcgcctgctcatcctgttggaccgcctggaagcgaatctggtggccctcggtgacgcctttcgggtgcgtgacctcgaggcgatccacgtcaacgccaaggctgcccaggcagcgttggcgttgttgcgaggggcgcttcgcgaggacgtgtgggagcacgccgcgacgatcgcgaccttgtacacgtgggcgctggagcgactcgtccgagccaatgtggacaaagatccggctccctacgaggaggcccgctcggtgctcgagccgctcatcgcggcgtggcgacacgctgcgatggaggtctcgcatgagtgagcgcgatccgtgggaggagtacctggacgcgtacgcggagcacctcgcgcgcgtctcggcgagcctcgaggcgggccgggtgctcgagacgccgttcgatcgtgcgcgtccttccagcgcgatgccggcgcgtcacgctgagcgagcacgcgccctcgtggaggcgaccgaacagctcgcggcccgcctcgagcatcgtcgcgacgtggtcgggaccgtacttcggtactcgagagtccgcgaccccgagcgggtggtgctcctcgacgtgatcttgtgaggatgccatcgcttcggtttgcgtgactcggccgatctcggggacctgctcagacgctccacggggctgcttcctcgcgtgagctgacgcgagaactcacgggaagggactcgacggtgatcacggtgacgggacccaccaagcgcttcggagaggtgaccgcggtcgacggattgtcgttcgaggtgccgcccgggcgcgtgaccggattcctcggcccgaacggcgcgggcaagtcgaccacgatgcacatgatcatgggcctcgaaaggcccagtgcggggtccgctctcatcaagggcgtcccctacgccgagcttgccgcgccactgcggcaggtcggtgcgttgctcgaggcgaggtcgttccatccggggcgcagcgccagagcgcatcttgggtggctcgcggcctccaatggcttgcccgcccacggggtcaacgaggtgctcgagatcaccggactcaccgacgtcgcttcccgacgggccggcaccttctcgctcggcatgggcagcgtctcggcgtcgcggctgcgctcctcggtgatcccgaagtgctcatcctcgacgagcccgtgaacggactcgatcccgaggggattgtgtggatccggaccttactgcggggacttgctgctgaaggtcgaacggtgttcgtctcgagtcacctcatgtccgagatggctcagacggccgaccatgtcatcgtcatcggccgtggcaagctccttgccgacaccgcgatggcagcgttcatcgcatcgagttcgtccgcgagaacgctcgtacgcacaccgagcccagatgcgctcgcgtcgaccctgcgcgagcgcggcggggtcgtggtcgtcggcgacgacgggagtctcaccgtccggcctcgtggcagccgagatcggcgagatcgccttcgagcacgggatctgtctccatgaactgtcgccccagagtgcctcgctggaggaggcgttcttcgctcttacgggcgaggacacgagctttcgcggccagccggccacggttcacgaaggagcctcacgatgacgacgacggtcgaccgtagtccgagcacgctcggcccgacgttcgggcgctgctcgccgccgagtggatcaagatcaagagcgtgcgctcgacggtgctcacgctggtgttcatggtggtgctcggggtcgggatctcggcgctcggcgcgctcgccgtgcacgcagccgtgtcgcaccaccgcatcggccccggcttcgatccggtcgcgcgctcgctcggcgggatgctcatcgcgcagatcgccatcggtgtcctcggcgtcttggtcttcagcgctgaggtcgcgagcgggacgatcagccagacgttcgccgcggtccccaagcgctggcacgtgctgctggccaaggtactcgtctacttcgtgatcgcgctcgttgcctccgaagtagtgtccgtggcgagcttcctcgtgggccaggccgtcatgcacggagtcgtcccgacgaccagcctcacgaacgcgacggcgatgcgggccgtcctgggcaccgggcttctcgtcgcgatcgtgggtgtccttgcgctcgccatcggtgtcatgatccgtcgtactgctggggcgatcaccaccttcgtgggcgagtacctggtgctgcccttgctcgtgaccgcgctcccgtcgccgtactccaccgacatcgaaaagttcctgccgttccaagcagcccaggtcatgatgtcctcgcagctcgtcgcgaacagcttgtccgcgtgggtcggcctcgccgtcgtggcgggctacgccgtgatcgccgtcgtcgtcgcagggtcgctcctctcgtcgcgcgacgcctagacgcccggccatcgcgccccgcgcgaggcctgcagcttgccgcccgtgccgccttccatggaggggacacgggcggtcgtgcgtcgcgggtgcggctcaagaacacgtaagtactgatttaaccaaatcacgaaaagctcgatgattcggtttagggaaaccgtcacccgtaccgctaccgtggtgcccatcgcgttggggatgtgaggaacacgccgctcattcgagcatgaccgcgtcgaccaccagagggtgcgaggccgcggaaaacagcggggcgttggtcgacggccgctccgagccatgacgagcgagcgcacgagaggcgtaccgacacgagagaggaaagaggatggctggcaatcgctacgaggctggcgtcaaggagtaccgtaagacgtactgggcgccggactacgtgcccttggactccgacctgctcgcggtgttcaagatcgtaccgcagcctggtgtcgaccgggaggaggcagctgcggcggtcgccgccgagtcatccaccggtacctggaccacggtctggaccgacctgctcacggacctcgattactacaagggccgcgcctaccggatcgaggacgtgcccggggacgacacggcgttctacgcgttcgtcgcctacccgatcgacctcttcgaagagggctcggtcgtcaacgtcttcacatcgctggtcgggaacgtgttcggcttcaaggcggtgcgatcgctgcgcctcgaggacgtgcgcttccccttggccttcgtcaacacctgcaacgggccaccccacgggatccaggtcgagcgcgacaagatgaacaagtacggccggccgctgctcggctgcaccatcaagccgaagctcggcctgtcggccaagaactacgggcgtgccgtctacgaagtgctgcgcggtggtctcgactttaccaaggacgacgagaacgtcaactcccagccgttcatgcgctggcgcgaccggttcctcttcgtcgccgaggccatccatcaggccgaggcggagacgggcgagcgcaagggccactacctgaacgtcacggcaccctcgccagaggagatgtacgaacgcgcagagttcgccaaggaactcggcatgcccatcatcatgcacgacttcttgacgggtggtttcacggccaacacggggctcgcgcgctggtgccggcgcaacggcatgctgctccacatccaccgggccatgcatgccgtgatcgaccgcaatccgtaccacggcatccacttccgtgtgctggccaaggccttgcgtctctcgggcggtgaccacctgcacaccggaacggtggtcggcaagctcgagggcgaccgagcggcgacgcagggatgggtggacctcctccgcgagtcctacatccccgaggaccgtagccgcggcatcttcttcgatcaggactggggctcgatgccgggcgtcttcgccgtcgcctcgggcggtatccacgtgtggcacatgccgtcgttgctcaccatcttcggcgatgacgcggtcttccagttcggtggcggcaccctgggtcacccatgggggaacgcacccggcgcgaccgcgaaccgggtcgcactcgaggcgtgcgtccaggcgcgcaacgagggccgtgacgtcgaacgggaggggaaggacattctccagaacgcggccaagcacagtccggagctccgtgtggcgatggagacctggaaagagatcaagttcgagttcgacacggtggacaagctcgacagcgtgcatcgctgagcgagcgtggttcgacgaggtggcgcagcgtgcgccacctggacctaaggagcacacatggctgacgttcaggagtatcgcacgtcacggcgctacgagctgttctcgtacctgccccagatgaccccggagcagattcgcaagcaggtgctgtacctgatctcgaagggctggaacccgagcgtggagcacgtcgagccccatcgctcgatggagcgcttctggtacatgtggaagctgccgatgttcggcgagcagtcggcggaggtggtgctcgccgagctcgaggagtgccgccgtgcctaccccgatcacctcgtgcggctcgtgggctacgacaactacacccagagccagggcatcgcgttcgtggtgtaccgaggccaggggtcctgagcggctggcgctcctcgacgccgggaccagcgcgacctcgcggttcgcgcgaggtcgcgcggtggggccgtgaggctgaggcatgcgaagcaaggagatggcgacggtgcgcgcgagcgacgcgagcgagtcgccaagtaggtcgaggtcgtggtggtgacgaagggagggccccgagtgagcgagtcgtccacagccggcggggcggtgcgttctggccgcgcgttggcgcagcagcgtcggcgtgagcaagcgcttcgtcgcgcgaacgcacgaacgtcgccgaggcacgacgcagacgatcgttcgcttcgggtcgcaccgatggcgactgacccggtcgaggcgcggccgacgaccaccgagggtggctcgtgcgggtgcgaccacctcgagccgcccgtctccgcggtcgcgacgtcaagtgaactctcggtctcggtgcgcgggtatgtctcggtggatgatgcgctgcgtggcctgcgcggccgtgaggccgccaaggtgcgtcgccagctcctgtgcgtgcaggggcgaggcgatctggcggcgtgccgtccgacgggccggatgcgccgtcgcgacacggtggcgcccaaggtggaagagggcacgacccttgccggcaccagggtgaccggtacgcaggtcgagctcacggcgaccatgacgggtgcggatgcgggcagctgccgggtgatcagcggcacacagtacgtgggcatcgagcagttcgaggagcgctgcgacgaggtcccggaggcgcccccggccaaggtcagcgtcggacgcacggcggcagggcgccgcgtgagcggcacctccctcgcgccgagccccagcgtgacgggctccgaggcaggtgcgtgccggcgtgtcaccggcgtggactacctggaggcgaacgcggtcgaggaggcgtgtggcgtcgtccccgagccggcgccagccaaggtgacggtgggcgagacggtccagggccagcgtgtcacgggcgtcgtggtcgatcgtccagctgcggtcaccggtgacgacgtcggccggcgccagcgcgtgacgggcagccagtaccagcaccctgagtggattcgaggcgagtcccgcaatggttcgtcggtgccgcacaaggtgagcgtcatgagcacggtgcggggtcggccggtcaccggaaccatcgtgacgcccgatcccaccatcaccggggccgatcgcggggcgtgcgtcgaggtgacggggacggagtacgaggacagcttggccaagtaccaggcgtgcaatcggcaaccggcacctggtccgcacaaggtgagtgtgatgcggacctggcgcggggaagtcgtgaccggaaccagcgtcgagcacgacccgcgggtcaccggtgacgaggccgggcagtgcgaggacgtgaccggcacgccctacgtgggaccaggccagtacgaggccgtctgcgcgaccgatccggttcgccagggcgctcctggtggatcgtcgatcgcgatctcgggaacgcgtgtcagtgggagcgatcgtgtgacgggggacgagcgtggccgttccgtcaccgtgagcgggactccgtaccagcgtgggccctctggcgatgccgagcgcggcgtgagcgcgtggggggcgacgttcagcatcaccacgccagcacgtgctgcgcgtgaacgggcgcgggcgcgcgtcaccggcaccggctaccagcgcggtacggctcggatcacggggccactcgacctcgccctcggtcttgtctcgggtacgccagagtttcgctatcacgccggctcggacgccgaacagcaggtgcccgctcgcgaggcggccgtcacgggagaggggcgcgaggagggctttgccatcaccggcgatgcctgggatcgttcggccaccatcaccgggacagaaggggcctccgcatggcgcaatccgacgttgcggggaacccctcgtcggcgcgagcaggtggccagaagcgccgaccagcgggcagcggcagctcgcgagctccccgccagcgcccgcatcaccggcagcaccggtggcgtgagcgaggggccggtcgtgacgttctcgggcgggtcgcgcggatgatcttcctccagatgaagcggacggtcccatgaacacgcgcaatcgccgggggcgctacggcgggccgactccgtcgcatggcccctacgggctgggtacggcgcaaggacgtctgtcgggccaggacgcgcatcgcgaccacggcgaagcggccggggtcagccgtcgctcgaggaacgcgcatccactcaccgatcacgccgccaacgagcgacttgctcgattcgaacgcctcgtgcgagggcggttcgacgcggtggtaccgacactgaaggcgatcggaacgcttgctccgaccgacgacctcgccgaacgtgctgcgtcgatggctcgggccgagctcggtgtggcgttgccggcagagctgttcgagtctgcctggatcacgggtctcgacatgcgccgcctgtacgcggtcacgatggcagagaccatccatgcggtcgcggccgagacgcatgcgttcgccggcaccgagtcggacaccatgaccggtttcctgctcgagtgcggcttccacgccgtcgacatctcgccctgctccgatgggcggctgaagggtgtcattcgctcgatcctgcgcctgccggacgacgccgtgcgcagtcgcaaggcctacgcgggcgccatgttcgacgtcgaagcgaacgttcgccggtggatcgagacggagctgctgcgctttcgcgaggggagtcccgtgccgccgtcggccgggacgcggtatctgaagatcgcggtctatcactggagcaggtcggatcccgattacgaggggtgcgcggcgcacggctccgaccagcgggccgccgccgcggcagcactgtcgcgcctccgcgagcttcgcgaagccgtcgagaacagcttcttctgcggcgcctccatcgatctgttgttgatcggcgtcgacacggacaccgatgccatccgcgttcacgtccccgatgcgctcggcgacatggacctcgatcgctacgtggacaacctcgatctctatcgccagaccatcgacgatgacgtgacgacggcgcgcatgcgcgtgcatcgcgccatcgaagctgcgagcgccgatcaccctggcgggccgccgcacgagggcatgcgacggctcattgcgacgctgctcatcaacaacctgtcgcagatcgactacgtccgatcgacctggggcgagcgctacccggacgtcggccacgccgaggccttcatcagcgtcggtgacggcttcgaggagttccaggttcgcaacctcgcctacttcgtcttcctccagacggtcgaggaggcggcgaccgacctcgacgtgggcatcgggctgttccagcgtcggcccgagcgccgtgggttgccgatcccgatcgcgatccactttcgctacgaccgtcgggtcccgggcagtcgggagcgagccatcgagcggtgcgtgcgcgtgcgctcggcgatccgagcgcgctatcgagatctgtgcgcggccgggctgctcgcgtgcgacatgagcatccaggagcgaaccttctcgagcccgatcgaggtgatcgaagcgccgagtgacggtccggcgaacgaggatccgctgcgcctcgagcagcgtacggggcgagaggggggcaggcgatgaaggtctaccaagtcgagaagacgctcgtgtccaccaatcgcatccccggtctcaagaatctcccgctgctcgtggtgcgcgagcgcaacggctcccagagcgtggcggtcgacgcggtcggctgcgtccctggcgactgggtcatctgcgtcagcggatcgggcagtcgggcggcgacgggagacaaggactatccgaccgacctcaccatcgtcggcatcatcgactactgggacgaggacggctagcgacgagctgccggtgcgatgcgtcggcagcaatggggcttcctgggcgtgcgagcgcacgaccagggcgcaagggcaggggccacaggcgtatgggcaaggggcccgagcaaggaggaacgatggcaacaggggtgagcggcatcgcgctcggcatgatcgagactcgcggtctcgtgccggcgatcgaggcagcggacgcgatgacgaaggcggcggaggtgcgcctcgtcggtcgtcagttcgtcggtggcggctacgtcacggtgttggttcggggtgagaccggcgcggtgaacgcagccgtgcgtgcgggtgcggacgcgtgcgagcgggtcggcgacggcctcgtggcggcacacatcatcgctcgggtgcactccgaggtggagaagatccttcctgacggcgaggacatggccgccggggcgtagggaagaggcgagaagggagcgttgacgatggcaacaggggtgagcggcatcgcgctcggcatgatcgagactcgcggtctcgtgccggcgatcgaggcagcggacgcgatgacgaaggcggcggaggtgcgcctcgtcggtcgtcagttcgtcggtggcggctacgtcacggtgttggttcggggtgagaccggcgcggtgaacgcagccgtgcgtgcgggtgcggacgcgtgcgagcgggtcggcgacggcctcgtggcggcacacatcatcgctcgggtgcactccgaggtggagaagatccttcctgacggcgaggacatgggcgctggggcgtagggaagaggcgagaagggagcgttgacgatggcaacaggggtgagcggcatcgcgctcggcatgatcgagactcgcggtctcgtgccggcgatcgaggcagcggacgcgatgacgaaggcggcggaggtgcgcctcgtcggtcgtcagttcgtcggtggcggctacgtcacggtgttggttcggggtgagaccggcgcggtgaacgcagccgtgcgtgcgggtgcggacgcgtgcgagcgggtcggcgacggcctcgtggcggcacacatcatcgctcgggtgcactccgaggtggagaagatccttcctgacggcgaggacatgggcgctggcagcgtggcggcgcgctaggcggtcgaggtgacccaggaccacaggctggccggctttgtcgtgcgcgcgttgcgtgcagagatcatcgcggtcgagcactacctcgcacaggcgagcctggtggaactgtggggctaccccgcgttggccgatcgcttctcgaacgatgcgcgtgacgaactcgatcaccagcaccggattctccggcacgcggtgtcggtgggcatcgcgccacgcgccatcgacctgccgccactacggtttggacggagcgtggaggagctcgtaatgatggaccgggcattcgagctcgacgtcgttcgactctacggcgaggcggtcgactactgcgggcggatgggcccggcctcgagtctcgagctcttcgccgggctctacggggaggaggtcgagcacctggcgtcgatcgacgccctgatcgttgagatccgatccgagaggagggggcgggatcgtggctgaggccgccgcgccacgatcctggcgcttcgtgttcgacgactacgcaaccctgcggcgcttcctcgatgagctcgcgtcgatcttcgaggagcatgggtactaccccaaccagagcttccatcgcgccgacgtcaccatcaccatcgatcccgcgagtgccaacggcaacgaccagggcgttcgggcggtcgaagccgctctcgatgcgttcgtggcccgtggggtggggcaggcagatgaccagcggtcctgacgcgagtgattcgagcctcgtggtcgcggtggtgaacgccaagggcggatcgggcaagacgacgctcgcgctgcacgtgggcgtcggtcttgcgaggcgcggccccacgctcctcgtcgatgcggatccgcagcggtcgctgaccttctggacggcgatggcacctcctcgagctgcgttgccaccggtagcggaggcctcgcgggacgtggtgaccgtgctgcgcgctgcgcgggcggactaccgctacgtcgtggtcgactgtccaccgacgccgatccgaggcaccgtgcgtgccatcgtcgaggtcgccgatcgtgtggtggtcccgatcctcgcatctccggtcgatctgtggacgagtgcggagacgttctggtcgttgcgcaggctcgcgactggggaccgtgcgcgtcggttcgtcggtgtgctcaatcaggtcgagccgcggagcgcgctgtcggcgtccgttcggcgcgcggcgctcgcactcgatgtgccgctcaccgccgtcgcgctgggccggcgtgtcgtctaccgacaggcggcggccgaggggcggagcgtgtacgcgatgggcaagcgagcgatggcagcgatcgaggagatcgaggccctcatccaggaggtggtgtgatggcagaggacttgagtgatcgcttggtgcgggaggtgagccaggtccgtgcgatccgagccaagcagacaagcgcgtcgaagggggcaagcgtcgccggctcagaaccgacggcgcgagccaccgaacctgccaagccccgacccagacggcgtgcctcctcgactgtcgagcgcgaggtcacgcctccggccgacggcgaggccgtcgaacaaccggtggcgcgccctcggacgagacgtcctccacttgccgtgtggcctgactgatgcggatcgcggggcggtgctcgtgacggtcgggccgacactgtctcaccgaggagcaccgtttcaccgagcaataccgtctcgccgaggaaaggagtgagtcgtggtcgcaccccaagttgcgccctacgtcatcgacacggagccctactaccgaccggtcgcgaacgagatcgcgctcttcgaagccgcgtactcggtgcggatgcccgtcatgttgaagggcccgaccgggtcgggcaagacgcgcttcgtcgagtacatggcctggcgccttggcaagccgctcatcaccgtcgcgtgcaacgaggacatgacggcctcggacctcgtcggacgcttcttgctcgacgccggtggcacccggtggcaggacggaccgctcacgatcgcggcccgctacggggcgctgtgctacctcgacgagatcgtcgaggcgcgccaggacacgaccgtggtcatccacccgctcaccgacgctcgccgagtcctgccgctcgacaagaagggcgagctggtccaggctcaccctgacttccaggtggtgatctcctacaaccctggctaccagagtgtcatgaaggacctgaagcagtcgacgaagcagcggttcggcgccttggacttcacctatccacccgcggccatcgagacggagatcgtcgcccacgagagcggggtcggccacgacgatgcgagtcgcctcgtctccatcgccgagcgcgcgcgcaacctcaagggacacgggctcgacgagggcatctcgacccgcatgctgatctacgcggccagtctgatcgcccagggcgtcgatcgcatcgccgcatgcgagatggcgctcgtgtcgccgatcaccgacgaccccgacatgcgtgacgcgctcgaggcggcggtcacgacctacttctaggagggccctcccgtggccatcgagctcgagcgctaccaggggctcctcgactctctcggctcgcaagccgaggaggtgctgcgtgctgcctgggacgaagcgacgcgctccttcagcccacgcggcctcgaggaggtctacctccgctcggccgcgagcctcgcggcgctcgggcgtgggagcgacctcgtggtctcgttcctgcagcatgcccccgcgctggcgcgtgagctcggcgaggacgccgtgcgggatctggtcgcggcctcggtggcgttcttctcgaagaccagcgccagcgtgatcgcggagctgatcgcgacgagccctcgggcggccgagcgcctcggggacctggaactgttccgctcgtacctcgggctcatcgaccagctcctcgggctggccccccgtggcgttcgcggcctcctcgaccacctcgacgtcctgcttgcgcagctgaccctgagcgggttgacgcgctgggccctctggggtgcccaagtccacaaggtcgacttcgaggcccagcagcgctacttcgcactcgagagccccgatgcgctcgccatgctccagcagcagcgtcggggactgctgttcgtcgacgtccagcgtcgcttgcaggcctacctgcgcgccctgtggggccgcgacttcttccttcgacccgagtcggccgatccgcagacggccgcggtggtacgaccgttcatcgatggattcgtcgtccacctccccgacgcctacgacgacacggacggggtcggtgggccgatcagcgcgctcgagcagtaccgtgccgcggcggcgcacgccgctgcgcaccaggtggcgaccacacacgccgtggctcgagccgagcgatcgcgtctcgaggaactcgtcgtcgggatcctcgaggatgcacgcgtcgagcgcgcagcgatcgcggccttcccagggctcgccgcgctctgggcgcgcttccacgtcgtcgatctcgccgccgacgacccctcctcgctcgtcgcgcggctcgttcgctctctcctcgtcggctgcgataccgaggctcatccgtgggtccgtgaggcgtgcgagcacgctcgggtgctcgacgagttgggcggtgccgaggcagcggcagctctcccggagcttgctcgaaccctcatcgacgccgcacgccgcttcggtgtcgagctcgaccaggtcgactcgcgagccgtcctgccgagctaccgcgacgacaatcgctacgtcttcgagcgcgacgaagccattcgcgcccaggccgccaacctcgatctcgcgccctcgcaggtgcgcaagtacgtgagcgtgatggagatgatcaacgaggtggacgtgccgagcgccggcgacgacgccgaggagatctgggtgctcgcgaccgagttcttccgtgacggcgaggccgagagcgtcaacgcccaagagggtcgggagccgccgcccgtcgaggtgcactatcccgagtgggactaccaggtccaactggagcgaccgagctggacgaccgtgctcgagcgacgaggacccttgggcagcctggaggaggccgaggcgatcctcgccaagcatcgccccttgctcgggcggatgcggcgcatcatggaggcgctcgcccccgagggtgtccagcgcctgcgcaagcaggaagagggcgaggaactcgacatcaacgcggcggtcgatttcgcagtcgacctgcgacgggccgaggagcccgacctcagggtgatggtgaggacacggcgcatcgtccgtgaccttgccttcttgctgctcatcgacacgtccgagtcgacgaacgatcaggtgctcggcgcggacgtgacggtgatcgagctcgctcgagaggcgaccttgttgctcgcagaatcgatcaatcgggtcggggatccgttcgcggtccacgggttcgactccaacggtcgccatgccgtcgagtacgttcgctacaaggacttcgatgagcgcttcggcgacgaggcgcgcgctcgtgtggccggcatgaccggccaactgtcgacgaggatgggcgcggcgattcggcatgcgggtgcccatctcgcacgccagccccagcgtcggcgactgctgctcgtgctcaccgacggcgagcccgccgacaacgacgtgcgcgatccgcagtacctgcgtgcggatgcacgccgagccgtcgaggagctggctcgcgctggtatctcgacgttctgcctgagcctcgatcctcgcgcggaccagtacgtcgcgcgcatcttcggcccgaccggcttcatcgtgctcgacaacgtggcgcgactcccggaacgtctgccgctgctgtacgcggccctcacgcgctcgtgagcaacacgtaagtctttacttgacgaacatcgctttcaaatgagctttcgcatagcggaagtgtatttccggtctagtagattctcttttcatgaggagcacgccgaccgagcgccttcacggtgatggtcggctgcaggcttctgctcggcaccgggtcggtgcggcgagcggtggtgaggtgcgccccgcggtcgcgttcttacggtgtccgtggccgtggcggcccctcgcggggctcgaggggagaagggatcaagcatggggaacctggtgagttcgtggttgctcgcggtcgcggtggtcgcctacctggtggtgggtctcggtctcctggtcgcgcggggcgcggccggacgcagtgcgcgacggtggacgacggtggcgtcgtgggtcgggctcgtcgccacgctcggcgcctcgacggcgttcgtcgtcggccacgaacgatcgaccacgctggtcgcggtgccgttgcccgcacacctcgggcacgtcgccgtcgattcgctcgtgaacgccctcaccatgatcgtcgtcaccttggtggcgttcgtgggcaccgtggtcgtacgctactcgacgtcctatctccgtgacgaccccgctgagctgcggttctatcgctggttgaacgtgacgctcggcttgttcctgtggctgatcgtcaccaacgacgtgtggacgttctggctgctgttcgtcggtgcgagtctgtcgctccacgagctgctcgtgctctatcgcgatcgaccgctggccgtcacggcggcgcgcaagaacttcgcgctcgccagactcgcggacgtgagtctggcggttgcgctggtgctcgtcgtggaggcgacggggcgctcgagcttcgccggcatcgcggcgtggttccacggggcgcaccccccgatcggcgtcgatctcgaggtcgccgccgggctgatcgctctgaccgcggtcgtcaagagcggtgtcttcccgttccacgggtggctgatccaggtcatggaggcgccgacccaggtctcggcgctcctgcacgcggggctcatctacacgggtgccttcctcctcctgcgcatgagctggctggtcgcgtcggtgccgtgggtgtgggtggtgctcagcctcgccgtgatcggggtgttcgtgtcgtcgctgatgatgctcaccgagacgaacatcaaggaggcgctcgcgtactcgacctccgcccaacttgcgttcatgatgatggagtgtgggctcgggctctacagcgtcgcggtgctccacatcgtcgcacactcggtctacaaggcgcatgcattcctctcgtcgggaagcgtggtggatggccatcggggcgcgatcctcaccaaggtcccggcgcgtcgaacgttcgggcaggtcgagggcgcgctcgctatctccgcgctcgtcaccgtggggatcgccgagctcctccgggtcgacgtggtgcacgagcccacgttggccgccatcggcttcgtggtcgcggtcgccatgacgcagctgctgctgcagggggtcggggggtcagaccgtcagggacgtcgcttgctcgtgcgcgcgagcggcttcagtgtgctcgtgggtgctgcctacttcggtctgcacgacgtcatggtgcgcctgctcggctccacggtgccgtccgagagcggccaggcggaccacatcccggggtgggtgctcgtcgtggtcgtggcggcgttcgtcgccttgctccacatcggccagttcctcggtccactcagccggacccgcttcggccagtggctctacgtggcgctgtggaacggtctgtgggtggatgccgccatgcgtcgcctcgcgtggttcgaccacctgcgcctcggtcatcgtccgctgcacgcccctaccgagcctgagcctgttgcggcgacgggcgatgagcccgtgcccggatcggcggcctcggtgctggaggccgcgcgcgtggcgtgcgaccggatcgcgccggtgtggccgctccggcacttcgtcgccgtgaacccctacttcggcatgcgcgacctgtcgttctgggaggccgaccgctacctccagaccatcgcaggttctcgcctggtcatgccgctcgcctactaccgagagcagctgcaacaaggacgcatcggtccacgcgatatccgtgacgcagcgcgtcgccttgggcgcgagggggcggtcgagggcctgctcgctcgcctggaggaggctcgtagtgagccgctgctccctcggctcccgctcttcagcgatcacctcgggcgccttcgcggtcgggacatcaccacggccatcgtcgagcggctcagccatttcctggcggcctacttcgacgaggggcaagccacctggcaccttccgtggcaggggaactcgttgtggcaggcgtggcggtcatcggtccaggtcgacgcgacgccgcgcatcctcggactcccgtggcccaagtcggcgctcgcggccctgcccgagacgcccgaggacgccatcgccgctgcgctgggcgtgctcggcgttgctcacgaagcgatcgaggactacttggtcgctgcgttgttctccatcggcgggtgggcgtcgtgggcacggtaccgacggtggcaggcggagctcgtcggctcgaccgacgaaaccctgttcgaactgctggcgatccacgtctcggccgaggcgatcctcgcccagggacttgatgatcctcgggtgctcgcctcgtggcgcgacgccgtcgtggcagcccatcggtcctgggtcgcctcgcggcacgatccgctcgacgacgccgcgatcatccacaccgcgttcgagctgcactatcggcgccggctcgcgcggacgctggctgccggtgctcgcgccggggaggcgcccaccggggagcgtcctcgcgcccagctcgccttctgcatcgacgtgcgctcggagggcatccgtcgcgccgtcgaggcccgcgtcgctggcgcccagacgctcggcttcgccggcttcttcggcgttcagatggagtacgtccccttcggtaccgagcacgcacgcgcacacctgccggtcatctttgcgccgccctatcggatccgcgaggacctcgtcgatgcctccgacgacgaccgtgcgcgtgcggcggagcgacgtcgccttcggctcggcgccggcgcggtctggaagaccttcaagtcctcggcggcctccaccttcaccttcgtcgagtcgaccgggttggtctatatcccgaagctcttcggcgacgccatgggctggtcccgcacggtcgcgcaccccgacgcccgaggtctcgctggcgacctgcgcgcccggctgcgcccgaggctgacgccgatcggtcatcccgggggcaacgacgggatccccgaggatcgtctcgccgagatcggtcgcttcatcctcacctcgatgggcctcaccggcgggttcgcgccgctcgtggtcctggtggggcatgggagcgagaccgtcaacaacccgcaaggatccgggctcgactgcggtgcctgcggggggcagacgggcgaggtgagcgcgaaggtggcggcggcgttgctcaacgatccgcgaacccgagcaggcctcgaacgcgtggggatctcggtgccgagcgacacggtgttcgtcgcggcgctccactccacgttgacggagcaggtgaggctcttcgacgtcgacgcgctcgatcccgcccatcgcacgctcgcccgcgacctcgagaccgatctcgccagcgcgacccggctcgccgcgacgtggcatgcgacctccctcggtgtgaccgccgaccaggatctggcgcacgacctggcgcgtcgtggccgcgactgggcggaggttcggccggagtggggcctcgtcgccaacgccgccttcatcgcggctccacgcgcaaggaccgcccacgtctcgctcgagggccgcgcgttcctccacgactacgactggcgccacgacacggactttgcgaccctcacgctcatcatgaccgctccgatggtggtcgcgaactggatcaacctgcagtactacgcctcgatggtcgacaaccggcgcttcgggagcggaacgaaggtcctccacaacgtcgtcggtggttcgatcggagtcctcgagggcaacaacggcgatctgcgggtcggcctcgcgctgcagtcattgcacgacgggacacgctggctccacgagcccgtgcgcctcaccgtggtggtggaggcgcctcggggcgcgatcgaccaggtcgtccgggaacaccagctcgttgccgacctcgtcgagcacggctggctggtcgtgacccaactcgaacccgacggcactctctacgaacgcgagggcgatggccgttggcgcgcggtcatcgacgacgattcgttggcagcgaccagcgttcgctgacggcacggcgagcgcgagcggcctcgctcggcggccacctggaccgttcgcggtgtcggtggctgctcgtggtccgtggcctcgctcggcgatccgtgctcaaggtcgtcggcgttcgctccgagatcagtggcagccgcaggatgcgagctaccgctgatccaaggagggcgtgacccgcacggggaggactccgcgtgagcacgaccgtcgaggcgttgagctttgcgctcgacgcgctccagatccagagcgacgccatcgccaacaacgtggccaacgtcgacacgcctggctacatccagtcgaacgtgtcgttccagtcgtcgctcgccgctgcgctcgccaacggtggcacggccaccaccagcgtgaccccatcgtcgaaccccgtgggactcaacggcaacaacgtctcgctcggccaggagctgacccaggcgaccaccaacgccatggactaccaggcagtctcgaacgagctgacgacgtacttccaaatcttgtcgggttcgatgggaggccagttctaagtgtcgctgtttccagccatcgacgtcgctgccaccggcgtgacgaccgagcaaacctggctcgacaccatcgcgtccaacgtggcgaacgtcaacgaccagtcggccacgaaccaaccgatctatcaggagcaagaggtgctcgtgcagcccgtggagacgtcgccggtgacgggcgtcgcggacacgaccacgacgcccgtcggttcgggcgtccaggtcgacgccatcgtcaccccgttgcccaacggggtgctctcctacgatccgacctcgacgctcgcgaacgcgcagggctacgtgaagacgcccgggatctcgctcgcccagcagctcgggaacctcgtcaacgctcaaacctcctaccaggccaacgtcgcggtgatcaaccaggccaagacggcctacgaggcgatcctcgggatccaggcatgatccccccgatcgcacccctgtcgtcagcgctgtcggcggcggcgccgggtgctgcgggagcgtccacgcagggcgcgagcggctttgcccaggtgctcggatcggtcatcgaccagatccaatccacccaagcgacggccaacacccaagcgcaaggcgtcgccagcggccaagcgtcgatctcgaacgcgatggtcgcctccaccgagtcgctgttgaccaccgaacttgcggtccaggtgcgtaacggcgtcgtcggcgccatcgaccaggtcatgtcgacgcagttctaggaggcgtactcgtggcatcccaggacctcctcgccaaggcgcgcgactcgctccggcgcttcgcgagcggcttcaccaccggccagaaggccgtggtcatggtcggcatcgcactggtcgtcgcgatcgcggttgcgctggcatcgctcacgtcgagcccgagctacggcgtgttgttctcgggcctgtcggcccaagatgccggctcgatcaccgcgaagctccagtcggcgggggttccctacgagctcacgaacggcggtacgacggtgctcgttccccagaacctcgtcgaccaggagcgggtctcgctggccgaggccgggcttccgtcccagaccgcggggctgacgtcgctgaacggcctgtccatcacgagctcgcagatcacccagcaggccgattaccaggcggcactgcagtcgcagctcgctcagaccatcgaggcgatcaacggcgtgcagtcggcacaggtgaacctcgccctgccgccgacggacgccttcgcgatcggtcagtcgtctcagccgagtgcctccgtgatcgtgacgctggacgcgggcgtgtcgctcacgtcccagcaggtcgaagcgatcgtccacctggtggcgagcgccattccggggatgaacgccaacgacgtgacggtggccgaccagaacggtgacgtgttggcagcgccgggtctcggcgtcaacgcccagggcgccggtcagtcggcgcagggcttcgactctcagctcgaggcgtcgatccagtcgatgctcgacacgatcgtcggccccggcaacgcgaacgtccgcgtcgcggccacgctgtcgacgaaccaggtcacgacgaagacccagtcgatccagacgcagaagggcaagcccctcaccacgccgacccagacccagacccagacccagaccttcaccgggaacggcaccgtgccgggcggcacgctcggcaccactgggatcgcgaccaccggcaaccaggtgtcgacctacaagcagacctcctccacgacgcagtacgcgatcggtcaggtcacccagacggtccagcaggcaccgggcgcgatccaacgactcagcgtggcggtggcggtcaactcgcacgtcaagggtctctcgttggcgaagctgcgccaggtcgtcgcggccgcagccgggatcgtaccggcacgtggcgacacgctctcggtcgtcgcggtgccgttccccgcgctggcgacgacgccgtcgggtgcggggtcgtcgctcttcgggtcgatcctcggcatcgcgaaggtggtcctgctcgtgctgggagcgctcggtgcgatcttgctcatgtcccgtgcagcggcgcggaccgaggtcgagccgttgttcccggctgagctcgagcctgctctcgcgggaacgggtggccagctcgccggacccaccgaggaactgcccgcggtcgccttgccccagagccagccggtcgtcggcgaggacgtgctcgactacatcgatcgccagcccgaggacgtcgcgaagctcttgcgggtgtggatgacggcgcggggtcgcaaatgagcacgaaggtcgccgacctcaccggcacccagaaggcggccgcagtgttggtgcagctcgggacgactctcgctgcgcgcgtgcttcgtcagatgagcgagtcggaggcggtcgccctcacgctcgagatcgccaagctgccgagcctcgacaaggagaccatcaccgaggtgatggccgagttcgtcgactcggtcatcgcactcaagaccgtcggtcaaggtggcgtcgacacggccaaggagatcctcgcggcccgcctcggcgatcgtgaggctgaagagatcctcgcccagttcaccggtcagagcgtgtcgaacccgctggccttcctcgaccacgtcgagccgttccagctggtcagcttcctctcgagcgagcacccccagtcggtggcgatcatcctcgccaacgtccctccagacctcgctgcccaggtgctggctgcgatgcccgaggagccgcgcgcggaggtcacccgccgtatcgccctcctgtcgcgtgtcgacccggtcgtcgtcgagcaggcggcctccgtgctccagcgcaagctagccggcctgacgaagcaggggccggtcgccctgcgcagtgggctcgccacggtggtcgagatcttgaacaacgtcgaccagagcacggagcgacgcatcctgtcggacctcgactcgctcgaccccgaactcgccgatcgcatccgtgagcagatgttcgtgttcgaggacatcatggtgctcgacgaccggaccctccaacgcatcttgcgtcaggtgtcgccgaaggacctcgccgtggcgctcaagggcgtctcgcccgagttggtgaaccgcatcatggcgaacatctccgagcgcgccgcggaggatctcgccgaggagatcgagctgctcggccccgtgcgcctctcgacggtcgaggctgcccaggcacagatcttgcgtgccgtccgcgagctcgaggcggcgggcgagatcacgattgcccggtccgacgaggagctcgtccagtgagcgccgcacggatcctgcggggcacgctcgacggcgtcgggacggtggcgctcccaccggtggagcatcttcgtgccggtgacgccgagcacatcgcccttgcgcacgccatcgaggaggccgagcgccgaggcgaggagcgcggtcgtgccgccggtgaggcggccgcacgtcagctcctcgaggccgagcgggcggcgctggcctcgacgcgcgaggcccttgcctccgtcctccggcggctcgagcgcatcggtcgcgagtcgctcgaggccgacgtcgtcgaggtcgtcaccctcgcgctcgagctcgctcgcgaggtgctcgcggccgaggtggtgcctccccgggagcggatcgaggcgtgggtggggcgagtgctcgccgagcgtgacgtcgaggagctcaccgtccgcctggcaccgcccgcgagcgaggacctcgccgacaccctcgtcgagttggccgagcgcgaaggcgcgaggctccgggtcgagcgcgatgtgtcgctcgagccctacgacgtcgtcgtggagctgggcgcgggcgtcctcgacctcacggtcaagggagcgttcgagcgtgtcctccaggagttgcgggagctcggacagtgatccctgcccgtgtgcgcgaccaggtcctgcgtgccgctgcgccggttcgccagggccgcgtctcgcggatcgtcgggatccacctcgaggtcgagggcgtggaggcaggcatcggcgaagcggtgcgcatcgagctcggaggcggccagagcctggtcgccgaggtggtgggcttcgagggcgagcgactcgtctgcatgccgctgcgcgaggtccgaggggtgcgctacggcgatcgcgcggtggccttgcgccgcgcgacccagatcccggtgggtcgagcgctgctcggccgcgtgatcgacgccgatggggtgccgatcgatggccagggcccggtcgaacccgacgatgtggtgggcctcgagctggcggcaccgatgcccatggagcggacgctcatcgacgagcagctcggtctcggtgtgcgcgtgctcgacaccatggtcccctgtggtgtgggccagcgtctcggggtgttcgcgggagcgggtgtcggcaagagctcgttgctctcgatggtggtgcgcggtgcggacgtcgacgtgcgggtcgtcgcgctggtcggggagcgcgggcgcgaggtgcgagaattcctcgagcacgacctcggaccggaggggatggcacgctcggtcgtggtcgtcgcgacctccgacgagccgccactcgtgcgtgtgcgagcagccatcgcggcgactcggatcgcggagtggttccgcgccagcggggcgcgcgtcttgttggtgatggattcgctcactcgcttggcgctcgcacaacgcgagctcggactgtcggcgggggaaccgccgagcgtgcgtggctatccgccgagtgtgttccgcctgatggcccagctcctcgagcgtgcaggcaccgatcacgtcggctcgatcacggggatctactccgtgctcgtcgaaggtgacgacctcgacgatccgatcgccgacgcggctcgctcggtgttggacggtcacatcgtgttgtcgcgccagctcgccaatcgcggccgatatccggcggtcgacgtcttggcgtcgctgtcgcggttggagtcgtccatcctccccgacgatcgacgaaggctcatgcaggcggctcgccgacatctcgccgtcctcgacgaggtgcgcgatctggtggatctcggtgcctaccaagcgggaacgagcatggaggtcgacgaagcgctcgaggtggtgccgcggatcgagaccgtcttcggccaggacatctcggagcgctccgatccgaacgacgcctggtcgcgcctggccggtgcactgggggtgaacgcatgagcgaggagcgtcggatcagagcactcggtctcttgcgtaggatcgagcgactggagcgctggaaggccgtcggggcggtcgccgcagcacagcgcgcgtggggatcggcaagggccgaccgcatcgcccatgtcgccgccatcgatcaggacctgcccctcacgctccatgcctggcatctccaggccgccgtctgggcgggcgagcaggccgtagacgccgctgcccgacgtgcgacgtcggagcgttggctgcgcgccagtgagcttcgagagcggagtctcgctcgactcgaggccgaggcgcttcggcggcgccggagccacctcgaacgtgcgcgcctcgccgatctgctcgatcgtgtggtgtcgacgccgaggggagacggaccatgaccatggcgatccagagtgcggctccgcccgccgtggccgccatcgagcagctcgccagcaccctgtcagcggccgcgagcgcgcagggcgtcgcctcgttcgagtcgacgctcgccgcagcgctccaagccgagggccaggtgatctcggggaccgggaagagccagagcccaggatcggtgacgggggtggcccagcagccgagcgcgagcgtcgtgccgacgtcgaacgcaccggtcgacccgttcgctggtctcaccccggtgcccccgacgccaacggcccagaccctcgtctcgacggggggctcggcctccgagcgtgcgacggcgctcgcggccgcgaccggtgagatcggcgtaccgtacgtgtggggcggatcgtcgccggcgacggggttcgactgctcgggcctcgtccagtgggcgtacgctcaggcaggagtcgagctccctcgtacggctgccgagcagcagaccgtggggacgctcgttccctcgctcgccgcggcccagcctggagacttggtcttctatgggaacccggcctatcacgtcgcgatctatgccgggaacggcatggtggtgcaggcaccgatgaccggtgagaacgtcgagctcgccccggtcggtacgccgacggagattcgtgacccgacggccgtcgcaccgcagccgacggtgagtagtgccgtcgcgacgccgagcgacctcacggcgacgttccaggctgcgagtgcggcctatggcctgcccacagggatgctcgaggcggttgccgagaccgagtccaacttcaacccgaacgccgtgtcgtctgcaggcgcggaggggatcatgcagctcatgccccagacggcggcctcgctcggggtcaaccccttcgaccccacccaggccatctggggcgctgccaagctgctcgcgggcaagctcgcccacttcggttccgtgccgctcgcgctggctgcctacaacgcgggagacggcgcggtggaggcctacggcggtattccgccctacgcacagacgcagaactacgtccgcacggtgctctcgctgatgggaggtgaggccgatggctccggtcagagcactgccagcgcgtgagccgtcgacgggatcggcggtcgcgtcgtcgagtgcgagtccgtccgagtccgtcgcgggtgggttcgcggcgctcctcgcggccgcatcggaggtgggcatgccccaggcgaccgagaccccgacacgtgggggttcctcgggtcactcgtccgatgtcgagcacgggggggtaggaccggaggcgcgaggacgcgggcacgctgcggtgagggccgaaatcggtgcccctggcgaggcgagcaatgccagcacacgacacacgacccatcccgagggatcggaggcgaccgtgtcggcggctcgagcagccgtcgagggcgccatcctcgccgaaccggctggtgcggtgcggacgcacgcagcgtcgaacccgaagccagagcccgcgagcgcttctgcgtcactcgcgctcgttgctcaagctggcgtcgtcggggccacaggcgtcggcgccgaagccatccgggccgaagccatccgggccgaagccgtccgggtggcagcctctcccgcgcgtgcgccctcgctcgaggtcgctccggccgccgatgctcgtcgtggcgagcctgccggggcgccagcgagcgccaacacgaacgctcgacccgatggggcacctccgcacgacgctgggtcgctggtgtcgcaggacgtggtgtggccaagcgctgggccgcttgcggcggcggtcgctggtgccgagggatcgggcagcgcgcccatggccgtgtcggcgccgacgacggacgcccccgcagcgctgtccagcgccgtggccgctgccccccgagcgcacggcacgcgcgagcccgcgatcgccctcggcaccgccgacggcagagccggatcgagcatcgcctccgacttgcaagcggtcgggcgggcgccgaccgccgaagctgccggccagacgacggtcgcttcgaccggagcgagcggtgcggtctgggcggcgacgagcgtcgagctcggctccttcgtggtcgatggcgatgtgatcggaccgcccgtcgagccctcggcggtgccggcgatggtggacgggctggcacgcgctggcggtgcccaccgcgtcgtggtggtcttgtcgccgcccgagctcggtcgtctgcgcatcgtcgtgagcgaggcaccgggcgggaccgcggtgcaactgcaggtcgagaggccggccactcaggcgctcatcgagcacgcgctgggcggatatgccgatacgagtggctcggggtcccgggggggccagccgcacgcagaggacgcggcgccgccgtctcgggtcgcggtgtcggtgacgacgaaggcgacctcggttcgcgctcgtcgaggcgttcgagtcgatacgtggatctagcaggtcgacgagagaaggagtccagatgacaatggcagtgggtggtatcggagcaagcgccgccggcgctacgacgagcgcgtcgggtggactcgccagcctgaccgcgaacgagtttctcaacctcttggtcacggagctgcagaaccagaatccgctctctccgatggacccgtcgcagatggtctcacagacctcgtcgctgtcggaggtggagctcctctcgaccatccagagtgcgctcacccagatggcctcgagccaggggatcctcagcgcgagcagtctgatcggccagagcgtcacctatcaggacggctccggcgaggttgccggccaggtctccggcgtcgggcagagcgccaacggcgtcgtcctcgatgtcggtggccagagcgtgccgatcgcgaacgtcatcgccgtcggcatggtgccctcgggcgcctcggcgacgggatcgacgcagaccgggtcgacgacgtcgacgaccgggtcggtcggctgagccgccggacagcgtcgctcagtgggcgccacgaccaccatcgacacggaacacgatcaggacaccacacgatcaggacaccacacgatcaggacaccacacgatcaggacacaaggaggatcatcccatgaccaagtcgctctcgtctgcgatctccgggatcgaggcgaaccaggaatggctcgacaacatcgcgaataacatcgccaacgccaatacgaccggctatcagtcgacccagacggagttcgcagacctgctctatcagcagcagtcggcagccggcggaccggtgccgggccagaccggagggacgaatccactggtggtcggctccggtgtccgggtgtcggcgacgccaaccgacttctctcagggcacgatcgtgcaaaccggtacctccaccgacgtcgccatccagggccaaggcttcctcgtcgtcaaccagggtggccagaactactacacccgtgacggggcgctccagctcgacggcgctggtcagctcgtcacggcctcgggtgcgctcgtgatgggatgggtccccaacgcggccggtcaggtgaaccagaacgctccgctcgccgcgctcacgattccgcagggccaagttgcccagccggtcgccacgagcaccatcacgctcggtgggaacctcccggcaggttcgtccaacccggtcgtcgtgacgacgaccggctacgacgacctcggtaacccggtgccgattcagctcacctttacgccgtcgacgaccgccaaccagtggacactcacggccgagacgacgccgccgggcgcgacctcgcccgtggcgctgactgtcggcggcgcctcctcgcagacggtgaccttcgaccccgcgaccggacagatcagcgccatctccgggacctcgaccgcgaaccctgatcaactggcgctcggtgggttccccacgtcgtacgatctgccggctggctacgccatgaacctcgacttcccgacccctggcacggcacaagccgtgacccagttcgccgccagctctccaacggcccaggtgacgaaccagaacgggtacccatcgggagccctcgcaggcttcaccatcggctccgatggcgtgatcgagggcacctatgccaacggtcgcacccaggtgctcggccagatcgcactggcgcagttcgcgaacgcgcaggggctctccaagcagggcaacctcctgtacgcagcgacgaccaactccggtgcgccccagctcggatccccgggtgccgcgggtctgggccagctcgtcggaggtgcgctcgagtcgtcgaacgtctccatcggctccgaactgaccaacttggtcgtcgcacagaccgattaccaggccaatacgaaggtcgtccagacgacggccacggtgctccagagcttggtgcagatggcctagcggcgtcgggtcgcgcctgctgggtgcggcccggtcgccaaaggttcaggccggcaccaacggtgccgataccaacggtgcgcaaggaggtgctccgtgatcgaggtcacgcggtggtcaggatcgaccttggtactcaacgccgatgcgatcgagcgggtggaggcgacgccggacaccgtgatcacgctgttcggtggctcgacgtacgtcgtccgcgagacggtcgacgaggtcgtcgcggccgtggtggcctacaagtccgccgtgttcgcacccatcgcacccaccggcctcgtcgtgctcgacggcggggaggggtaggccatggacgtcgccacgccggtcgggatcgtcgtagccctcgtcgcgatcctcgtgtccatgatcatggatggaggcaatccggccgccctcatcgccccgtcggcgatgatcctcgtgctcgtgggcactgtcggcgtgtccctcgcgggccgtcgtctcaaggagatcggccagatcgtgggagcgctgcgctcggccatcctcgccaaggcgccgagcgcggaggagagcgttgggcaactcgtgcacttcgctgagatggcgcgccgagagggcgtgctcgctctcgaggccgccgcgaaggacctcacggaccccttcatgcgctcgggtatgcagctgatcatcgacggtgtcgagggcgacaagattcgagagatcctcgaggcagatctcgagggtatggggacgaggcatcgcgccggtgcgaagttcttcaaggacatggcgggattcgctccgaccctggggattctcgggacggtcatggggctcatccacgtgctcgccaacctctcgtcaccgcagacgctcggtccggcgatctcgggcgcgttcaccgcaaccctatggggcgtcatgacggcgaacgtgttctggctgccgatctcgaacaagcttgcgcatctgtcggagcaggagaacgcgctgcgtctgttggtcatcgacgggatccttgccatccaggctggtgcgtcaccgcgcctgctcgagcagcagctcctcagcttcctcgccccgacggcacgtgaggcgcaccgtacggccaaggagcgagccaagccgcagaagaaggcggcctagcgtggccagacgacatcacggcgagggcgaggccgagaactccgagcgatggctgctcacctactccgacatgatcacgctgctgctggcgctcttcgtggtgctgttcgccatgagctcgatctcggtgcgcaagttcgacgagttcaagaccgggttgttgcagaccttctcgcagatgcagctgcagagcttggagcacgggggacgcgggctgctccagcactcgtcactggtgacgcacccaggtctcacgccgggtcctccgcagatcaccatcccgcaaccaggcgcgggaactccgagcgagtcgcagatcgcccaagaggtgaaccaggcactcgcggcccaaggcctctcgcaagatgcccaggtcgtcgtggagcaacggggggtggtggtgcggatcttgtcggacaaggtgttcttcgcgacggactcagccgcactcggccccgtgggagacgccgtggtcgacgccatcgctggcgtcctgcgcacgctgccgaacgacgtgtccatcgagggctacaccgactccgagccgatcgtcggcggcccctacagttccaacttcgaactctcggcggtccgggcggtgacggtcctcgagcgactgtggaaggtcgacggcatcaaccccgaccgtctcagcgccacgggtttcggcgacacccatccgctggtgccgaacacgaccccccagaacatggccatgaaccgtcgcgtggacatcgtgatcttgagttcgaccacccaagccggcaaccgcatctagcgcgacccgacgagaaccaccggggtcacgaggaccccacgagacccaccaaggagggatatggcgacgacgaaggccaaggctgcccaggcagccgaggaggcgcaagcgcccaagaagggcaagaagcgcctcgtgctcatcgtgctcctcgtgctcatcgtgctggggggtggaggcggtgcctacgagttcctcctcgcgccccatcctgccaccaagcggcaccacggaccaccgctgccggggccgacctacacgttcccccagctcacgaccaacctcgacgacggccacatcgtgcagctccagatggtcctccagctcgcgagcggtgacacaaccgcggaggtcgcccacgacctcgacgagctcaacaatgcggccatcttgacgttcggccagatgagctacgggcaactgctgccgacggcgggccgggtggcggcggcgagcgccctcgaaggcgcgttcaaccacgtcctcgcgagtggcgcaccgccacacgacgaggtcgtcgggatcgagttcacctccttcatcgtgcagtaggcgccgcggcgccctggcaccaccgagcgcgaccgttggtcgacgctcaagttcgcgcgcctccgtccgatgccactgtcatgagtggggagaacgaggcgcgtgagcgccaggtgcgtactgtcgactttcgcctcccccacagcttcgaccgtgccgagcaacgaggactcgagctcctcgtcgagaacgcgctccgaccggctgcaaccttgatgggtgcgagcctgcgccgcggcgtgcggctcgagctcggtcggatggaccaacttccctgggagcaggtcgtcgcccaacaggacggcccagccctggtcatctcgttcgcgctggttccattgggatcgcgtggcgttctgcgcttcggagccgatgcggcccttcgcctgctcgatctgcggctcggcggtgacgggtcgccgatcgagccccgtgcgctcaccgaactcgagcagggactgctcgtccaggtcttctccgatctgctcgtccaactcgcctcgagtctgcagacgctgctcgacgtccgcttggatcgggtgggggcagagacgtccctcgagttcgtccaagtcatcagcccgggcgagatgtgcctggtcgtgccgatcgcgctgggcatcggtgacgaactcgagagcgagctcacgctctatctgccctattccatgctgcggcccgtcgtggagctcatcgcccagcgcgccatcgtggccgtcgatcgtggcggcgatacgttccgggatctgctcgccgctcgtctgcacgacgtccgcctcgaggtcagcgtccggttcgagccgacgtcgatcagttcgcgcacgctgctcgagcttgctcccggtgacgtcgtccccctcggccatcgccaaggacaaccggcctgggtcatcgtcgatcgcacgcggcttcatcgggccgtcatgggtcagtcgggctcgcgcgtcgccgccgtcatcatcgaggaggaggaagaggctcatgcctgaggtgcccgagacggccgcgaacctcgcggtccttcgcaacgtcgaactggagctcagcgtcgaactcggcagggcgcggatgcccgtgcgcgcgctgctcgcactcacgagtggcgacgtcatcgaactcgaccgtcacgccaacgccccggtcgacgtcctggtcaacggcaccctggtggccaagggcgaggtcgtggtggtcgacgacgagttcggggttcgcatcctcgaaatcatctcctccgacgaggtggaccagctgacccggggagcgtagcgaagatgggatcgatcgtcgaggccatcggcgcgctcgcgttggtggtcggcttgatcgtcgcatctggtcgcctcgcccagcgcggtcgtccggcgcgttcggtcggcatggctcgcctcgccgtcgtggctcgggcttcacttggatcgaagacctcgatcgtcatcgtcgaggccgacggacggcgattcctgctcggggtcgggccgcagggggcgagccgactggcgagcctcggtgcggcaccgccggccgatgcccccgagatcgagctcctcgacctgcgagatgtcgacgtggccttcccccctccaggttgacacctgctataggaggaagggatgagccagacaccgaacccaccaccgggcgacggccccgctggacgacgacgcggccgctacccgagccagttccgcaaggacgcggcagcgttggttctcgaccagcgccgcaccatcgctgacgtcgcccgtgagcttggcatcaacgagcagacccttggtaactgggtccgtcaggaacgcatcgaccgaggtgagcgagagggcctgacgagcgccgagcgcgaggagctgacacggctgcgccgccaggtcaagcagctcaccgtggaacgcgagctgctcaagcgagcgatggccttctgggtgaaggaggggggacagtgagccgctaccactggatctcccgccaggaggccaagggcttctctgtagcggcagcagcacgagtcatcggggtctctcgccaggcctactacgcctggcgacaccgtcgggaccgaggcgaggatcccgagcacctggtgctcgcgagcgagcttcgcgccatctggcacgagagcgacggcacctacggcagcccccgcatcacccacgagctgcgacggcgcgggttctgcgtgaaccacaagcgggtggaacgcctgatgcgcgagctcgagatggcagcgggcccacgccggcgcttcgtagtcacgacgaggcggggagaggacgcagcgctcccggacctcgtccgtcaggacttcgctcctggtgagccgaagcgcaggtatgtgagcgacatcacctacgtccgcaccgatgaggggttctgctatctcgccacggtggcagatcttggctcgaggcgcatcgtgggctggtcacttgggcgtcacatgcccgatgacctggtggtcgaggcgatccgcgaagcactcgggactcggggcagcctggctggggcgatctttcacagcgatcgcggcagccagtacctctcccggaaggtacggagcctgctcgcgacccttggcattcgccagtcggtggggagggtcgcgacctgctacgacaacgccgtggccgagtccttcttcgggagcttgaagcgcgagctggtggctcgctaccgcttcgcgaacctctcaggggctcgctctgccatcgctagctggattcaccgttacaacacggtccgcctgcactcaagcctcgggtacctaccgcccgtcgagtacgagctctcctgggcctgccgggaggtggccgtggcctaaattcagactgtcaagcaaatggggggaagcccaacgatccagaggccgccgtggtcgctgccttcgacgagccgccggtgcacgccggcggtgcgctcacggccctgctcgcggcgcttcgcacccgaggggttcgcccgtgagcggtctgctcctcgcggcgacgagcctgccgtcggccacgttgacggtgcatgcgggttcgacgccgaccgcgagcgtggtgatcatcctcgccctcaccgtgctctcgctcgccccgacactcctcgtgctcttcactggcttcgtggagatcgtcgtcgtgctctcgatcactcgtaatgccctcggtctctcgacgacgccgcccaatcaggtcctcgccggtctcgcgctcttcctctcgctcttcgtgatggcccccaccctcgggatcgtggagcaccaagccgtcctaccgtatctgcacggtcacatctctgccgttgtggcgttggatcgcgcggaagggccgatcaagctctggatgctgcgtcacacgcgaacgcaagaactcgcactgttcgatgtagtcacccaccacgccggggtcgcacctgccgcagcgccactcgatgccgtcgtgccggcgttcatcctgtccgagctccacagcgccttcgtgatgggcttcatcatctacgtgccgttcctcgtgatcgacctcgtggtctcgagcgtgctcatgagcctcggcatgatgatgctgccgccgacgctggtgtccttgcccttcaagctgctgctcttcgtgctcgtggacggttggacgctcgtcgcgcacgccctgctcgtctcgctccactgacaagggggttcaccagatgaacgatgctgctgtgctccagatcgcgcggacggccctcgaggtcgccacgctcgttgccggaccggtgctcgccgttgcgctccttgtcgggctcgtcgtcgcgctggcacagaccctgacccagatccaggaggcgaccctcagcttcgtgcccaagctcgctgccatcgccttggtcctgctcttcacggggcactggatgctccaggaactcacgacgatgacgacccagctctacagccagatcccccatctcgtgcagacgctctaaggacgagccgtgcagatcagcctccagctgggctccgtactcgcgttcttgatcgcgaccgcgcacgcgctcggcttcgtcgtcatcgccgcgccgttcgcgctcgcgacggtgccgcgcacggctcaactcgcgctcgcggtggggatgggcatggctggcgcagcgatccacaccgccttgccggcgacgacgccagcgctcatcggccagctcgcctgggcagcagcgaccggtgcattgatcggattcgtggcgctcgctgcgatcagcatcggatcgcaggcggggagcttcatcggcttgctgggtggcttcgtcacgcctccctcgctcacgccgctcgcgttcggcgaggtcccggtcaccggcgacctctacggcatgatctgggcggtgctgttcttcgtctccggcgccgacgtcgtcgtgctccgcgggttctatctcgcgagcgacgcgagcgtccatctggccaacacggccaccgtcatcgtgcagtcggtgacgctcacctttgcggccggcctggaggtggccgcaccggtcatcgcggtcatgttcttcgcccagatcgtggcggcggtcctcacgaaggtcgcgccgcagctccagccgctcggcttcttgttcccgctcgagattctgttgtcgctcatcatgatggtcgtctcgctgcccgtcatcccgcacctcttcgacgctggggtgcgtctcctgctcgctgccgagcgtgatctcggggcctgaagatggcgcgccaggagggcaccgaagagccaaccccgcgaaagctcgagcgggcgcgcaaggaggggatggtcgcgcgctcggtcgacctcgtctcgttcgtcgtgctcctcatcgcgtcgttcgccctcccgctcgccgtgcgcgatgcgagcgtgcgcatcggcgacgtcgcggccgcagcgtggtcgggcgcgatccccgccacgagcgccggggcgttgcgctttctcggcaccggtctcgatctcgtggtccaactggtcgggccggtcgccgtcgttgcggtggtcatcgtcgcggtcgggaaccttgcccaggtcgggctgcgcttcgtcccgaagcgactccgaccacgcgccgagaccttctcgcccgcggccaacctgcgtcggatcttctcggcccaacccgggatcgaggtcgccaaggcgatcgtcaagctcgtcgcgacggcggccgtcgcggctgccatcgtctccagcagcatcgacgccatggctcagggtgcatcctcaccgcttgcggcggcggatgccgccgctggtgcctctctcgagctggtccgtgtcgtcgcggtcctcggggtcgtcctcggcatcgtcgacctcgtgcgccagcgtcggtcgctgcggcgcaggctgcggatgacccgccacgaggtacgtgacgagttgcgcgagcacgaaggagatctcgccgtcaaggcacgccgccggcgcttggcgcgtgagttcgttcgacgggccatgctcgccgacgtcgcccaagccgacgtggttgtggtcaatccgacgcacgtggccgtcgcgctgcgttacgaccctcgccgtgatcgtgctccgaccgtcgtcgctaagggcctcgatcacttggcgatgaccatacgcgagcgtgcgcgtgccgctcgggtgccgatcgtcgaggaccccccgctcgcgcgcgtcgtctacgtcgcctctcgtgtcggagagccgatccctgcatcgctgttcctcgtcgtcgcgaggctcctcgcgttcgtctatcgactgccgtcgctggcgcgctcgttcgactcacgccacgtgacccgttccgacgacattccggtcgatctcgccgctcgggcctggagtctgctcgccgacgagatcgatactcaaggcgacgtgcacgcgggccgagaacgctagcgaggcgcacggaggcgccgtggaagccacggtgggcagcgacgaaggggaggcccgtggactcgacgaggctccggcgcatggcgctcgccgtgccggtcggcatcgcggtcatcgtgatcatgctggtcgtgccgatgccgtcgcagctcctcgacgtcttgatcacggccaacttgaccttcgcgttgatcgtgctgggactgacgctgcgcgtgcgagatcccctcgacttttcggcgttcccctcggtcctgctggtggccaccatgttccggctcgcgctgaacgtgtccgcgacccgtctggtcctgctgcacgcctatgcgggcagcgtgatcgaggccttcggccacttcgtcgtcggcgggtcggtcgtcgtcggactcgtggtcttcgccatcttgttcatcatccagttcgtggtcatcacgaacggtgccggtcgcgtcgcggaggtgggggcgcgcttcacgttggacgctatgccgggcaagcagatggcgatcgacgcggatctgaacgccggtcacatctcggaagccgaggcacgtgcacgtcgggcgcgcatcgctcgcgaggcggacttctacggggcgatggacggcgcctcgaagttcgtcaagggtgatgccgtcgcggccgccgtcatcaccttgatcaacctcattggcggcttcatcgtgggcatcgtggagcaccatctctcggtctcgcagtcgatcgacacgtactcgctcctgtcggtcggtgacggcctggtcagccagatcccggcactcttgctctcgatctcgacgggcctcatggtgactcggagcgcgaacgacgcggacttcggcctcgacctcctgcgccagatcgcccacgagcccgtggccatccaactcgctgggggggtgatcggcgcgctcggtctcttgccggggctccccatggtgccgttcgtcctggtcggtggctcggtcttcgcggtcgggtggcggcttcggtcgaggagcgcgtcgcacgtggggagcggcgacgagcccgtcgtcaccgagtcagaagccgtgccggacgcgctcgcggccgacgtcgtcggcgtcgagctcctcgagctccagctcggcttcgagctcctcgacgtcctcgatccggctcgaggcggggacctgctgacgcgggtgaagggcctgcggcgcaagctcgccggggagttgggcttcctcctgccaccggtgcgtacccacgactccttggacgtcggtccggacgagtatcggatcctcatccaagatcaggtcgtcggtacgggtcggattcccagagggcgtgtcctcgccatgggccagggcctcgagtccttaccgggggaggccgccgtcgatccggtgttcggtcttgcagcgtgctggatccccccggaggccaagacgcaagcccaggtgctcggcgcgacggtcgtcgaccgatcgtcggtgatcgtgacgcacctcgccgaggtggtccggcgccacgctgacgagcttctcacgcgccagcaggtcaaagagatgctcgatgcgctccgccaggcagcgccggtggtggtcgacgagctggtgtcgtcgcagctcccactcggtgagctccagcgagtccttcgcgacctgctcgccgagcgggtgccggtgcgcaacctcgccgccatcgtggaggcggtcgtcgatcgcgcgcgtcagacacacgagcccgacgcgctgctcgaggctgcacgcgaggcgctcggcggtgccatcgggacgcgctttgcgaccggcggcaagctgccggtcgcctacctcgtgcccgagctcgagcttcgcctcgtggaatcgctcgtgagcgtcgacggacgccggagtctcggcatcgcccacgaggagctccgagcactgcgtgccgaggtcgccgaggccaagcagcgcgccgaggcacaggggctcgacctcgtgctcgtcacgatgggagcgatccgtcggccgctgtgggcggtccttgcccgtacgccggcggagctccccgtgctcgcgctcggtgagatcggttcgtcggttgatgtcgttcagatgggggtgatcggtggtgtccagcaaccagcggcgctttagtggtcagacagcggcagaagcggtcgcggctgcgcgcgcggccctcggcccagacgcgaggatcgtggcggccgagcgggtttccaagcccggcctactcgggcgcaagcgccacgtggtcgtcacggccgaaccgatgccggtgacgagcgcccgggactttgccaaggagctgtcacgtcagctcgcggctcgggaagcggaggcgcccgccgaggacctcgagatcctggcgacggcgtacgagcaggccaagagcgagccgcctcaggtcgtggtcgcgcccatcgggcgacgcgaggcggtggtggtcggttcgggcggtgagacgcgtccgctcggctcggtcgagcgcccgcagtggtcgcagctcggtgacgtagcgagcgcagccgtgcgtgccgtcatcgacgaacgcacgactcacctgaccgtcgacctgagcgctgacggtggcgacgtggtggtcgacgtgagcgcaccggtggccgagcgcaccatcgcccccgagggctcgcgggtgatcgcggtgtgcgccccgagcgtgccgtatccgttggcggcgttcgatgcggtcgccgatcgcgtcggggtcggcgacgccgatcggttcgtgctcgctcagcgtcggcgcgagatcccactcggactgcgcagtccagctgatcgggtggcgcgagcggtcgcgagtggacagcgacgcgtcgcggtgctcgtggatccaggtcagctcgcgctcttgcgtagctcgtttctcgccccgctcacgtgggtggtcgtcgcggtgtcgggagacgagcctgcctgcgacctcgaggtggaactcgcggcttgtgggccgatcgacgcgctccactgcgtgcgctcggagcgtgccgccgtcgagctgggccttgcggtggtggcgtagccatgcgtcttccgtggcgggtctggctctcggtcatctcggctgcgctcgttgcgacacccagcgtcatccaagccgaccacggctacacgagctgggccaacgtcctcgagcacttcctggtcgccttggtcgtgctctggatcgcctactccgtgctggcaacggtgatcgcatggtacgaactcgaggggatggtgcgacgtcggcaggcgcgccaggccgcgatggagcaggcgcagcaggcggcaccacggactcctcagtcctgatcgacgaggaggatccgaacgacgtacgacccgtgctcgtggcacgggtcgtacgtcgtttcggcgatggcgtcgagcgcgattcaggcgacgttctcccggctgccgttcagcgttggcttgcccgcgcggatccaggcgttggtgccaccgcggacactgacggcgcgcagaccgctgccggcgaggagttgggcggcggcgtagctgcgcgatccgctcgcgcagatcacgtggacgtccttgtcgcggggcagttcatggatgcggcggggcaggtggctgagcgggatgttcttcgcccccgggacgtgacccgactcatattcccaaggatcgcgcacgtcgacgacgaaggcaccatcctggtgggccgcggcgaagtgatggatgtcgatctcgcggatcatcggtcctcccgtagtatcacgacaattatgtgatgcttcaggttgtcaaccctgatgatgacagtatataccccatggggtactgaggcgaccagtccggcccacgtcatgtgtgcgatcgatcgacgcccacgacgcaaccagccgggaccacggtcccggctggttggaggtacgcgttgtggggtgaggtctggtgctacggcagctgcgcgagggcgcgctcctccttgaagaggaagtagcgctcgaggaaccgcttcgtgatgtcgtagaaggggttcgggagcatgaactcgacctgccgcggcttgaagaacttgttggcgtacatgatcacttctttgtgccccgcgtccagtacgcacacgcccgggatgtcgcggaagggtcgctgctcgaggtccgtccgtccggtcgccaagcggccgacgttcttgccgacgagcttgccctcgatgtcggccgggaagcccgtcttcgggatgccgagcggcacctgactggtgaagggcttctccacgtcgatcgccacgcccgcagaaaagatgttcgggtagtcggggtgctggaatgcgccgttgaccgggatgaaacccgctgcgttcccgatgcccgcacccgagttcaagatcacgtcctgtccgctgaaggccggcatgatcatggtgaacttcgaggggagctgggtcccgtcggcgagggtgacgccctcgtcgctcacggatgcgatcgccgtgttctcgtagagccggatgccctggcgatggagcaggcccttcaggagccgctcgccgcctcggatgccatccatgccgaaatgacccgcgtagggttcaggtgtgacccaggtcacgtcgacgcggtcgcgaacgccgtggacgcgcaggtagtagtccaagttgaagaggaactcgtaggcggctccgatgcagctggcaccaggagcggcaccgacgacgaccgggcccggatcggcgacgagccgatcgaagtcttcacgcgtctgcatgatgagctcggggtcgtggacggcgtggttgaagccgagcttcgggtcggacccttcgagcttcgagtagtcgaacttcgggcccgtcgcgatcacgaggtagtcgtagggctcctcgccacgagtggtgctcaccacctggcgctcggggtcgatgtgggtcgcctcggcctggctgaaggcgacgtcgcgcttggcgaggatcttgggaaccggccgggtgatctgcgacacctcacgctcacggaagggaacccagatcatcgaggggacgtacaagaagtagtcggtcttcgagaccaccttgacctcgacgtcgcggccgcgggtatgtcgcttggcctcgagggccgacgtcagaccggcgaagttgccaccgagaacgagtactcgctccactgcgaacctcctttgcgcactgagtcagtatgggcgcgctggagcgcccccgaccagggaagaggtgcccgtccttgagggaccttcgtcccgaacggacgtcgaggtgccggtaggatgggggtgtggcgagcgtctatgagctggatcgtgcggcggtgcgtgcgctcgttccctggccggactggcgtatcgagcagctgtttcacgggctctaccacgaggggcagcgactcgaggcgatctcgacgctgccggctcggatgcgagccgagctcgcgagccacctcgatccgggcctcactgagcgtcggcgtgagcacgccgacgacggtgagacggtcaagttcgcgctggaggctgccgacggggcgctcgtcgagacggtcgtcatgcagtcggcgcgtcgcatcagcgtgtgcgtctcgagtcaggccggttgcgcgatgggctgtcgtttctgcgccacagggcaggccgggttcgtgcggcacctcggggtcggggagatcgtcgagcagctcgcgatcgcgcagcgttcggtacgcccgcgacgtctcacgcacgtggtcttcatggggatgggcgagccgctcgcgaacgcctcggtggcgatcgaggccattcgacgcatccgcgctgacttcggcatcagccctcggcgcgtcacggtgtccacggtcgggatcgtgccggggatccgacgccttgcgcacgcagatctcggcgtcacgctcgccgtgtcgctgcatgcggccaacgacgccgcacgaagcgacctcgtgcccatgaaccggcgctacggcatcgacgccgtgctcgatgccgcgcaggagttctccgagctcaccgggcggcgcgtcacgctcgagtgggcgctcatcgccggcgtgaacgatcgcgaccgtgacgccactgagctcgccgggcacgcacgtcggctcgccgctcacgtcaacctcatcccgctgaaccccacaccgggctacccgatggtgggcaccgatcccgacggcgtcgcgcgctttgcgcgccggcttcgctcgctcggtgtcaacgtgacggttcgcgacacgcgggggcgatccatcgatgcagcctgcggacagctcgccgccgacgtcgctcgcggcggcccggccggcgccagcgcggtgcgcttcgcacggcgcatggtctcggcctgagatcccccgaccgatcacccctggcgggggaggctccaagcgtcggagaggctaggttcctaggtgcctcgataggcctcgcttcgaaggagcgcgcatgacgaagcttgagatcgcgccctccatcctccctgctgacttcggccagctcggcccgacgctccaggacctccaggctgctggcgtcgaccgtgtgcactgggatgtgatggacggcgtcttcgtgcccaatctcaccgttggcgccccggtgatcgagagttgccgccgctggagcgacctcccgttcgaggcgcacctgatgatcgtcgaccccgaccgccacgtcgagtcgttcgtgcgggccgggtgcgagctcgtcatcattcacgccgaggcgacggcccacttgcatcggagccttgggctgatccgcagccttggtgctcgcgctggcgtggccctgaacccgtcgaccccgccgtcggcgatcgagtacgtcatggatctgctcgatgtcatcctcgtcatgacggtcaatcccggtttcgggggccagcgctacctggcgagcgtcgagccgaagatcgcatcgctcgccgcactgcgtgacctcacgaacccgaccaccaggatcgaggtggacggcggcgttgcccctgacacgctggcgggggtcgtcgagaacgggggcgagatcgtcgtgtcgggctctgcgctcttcgcacatccaggcgggctccgagctggcgtcgaggcgtttcatgcgatcgcagaggaggcaaggaagtgaccacgactgtcgagcagcgagccatcaccacggtccggatgctctcgatcgaccaggtcgaggcggcgaactcgggccatcctggccttcccctcggactctcgccggtcgccgtcacgatctttgcgcgcttgatgcggttcgatccgacagatccggcctggcccaaccgcgaccggttcgtcctgtccgctggtcacggctcggcgatgctgtactcactgctccacctgttcggtttcgacctaccgatggatgagctgcgccgtttccggcagctcaactcgcgcacgcccggacaccccgagtacggccacaccgcaggggtcgaggtcacgaccgggccgctcgggcagggcttcgcgaccgcggtcgggctcgcgctcgcagaacagctgcagcgtcacgagacggagcagcgcttcggtgaggcgctcatcgaccatcacaccttcgtgctcgcgtccgacggcgacctcatggaggggatcagccacgaggcggcgtcactcgcgggccatctcgggctgggtcggctcatcgtggggtacgactcgaacgacatcaccatcgacgggcccgcgcacatctcgtgcactgacgatgtgcgcgagcgcttccgtggctacgggtggcaggtcctctcggtcgaggacaccgaagacccggacgccatcgaggcggtctatcgggtcgcgatggccgacgagtcccgcccgagcctcatcatccttcccacgctgatcgggcgcggggccccaaccaagcagggaacgtcgaaggtgcacggtgccgccctcggacccgacgagtatcgggcgaccaaggagttctatggctggcccgtcgacgaggcgttcgtcgtccccgatgacgtgcgcgcatgggccgacgaggtggtcgccgccaagcgtgaggtggctaccaagtggcgcgaacgggctcgtgaggtgggctacgaggcgccctccatccacctcgacccgcaggtcctcgaggcgctcgagttcccggaggtcgatcctgcgaaggccgtcgcgtcccgcgtggcgagccagcacgtgctcgagcgggccatggtggcgatcccgacgctggtcggaggatcggcggatctcgccgagtccaccgggaccaagcttgcgttgcccgtcatcgatcgcgagcatccgctcggacgcatcgtccacttcggcatccgtgagcacgccatggccgcatgtgccaacggccttgcgctctcgggcttgcgcccatgggtcgcgacgttcctcgtgttctccgactatctgcggccaagttttcgtctgtcggcgatcatgggtctcccggtcatctatctgttcacgcacgactccatcggcgtgggcgaggatggaccgacgcaccagccgatcgagcaggtcgaggcgctgaggatcatcccgaacagcgcggtggtacgaccagccgacgccttcgaaaccaacgaggcgtgggcagcggcgctcgcccacacgagcggtcccattgcgttgatcttgactcgccagggtcttgcgcccatgccgaccgcggacgagcctgggtggctcgagcgccgtggtgctcggatcgtgtacggcgccgacgtcgaccgacctgatgtggttctcgtcgcctcggggtcggaggtcaacctgtgcgtcgaggccgcgcacgcgctcctcgaggaggaggggatcgtggcgcgggtcgtctccgtgccgtggcgcgagcgcttcctcgccatcgacgagcaggagcgagaggagctcgcgccgtcggggattccacgcctgatcgtcgaggcgagcgtcgcgaccggatgggaggccttcctccagccgggggaccgcctctacaacatcactcgcttcgggctgtcggctccgatcaaggacgtgcagcgagcgctcggctttaccgcctccgacgtcgccgacgccgccgcagagctcgtcgtggacggttcgttcttgcgtcgtccggtccacctcgtctccgagctcctcgctgcgacggaggccgctgcggttgcgacccaggacctcgtcggcgatggcgatcgctcggcagcagaccaagccgcggtctcggccatgcgtcgagcgctcggtgcgctccctgcgcgggccaccgtgatcgtgggtgagggggagaaggaccgagcccccatgctctacgtgggcgagcgacttggctctggttcggtcgcggtcgatctcgcggtcgacccgttggaggggacgacgtacgcggcgaccggccgggagggtgccgtctcggtgctcgctgcggcgcccaatcgcggcctgcaccccttgccaggctggtacatggagaagctcgtggtaccggccgaggccgcgggagtcgtcgacatcgaggcaccgctcgtcgagaacgttcgacgcgtggcgcaccgtctcggacttgccatctcggagaccccggtggtcgtcctcgccaagccacgccacgaggcggccatccgagagctgcgggccgcgcgggttccggtcgtcgagatcccagacggggatgtgatggcgagcctgcgcgtgctcaccggcgatccccgtatgcgcatgctgtggggtatcggtggcacgccagagggcgtcatcaccgccgcagccgccttggcgctggccggccagatgcaggcccgcctccgcccgcagagcgacgaggagcgatcgatcctcgacgcatggaagcccgattgggaggagcttcgcttcgaggcgagcgacctcgctcatcctgaatcggtcgtcgtcgcctcgtccgtaaccggggcgaccccgcttgtgccaccgatgccgcatgcggatggtttcgtgatcgaaagcctctggatcgagccgggacagttcggcacggtccggcgggtcgtgagcctccggggggaggaggacgcatgatcgatgttgtgcgaaaggaaccgtcaatgtcccatcgagtggccgccatccagaaggcgacggcgcgaggagcgcatccgacgcgcgtgacgatgctcgcgatcgccggagactccgcttctggcaagacgaccctgacgaagggcatcacccaggcgctcggcgccgagcgtatcgcgtcgttctgcaccgatgattatcaccgctacgaccgggaggagcggcgtggactcccgttcacgccgctgcatcccgagtgcaactacctcgacattctcgagcagcatctccagctcttgaccctcggacaatcggtgttgaagccggtgtaccaccattcgacgggcacgctgggtcggccggtgctcttcgagcccaaggagatcgtcatcgtcgagggtctgttcccactgtggtcgaagctgtcgcgggccacgttcgacgtcaccgtcttcttggacccaccagaggaggtccggcgtcgctggaagatccagcgcgacacgggcaagcgtggctacagcgaggaccaagtgctcgccgagctcgagcgtcgcgagcccgagtcggacgcttatatccgtccgcagcgtcgcaacgcagacatcgtgatttcgttcgctccggttgcgggccggaccggcggagacgagacgatgagcgcgaccatcttgctgcgtccgacgatcccgcaccccgacctgtcgtcggtgctcacgggcgacacgcgtgagtcggtccacctgaagctgattcgtgaccaagacggcaagccggtggatgccctccacgtccacggccatgctccgaccgaggtgacccaggtcgtcgaggaggtgctctgggaccacatcgggctcccagggccgatccccgaaccgctcggggtcatcggaccgggcaagcgctcggcgtcactggcgatcgcgcagctgctcctcatctaccacctgatccacgcatagccgggtcgggcgtgtcctactccgaggcgtcgcgcgcctcggagtcggcagaccgccagctcaccgagctcacggcgggttcgaggctgaggcgagagatggcttgttccacggcgaggtcgtcctggccttcggcgacgaggtctgcctcgacgagcacgaggccgggctcatgacgcagctcctggctgcgcacgccgcggagccgaaacgcgccggctgaggctgcttgggtgatgagcgcccggatgtgggcttcggctggctcttgacagacgaccgagagcgtccactcgaagcgcacctcttcggcctcgcgctgcggacgtcggtcgagggtgcgggcgagcggccgtagcccgacgtgggctgcgaggaccgtgagcgcagccagcagcgccaacatgaggtagccagtgcccgtgagggcgccgatggcggccgcgcaccagatcgtggctgcggtgttgatgccgcgcacgttcacgccatcgcggatgatgacgccggcaccgaggaacccgatgcccgagacgatgtaggcggtgaccctcgtgaagtccaccgattcgtgtgccgtcgcggcgatggggctggtggcaaggagcagcgagagctgttcgaagagggcggcgccgagcgccacgagggcgttcgtgcgtagccctgccatgcgcgagcgccactggcgttcggcaccgacgatcgcaccgaacagcgcagcgaggacggagcgcacgaggaaggtccaggtcacccctgggacgaggggagcggcgaggtggcgcatgagggcctcccgaggttgcggtcgggggtagtccaccggtcgagagtgaccacgagctgaacgaaaccttgcgaggcgttgacaatgcgactgcccgtgcggaacaggtcgctgtgttgtctcgtcgatcaccgacacggcagtggtgcaccgtggtccgtgctcctgcggggcggtgctcgtgaacggttcctgcgagcgatgctgaaagcgtttgcatgtcgttcacgtaagcgctatcatctggcctacgttcgctggtatgcgaaccggggaacttggtgggggtcgtcggtcgtgcggtgtgatcagggcgctgggatcgcgcgatgagcgctgctcgcgcgacgatcttcgatgtcgcagccgaagccggcgtgtcggtcgcgagcgtctcccgggcgctgcgcgacattcctggcgtacgtccggagctacgagcgcacattcgtcagatcgccgagcgactcgggtacgtgccgagtgccccggccgcgtcgctggcgtcgcggcgcctcggtgcgatcggcttggtcttcccggacctcgatgatccgtcggtcgacccagggctcgacgaggatcaagagggtcggctctatgccgacgaggtgattcgcggagccgagcgcgctgcacgttcccacggggtcgcgctcctcgtcgccgctacccatcagcgcgaggccgccgagctcgtgcgtttcgtctctgctcgtgtcgacggcatggtgatgctctcacgggtgctcgccgacgtcgaggtccgggccttggcggagcgggttccgctcgtgcagctcgccgggcggagtcggttgcggggggcggacgtggtccgagtcgacaacgagcggggcatcgaggagatcacgcggcatctgctcgtcgatcacggctacgccgacgtccggttcgtcggaggtccggttcgctcgccggatgctcgcagtcgtcttgaggccttccagcgcacggtacggatgctcgggcgcgacgatctggccgagccgatcgcgcgcggagactttcgcgagtcaagcggctggtccatcgcgtccacgctgctcgaacgcggccccgtgccacgtgcgctggtggtggggaacgaccagatggctgtcgcgatcgtgctcgccctccggaacgcgggcctgcgcgtccccgacgacgttgcggtgaccggcttcgacgatacgcagctcgcgcgcctgacctatcccggcctgacgaccgtgcgccagccgatgcgtgacctgggaaggctcagtgtcgagctcctcatcgatcggatcgaaggtcgagccgcgccaggccgcatgatcacgctcccgaccgaggtcgtgcgacggcgtagctgtgggtgcacgtcggcgtcgtggcccggagaactcgtcgcacccagcggtgcagcggagccggtgacgagcacggtcgggacggcgatgagaggagcccagtgaaagcccacggagagcagcaggacgcgacccgggcggtactcgagcgctgggaggagggaactcgtgagcgacgtgtcgacgagcacgttggtcaccttcctcccccgacgggcgtcgaggcctggcgtggctcgggctgcgtcaccatcacatggcagcgtgtcgagggtgcggtgtgctatctcgtcgagcgggcgccgagtccggacggtccgtggacggtgcttcggcgcgccgagcacgacctcgtcgaagtcgctgggcctccaacgctggacacgagccgggaggcgggcggttggtaccgggtggcggcactcgaagatgtgggtcgtcgtccgacgtcgttctccgatccggtcgaggcgcgcgatggcgaccgcagcgcagcggtgacggtacgggtcgaggcgtcgtccccggtcggctcactcgcgcccgtgtggtggatggtgggctccgagcggccagggcagctgctccttcgcgacgacggcttcggtcatgacgttcgggccgaggtgctcgaggcctatcgccgggccgcggcgatcggcgtgacgcacgttcgggcgcactgctggctcgatgacgcctttgggatggtggacgcgtctggtcgcctgaccgagacgagcgcgctcgacgaggtgctcgatctcgtgctcgccagtggtcttcgcccgatcgtggagctgtcctttacgccatcatccctggccacggatccagcggcaaccgtgttcacctatcgggccaacgtgtcgcctcccgctgacctcgttcgctacggcgaactcgtggcgcaggtggtgcgccacatgatcgagcgctacggcgccgacgaagtccgcgagtgggcgttcgaggtgtggaacgagcccaacttggccgtcttctggaccggcgacatggctgcctacttcgcactgtacgaccgggtcgcgagggcggtgaaggaggtggatccggcgctacgtgtgggaggccccgcaaccgcgggaagcgggtggatcgcgccgttcctcgacttcgtccacgagaccgatgcgccgttggacttcctgtcgacgcacacctatggcggtatgcctctcgacctgcgtgcccagcttgcgcgcgtcggtcggggggacgtccccgtgtggtggaccgagtggggcgtgtcgccgacgcaccacgcgcgggtcaacgacggggcctttggtgcgcccttcgtggtgcgcggcatgaaggcagcacagcagatcgcagctgccctctcgtattgggtggtgagcgaccacttcgaggagctcggcaggccggaacgcctcgccgcgggaggtttcgggctgttgacggtcggcaaccttccgaagtcgcgctggcacgcgctcagtctcgtcgctgagctgccttctcgaatcgtggcgaccgaggtggagggcgacggtgctggagcactcgtggacgggtgggcgggtgccgatgcggagcgggtcgacgttctcgtgtggaacggctcgcacgatgcggccgacgccgagggtcgcggtgacctcgatcggacggtgactgtgacgctcgaagggctcgaggacggcgagtggctgctcgagctcacgcgcgtcgatcgggatcacgcttcgttcctcgaggcgatcgcgggtgaggacccatggcctgggcccgaggccacggcggccctccgggagcgcgcggcgctgcgggtcgagccggctggccgaacctccgtcgtcgacggggggcgcatcgagatgaccgtgcgcgtgccgatgcccgggttggtgcggctcagggcacgccgcgcgaggagttgggaggcctgagggtcgaccaacgcgagggccagggcccgcggcgaacggcgtaagagtttcgaccgcgggacctggcgtgggatagacaaagggggatcatagtgagtggacaggtagctcgctggaggactggtcggcgatcgcggccgatccagggattgatggtggggctcgcgggcgccgcggtgctcgcggcgtgtgggtcggcatcgacgtcgtcggcgtcctcgacgacgaaggtgtcgccgacgctcaccatcggggtcgacaacggctcgccgaccctgcaggacgatttcaatccgttctcgggcaaccagcgcatcggcacgacctacatgtacgagccgctggcctgggtcaacccgctgcaagggacgacggtcccgctgctggcggcgtccgagcacttcaccaacccgaccacactcgtcgtcacgctgcgcagtggaatgaagtggtcgaacggagcgccgatcacgccagcggacgtggtgttcacgttcgacatgctcaagcagtacccggccctcgacggtgcggggatctgggatcacgtgtcgtccgtgacctcgagcggctcgacgatcaccttcacgttcaccgcaccggatgtgccgttcgcccagtcgatcctcgagacgccgatcgtgccgaagtcggtgtggtcgtcggtgtcgaatccggtgacgttcaccaacacgaacccggtggtctcggggcccttcgtgctgaagtcgttcaatccgaacgagtacgtgctcgcgaagaatcccgacttctgggacgcatcgtccgtcgaggtcaagaccatcaacttcccagcgttgacgggcaaccagacctcccagctgacgctcgcacaggggggctacgattgggcgacgctcttcatcccggatgtccagaaggtgtgggtcgccaaggatccggcaaccaacaagtactggttcccgagcggcggtgagatcaccctcttcttgaacctcgcgaaggcgcctttctcctccgtcgcgttccgccagggcatctcggcggctctcgatcgttccacgatcgcgacgaaggcagaggacggctacgtgccggttgcaagccagacgggactcttgctgcccaacctgaagcagtggctcgatcccgcgatccccaacagcggctacgtgagctacgacccaacggcggcgctcgccgacttcgcgaaggctggctaccacctcagcggcggcaagctgaccggtccgagtggtgccgtctccatgtcgatcatcgtcccgaacggcttctctgactggatcgaggcagcccaggtgatcagccaagagctggcgaaggtgggcatctccgtgacgctccagacgccggagtacgccgcctacgcgagcgacctgtccacggggtcgtttaccggagccatcggtgccttcggcggtacgggcaacccgtacaacgacctccacggcctgctcgcggcgtcgctcgccgcaccgctcggacagacggcggcctcgaactacgagcggtgggtcaatccgacgacggagacctatctgcacgcgctggctgccgcggtcacgacgagcgcgcagcgcaacgccgtctacgggctcgagcaacagatggtgaacgatgtcccggtcgtggtgctctaccaaggggcgatctggagcgagttctcgacgaagaacttcgtcggctggccgtcggcccaggacccgtacgcgccaccgcagccctacggtcaagcgccgctggtcatcatgacgcacctcaggcttcgttagtcgtgttcccctggggccgccaccgacctcggtggcggccccctcccgaggaggtagctcgtgcgctacgtcgtgcgcaggctcgtcatcttcgtactgacgctctgggtcgccctcacgctgaactttctcatccctcgcctcatgccgggcaacccagctcaggcagcgctcgccaagttggcggctcgcggaccggtgagccctaccgagctccacgccatcgagctcaccctcgggttgccccatggctcgttgctctcgcagtacggtgggtacctcgttgccctcgcgcatggacaccttggcgtctcttacacgttcttcccggagtccgttcgctccctgatcgctcaagctctgccctggacccttggcctcgtcggtacgaccactgtgttggcgttcgtcgtcggcaccttgctcggtgtgcttgcggcctggcgccgaggcggcatcatcgacaccgtcgccaccgtcggctcgacgttcaccgcggccttcccgtacttctggaccgcgctcctcgcgctctacgtgctcggtttcgtgctgggctggttcccgatccgaggtggctacgcctccacgctcagcccgacctggagcctcggtttcatcgtcgacgcggcctaccatgcgatcctgccggccgcgacgatcctcgtctcgagtcttggcggctggttgctcggcatgcgcaacaccatgatcccgaccctcggtgaggactacgtcacgttcgccgaggccaacgggattccctcgcggacggtggcactgcgctacgccgcgcgcaacgcgatcttgccgaacgtgaccggcttcggcctcgcgctcgggttcgtcgtgtcggggtcgttgctgaccgaggtggtgttcggctatccgggcgtgggatcgttgctctacaacgccgtcgtgaacgaggattacccgctgatgcagggcctgttcctcgtcatcacggtgagcgtgttggtcgccaacctgatcgtggacctgctctacggcgtgctcgatccgcgggtgcgccgatgagcacgcccgtgacgagcgcgccggcaccggctggggcagaggctgcggctccggtgcagtcggggtcgagggcgcgagcttctctcgcgcggatcgtcggggcgctctggtcgaacgtgcgagctcggatcggcatcgtcatcctcctcgccttcgtgctcatggcgctcgccgcaccgctgatcgcgccctactccccgacggcgacgtcgtttgccgactccctgcccccgagcgctgcgcatctgctcggcaccacctcgagcggccaggacgccctctcgcagctgctctacggagcgcgtacctcggtgctcgtggccttcgccgccggcggcatctccaccgtcgtcgccatcgtggtcggactgatcgctgggttctcgcgcgggatcgtggacgagaccctgagcttcgtgatgaacgtgatgctcgtcatccccgggcttccgctcatgatcgtcatcaccgcctacctgccgggtcgaggtcccggtgtgatcatcgcggtcatcgccctcaccgggtgggcgtggggagcgcgcgtgctccgaagtcaggcgaagtcggtgagcgcccgtgacttcgtgctcgctgcacgcctggccggagattcgtcctggcgcatcgtgttccgcgagatcctccccaacatgacgtcgctcatcgcggcgagcttcttcggcgcggcgaccgccgcggtgctcgccgaggccggactcgagttcctcgggctcggcaatccgaacgccgtgagttgggggacgatgctctactgggcggagaactccaatgcgttgctgacgggccagtggggcgtcatcgtcggtccgggtctgtgcatcgcactcctggcctcctcgctgtcgctcatcaacttcggtgtcgatgcgctctcgaatccccggctgagggagcgcgcatgagcttgctcgaggttcgcgatctcgtcgtcgattaccgcatgggcacgaccgtcgtgcacgcgctccgaggcgtctcgctcgaggtcgacgagggccagttcatcggcgtcgtcggtgagtcgggctgtggcaagagcacgctcggcaccgcggtcgtcggtgtgctcggtccccctggcttcatcgtcggtgggtcgatccgcttccgcggtgtcgaactcgtgggtctcgacgccgcccagcggcgggccctgcgccatcgagggctcgcgctcgtcccacaggccggcatgaacgccctcaatccggtccgctcgattgaggggcactttcgagacgtgctcgccggtaccggtgttcgtcaccgagcagaggtccgagctcgcgccgtctccctgctcgaacaagttgcgctcgcgccgtcggtcttgcgcagctatccccacgagctgtcagggggcatgcgccaacgggttgcgctcgccctggcgctcgctctggaaccccagctcgtggtcttcgacgagccgacgacggcgctcgacgtcctcgtgcagcgctcggtggtcgataccatccgatcgctgcagcaagcgaggggcttcgccgccatcttcatcagtcacgacatcggtctcgtcgcgagccttgcttcgcgagtggacgtgatgtacgcaggtgaggtggtggaggcgggaccaaccgagcgtgtcgtggcacgaccgctgcaccgctacaccgaggcgctgctgggctgctacgccgaccctcgggcggaggaggtcacggtgcgtggcattccggggagcccgccgaacctcgttgcgcagatcgaagggtgcgcgttcgcgccccgctgtggcgtcgcgagcgacgagtgtcgttgccccctgccgacggtgacgctcgacgaccagtgggcacgctgcgtgcatccagccgtggcggtcgagggacggtcccgatgaccgaacggctcgtggtcgacggggtctcgaagtcctatcgaggggagcggcgtcacgagacgatcgaggcgctccgagacgtctcgctcgaggtcgccccgggtgggtcgctggggatcgtcggccagtcgggaagcggcaagagcacgctcgcgcgcctcatcctcggcgcggagcgcccggactcgggcagtatccgactggggaacgtgcgcgtcgaccagctcgaccggcgggggctacgagcgcactggcggcgcgtgcagctcgtgttccaagatccctacgcggccttgaatcccttgacgagcgtgcgcaccgcgctcgaacgtcccctcaccaaccaccgtcacctccgaggcgccgagcgtgagcgcgcgctcgccgagctcctcacgaccgtcgggctggtgccagtggagcagttcgccccgaagctcccacaccagctctcgggcggtcagcgtcagcgcgtcgtgatcgcgcgtgcgctcgcagcctcacccgaggtcctcgtcgcggacgagccggtgtcgatgctcgacgtctcgctccgtgccggcattctcgagctgctcgcgtcgttgcgtcgcgagcgcgggatctcgctgatctacatcacgcacgatctcttgtcggcacgggtcgtcaccgacgagctcgtcgtcctccgcgagggagcgatcgtcgaacgcggccccaccgtgtcggtgctgcgccagccgacgtcggcctatacgaaggcactgctcgatgcggtgccggtgctgccgaggagtacgcaagcgtcgacgtgagctcggccatcgtcgcgtacagtgacggaggatgactcgaacccagctccggagcctggtcgccgtcttcgaggcgggctcggtcgcgggtgcggcgcatcgactggtcgtcagcgccgctgcagtctcggcggcggtggcctcgctcgagcgggaggtcggtgtcaagctcctcgagcgggtgggtcgcggtgtgcgcctcacacctgcaggcgaggtgctcgtcgactatgcacggcgcatcgaggggctcgaagaagaggcgctggtccgcgtgcatgagctcgccgacgccgcaggcggggtcctacggatcggggcggtcgcaacggtcggggaagagctgttgccgcggtggctctcggtgttccgatcggcgcggccgaaggcgagcgtccacctcgaagtcgccaacaaggcgcgactgctcgagcggctccgtacgcatcggctcgatctcgtgatcgcgggtcgacccggacacgaggccggtctgcgcatcgtcgcgacccgtccgcacgagctgctcttgtgtgccgccgcaggctgggcgcgcgagtggttcggcccctcgctcgaggtgactccagagacggcaagcgcagtgacctggctcgtgcgcgaagagggatcgggcacacgtgcctcggcagaggaggtcctgagcgcgctcgacatccatccgccatcgctcaccatcggctccaacctcgcgatcaagcggggggtggagctcggtctcggcgtcgccgtcctgtcgagcgatctcgttgcacgagaacgtgagcagggcgagatcctctcgctcgcgctggggccgctgccgtcggtccggcgttggtgcctggtggtgggccccgaggggcccccagagccggtccgcgccttcgtcgcccagctccaggcgatgggggagctcgaaatcccccctgcgctcacctgaggggcgggtgggcgagcctccctgcccgcgtagcgtgctggcagcgcgtcgtccagtgggtcgacgatgaccagggcgcgccacgattcagtctcgagccgaggaggcgttgtggacgacattcgcacgatcgctgcggccatggtggcacgaccgaagggcattctcgctgccgacgagagcagtccgaccctgaccaagcgcttcgacgcgctctcgatcccatcgacgccggagagtcgcctcgcctggcgggagatgctcttctccacgcccgagctctccacgtggatctcgggggtcatcctctacgacgagacgttcaaccagcgaacctccgatggttcgacgatccccgagttcctcgccgcccgtggcatgatcccagggatcaaggttgataccggtgccaagccgctcgctggctcgaggggagagctcgtgacggaggggctcgatgggcttggttcgcggcttgcgacctaccacgccaagggggcgcgctttgccaagtggcgcgcggtgatctccatcggggacggtcggccgagttcgatgtgcgtcgccgccaacgctcacgcgctcgctcgctacgcgaagctgtgccaggagaacggcatcgtccccatcgtcgagccggaggtcctgatggaaggcgatcactccatcgaggtcaatgcggccgtgacccgacgcgtgctctccgaggtgttcgccgaacttcgacgcttcgacgtcgacttcgagggcatggtgctgaagccgtcgatggtcacgcctggggtgcttggcgaacccgtgagcgtcgacacggtcgcacaggcgtcggtggcggtctatcgcgacagcgtgccggcctccgtcgccgggatcgccctcctgtcgggtgggcaggcagacgacgtcgcgaccgcgcacctgcgcgcgatgaacgccggagcgacgttgccctggccgatcacgttctcctacggacgagcgctgcaggacctgcccatgcgcatctggcgtggtgatgcggccaacgcggcggcggcgcagcagtcgctcgcgacgctcgcggcggcgaacgctgccgcggccgaaggccgctaggtctgcgacgctgtcgctgtaggctccagagccgtggagcgtgaggcatcgtgtgaccccgtcgtgctcgcatcgttgctcgcgcaggtcgacacgctcgaagcggaggtcgaggccttcctcgaggtcctgcacgccgagatcgagccgacgcgtacgctgcccgatccgcggcagcgtgtgtccgagggggcgagcgagacgaggcctgagcgtgcgggtctcgcttgaactcctcggtccggtccgcgaggcgatcgggtccagcgtcatcgaggtcgcgctcgagcccgacgccacggtcgcagacgtggttgaggagctggtcgagcgtgctggcgagccactgcgtggcctgctcgaacggtgtcgctttgcgatcggcgatcgcgtggtggacctcgacgagcctctcgccgatggtgcgaccgtcgtcgtgatcccacccgtcagcggagggtcgtgatggccgtgaccatcgtgctcgtcgatgaccaccaggtgatcatcgacggggtgcgtgccatgcttgcgccctacgccgaccgggtcacgatggtcgggtcggcgaagacgcgggccgagctgttcgaggtgctcgagagcgtgcaccctgatctcatcgtgaccgatgcgaggctcaccaacgactcgggcttcgagatcctcgaggacctccagcgacgtggcgtggcggtgcccgtcgtgttctacagtgcctatgacgacgaggcctacctctttcgtgcgttgcgcgccggtgcgcgaggctacctcctcaagcaggcctcaggcgaagagctcgtagggatgctcgagcgggccgcaggtggcgagacgatgatcgatgctgcgctcgccggcagagtagccctgctcgcagcccgcttgcagttcggtgagttctggccgggagcacacctcggactcacgcagcgcgagagcgagatcctcgatctggtggtcaaggggctctcgaatcgagacatcgcgcagcgactgttcctgggagaagagaccgtcaagacgcatctgtcctcgatctatcgcaagctcaaggtcaagggacgcgccgaggcgatcgcggttgccctgcgcgaagtgcggttccgatgagtgcgcgtgagctgaccctctaccgacgtcttgccgagctcttggttgcgccactcgaggtcggcgaggtggcgagccgcaccgctgcgctcgtcgtcgaggcggtcgatgcgagcgtgtgcttcgtgcacgccgtcgatcacgagcgcgggcgcctcaccctgatcggggccaccccgcccttcgatcgagtcgtgggtcgcatccagctcggcctcggtgacgggatcgcaggatgggtcgctcaaaccggtcgtgccgccgtggtgcccgacaagtgggcggaccaccggtatcgctatatacccgagctcggtggggagcacttcacctcgctggtgtcggtgccactcgctcgcgacggaaggccgaccgtcggggtgctgaacgtgcactggcgcgaggcgatcgctgacctggagcacgaggcttccgtgatcgaggcggcgggtcgattcctcgtcggggcgctcgagcacgcgctgctcgcagaccagctcgtcaccggtgaggccgcgctcgagcgtttcgcgacggaactcatccgtgcccaggaggccgagcgccgtcgcgtccagctcgacctccacgacggcgtcgcccagtcgctgcacgccgcggcgtaccgtctcgaggggcttcgagccagcgcaccgccggcgctcgcgtcggagctcacggtggtgagggacctggttcgcgcggcgaacgccgaggtgtcacggctcgtgcgcgacccgggacgtcaggtgctcgaggacttcgggctcgccgaggcgctccagtccgtcgcacacggctatcccgacctcgaggtccaagtcgacgtcgagctcgacgatctgacgctgctgctcgagcccgagcgggggctcgccgtcatgcgcatctgccaggaggcactcaacaacgtcgcgagtcacgccgcgaccgacgctgccgaactgcgcgctcgacgcgtcggcgacgacttggtcgtgaccgtacgcgatcgtggcgtgggtttcgagcccgaggcaaccgtgcccggtcgtctcgggctcgtcgggatgcgcgagcgcgcgcgcctgctgggcggaaccatcgagatcttctctcgcctgggtgaaggaacgctggtccgtctgcgtgtgccgatcgtgccgtcggtcgcgtcgtcctaggctgagtgcgctcaaggcgccatgctggggcagagtgacaggggcagctcgtgagccgtggaggggacagttcggcgctaccgcctgagctgtggcaacgtgcgagccgttacacctggatcgccacggcactgctcctgccgaccatggtgcccgccttcgtcatcggtgggtgggcgctgcgggtgtcggacgcctcgttcgcgctggccgcgctggtgggatggctcgcgcgtcgccgactcggtctcggggcaaacctccttgtcacgaccgtcgcgagtgcaggcgccctgctccagctctcggtgccggtcgatgccgtgacgaccttgatcgcagcgagcgtcatccgctccaccttgctcctctttgccggggtgggcgtgtacgcgatgagcttcatcggcgggcgggtggggctcgcgttcgccggcgtgctcctggtcgccacggccctcgtgcacccggtgggtttgctcggcgcggtgctcgccctggcgctcgccgccctgctcggctacatgatccacgggctcgtggagcatcttgcccatcgcgagcgtgagctgagtgctgctgcgctcgtcgatccgctcaccggtctcggcaatcgacgggccctcgagcgtgcgttcgacgtcgccgtggccgaagccgcacgacaggacaccacgctcttcgtgtcgctgtgggacctcgatgcgctcaagcgcaccaacgatgaacgtggtcacgaggccggcgatgccctcctgcgggacttcgctgcggcgctcacgcggacgctccacgatcaagaccaggcctttcgtatcgggggcgacgagttctgctgcttgcatctcggcttgaaggacggcgcatcgatcctcgcgcgcatggcactcgcgtttccgagcgtctcgggcggctttgccgaggttggcaacgactcgctggggacggcgcttgctcaggccgatcgcgccatgtacgccgcgaagcgccgtcgtcggcgccacgacggctccgacggctgagcgcgtgctaaactcgacacgtccatacggatggacgtcaccgcggtcgtggaaggcgtggcgccttctccccgttcccggcgtgttcgcgctggtggtgatgccgtatggcgccacgtatgacagaagctcatggatgggcgcagtggcgacgagctgctgcgacgctggcgctcctcgtgagcggtggctttgtcgcgcgttggggctcgacggccccgtcgtcgtccgtgcagtcgctgcaggctcaggcacaggttatcgaggcacagcttgccaacctgggggcctcggtgcatgccatcacggtgcagatccaagagactcaggccgcgatcgcggccaacgaggcctctgaggccatcctcgaggggcagctacgagccgagcacgctgcgatcgcgcggtcgcgtcgagtcctggtgacggccgctgatcagcagttcgtgacggcaggccaatactcgagcgtgttggcgtcgctgcggtcgaactacagctcggtcgggctgacgcagggctacgagcaggtcgcttcctcgtcgatcacccaggcgctctcggcctacgagcaggccggtctcgagatcgaggtgacgcaggcagcgctcgcggcgcgcgttcgggcaaccgaggccgagctggtgcaggatcaggcgcaacgcgctcagctcagccaacgggttgcggccaccgaggccgaactggcccaggtgcactcgcagctggcctcggccatcgcggctgaggcggcagctcccttgccggctcccggcggagcggcccaagccgtccaggtcttgctggctccgccgccgccctcgccgacgtcgctgtcggggcccgcgaccgccgcgcagctcctcgcgttgcgcgactgcgagtccgggggcaactaccaggccgacaccggcaacggctactacggtgcctaccagttcgcggccagcacctgggctgcgctgggttacggtggcctgcccaaccaggctccgccagcggtgcaagaccaagccgccgagcaactgctggctcgagctggctggggtcagtggccggtgtgctccgtcctgatcggcatgtaacgccgatcgttgcgccacgagccgaggcggccccgggatcgctcccgtggcgccgatcggagcgcgcgccactacgtcatggcgtgcgccccgaggaggctctggcgtgcggtcgcgtcatgctcgctgggttcacgcacccgtggtggccgactcggcgagaagctctggaggcgtcgaatcgagcagcgacaagatggcggtggcgagggcgcgggcgcttgcgacatcgagctcgagcgcactgaggcgcctgaggccggtggcctcgcgagcgaagacgtcgatgttgagcgaatgggtcgctgggaacgccacggggtggtcgaagtagacggtcgcctggtcgacggcctcccagccctccggggtacgtgcgcgccccgtgagaggggcgtgttcggtcgcgtaggtgcacatggctaggcgagatgctcgccgaggaagcggaagatccgctgccaaccgtcgttcgctgcttcgggtcggtacgagggtgcagcggtgttgaagaaggcgtgcccggcaccgtcgtaggagtggaactcgtgcgccttgccgagtcgggtgagctcttcgtcgagtcgacgtacctcgtcaggggctgggaacgagtcgtcgttgccgaagaggccgaggagcggggcgtggagctcgggagctcggtcgatgaccggacgcaccctgaccggggctccctcggggggctcgttcaccacgaaggcgccgtagcagtcgatcgctgcgtcgaaggggatcgcgcatgccgcgaggaagctctgtcgaccgccagaacagtagccgatcacaccgaccttgccgttggcgctgagggcggcacggaggtagtcccgtgccccggcgacgtcgccgatgagacgctcgtctggcaccccaccctgggcgcgggcgatggccgcggcctcgtccggagccgcgttcggagcctcgcgccagtagaggttgggcatcagcgtggcatacccgtggcgagcgaagcggtaggcaatctccttcgtcgcttggtcatagccaggcatgtgatggatcacgaccatcgagccgtggaccgtcgcgtccagcggtcgcgcgagaaacccctggacgaggtcgccgtccgcgccgcgaaacaagatctcctcggtgaggacacggtgctccatgcagactccctgtgtgcatctgggtggtcgaggccaccggtcgagttggagtagttgtaccttaccagcgactgggttcggcgtcgccacaggtggcaggccggggtgcgatgaccgacggcgaggcctcgcgggcggagtggtggtccctagtgctcgaccgagggcgaggcgacgagctcgaaggcgtcgaacccgacggtcggggccgctgggcgttgcacgaagccggcggcgaggagggctcgagccgagggggtgttgtgtcgtgcgacacgcgcgacgatcacctcgacaccaggctccgcgctcagcgtcgccgtgaggctgaggatcgccgccgtcgcgatgcctcgcccccgttcggatttgatgacgtcgtagccgatctcgacctcaccgttgatcgggttgccgtgcgcgccgatggagccgacgacgacgcccttggcgaggtcgacgatcacgaacgggccgaacgggaactcaggcccgacgcccgcctcgtggagctcgaggaagcgctgcgcgacgcctcggtcgatgtcgtcggggaagtccggggcccagtcgggagcgcgttccgccgtcgcgatcgctcggaggaggtcgacgctacaccagcggagctcgacggcggcacgatccatgcgttcggatcagtggaacgtcaagacggtgatggtgccgagcaggaacagcacgccgctgacaccgtagagcagcgacttggtgatgaccttggtcacggggcggtgcacgtagtcgttcacgatggtccgaaggccgttaccgccgtggagcagaccaagggcgaggaggagccagtcgaacaggcgccagagcggattcgaccagcggtgggcgacgaacgccacggtggtctgggtcacgtcgttctcgatgtgcatgatgtacatgtggatgagggccaggaagaacaggacgatcccggacacccgcatgaagagccatgcccaggtctcgaagttctggcgaggtcgtcgtgcgctccgaggagtggcgaagacggccatgtcagtgcacccccacgaagaacggcttgacgatgtagtagccaccgacgatcgtcagcagcacgctgagtccgagcatggcctggaagagcgctcgttcgttgcggacggcgcccgggaagaagtcgatcatgatcactcgcagaccgttcagcgcgtggtagaggagggcgaagagcaggccgacctcgaacaggcgcaggaagatgttgccgtagagctggtggatctgttcgtagacgtgcgggtcgttcagcgtggcgacgtcgacgatgtggagcaggatgaacatgaagacgaggaagccggtgacccgatggaggatgaacgcccactggccggtcttgcctcgatacatcgaggcgcgcgctcgtactgcgcgccctccagccggagccggcgtcgctggcgacgtcatgactgcctcctgaaccaccgggtgctgcgggtggtcgtcgcgacgacgtaggcagcgaaggcaacgatccccaacgcgatcagaccgagggcgatggagaacaggatctgggccagactgacccccgaagagctcacactcatggcgcttacgctagcgcccgctcggtgttggtcgaaatcacggcgatgcgtccttgtcgtgggtcaacccagctcgccaccggccggggctgtcgtgagcgtccttggcgatgcagtcgggctccgtcgtgagtggtgcgacacgacctgcgatcggtggggcgctggctcaagcggtcttgggtgcctcgagcctcgaggtgccgaggtagggggccagcgcatcgggcaggcgtatcgacccatcgggttcgcgaccttgctcgaggagggcagcgatgacgcgtggccacgcgagcgccgagccgttgagggtgtgcacgtactctggccgcgccgccggctcccggcggaaccgcacattggcccggcgcgcttgatagtcgctgaaccatgacaccgaggagacttcgagccacgcgtccacaccgggcgcgtagacctcgaggtcgaaggtgcgggcggacgactgtccgaggtccccagtgcacaggtcgacgacacgatagatcaggccaaggcgctggagcagcgcctctgcccgaccgagcagctcgaggtgcatgctcgtggcatcctcgggtgcgacgagtgccaggatctcgaccttgtcgaactcgtggagacgcagcaggcctctggtgtcgcgccctgcggaccctgcctcgcgccgatagcacggggtcgcggcggtgaggcgcatggggagcatcgcaaggtcgaggatctcatcgcggtagagcgacgtgagcggcacctcggccgtcgggatcgcgtagagatcatcgcgctccatcacgtaggcgtcgtcggcgaacttggggaggtggcccgttgccaccatcgtctcgcgacggaccagcgtcggaggatggatctcttcgaaggcctctgcgtgggcatcgagcgcgaagttcgtcagagcgcggacgaggcgtgccccgaggttgcgatagagcgcgaacatcgatcccgagagcttcgctgcgcgctcgagatcgagaatgccgagctcgcgaccgatctcgaagtgcggtacgcgacgatggctgggtgtggtggacgtgagatcgacgtcgggctcgaccgtgccggtctccggcgaccattggcgtaccacacggttgtcgtgttcgtcctcgccgatgggtgcgttcgggctcgggatgttgggcaaggtcagccagatcgcgtcgcgatcgccggtcaaggtgtcgacgcgctgctcgagttcgtcgagccgattaccgagcgctcgggcgccctcttgcagctcggtcgcgtctcgaccgctgcggcgagcctcggcgatgtcgcgagagcgggcacgcagctcggctcgaagctggtcacgctcggtgatcaccgctcggagttgctgatcgatcgtggcgaggtgggcgaccacctcggggtcgatcccgcgggacgcgaggcgccgtgcgacgtcgtcggggtgggcgcgcagctccgtgaggtcgatcatgcagccttagactagcgatgcgatggaggatgctctcgaggtccacgacctcgtcgtgcgctacggctcgttcgaggccgtccgcggcgtgtcgctgcacgtcgctttcggggaggtcgtgggcgtcctcggtccgaacggcgcgggcaagacctcgaccgtcgagacgttggagggctaccgacgggcggctcgtggcgaggtgcgcgtgctcgacgtcaccgatccgtggcggcaccagcgcaccctcgcgcgtaaggtcggcgtgatgctccaagagggaggcgtcccgccgcggatgcgggccctggaagccctcgagatctacgcacagttctacgacgatccctggcccgtcgctgagctcgtcgatcgtctggcgctggcgcccgttgcgacgacgccctttcgtcgactctcgggcggcgagaagcagcggttgctccttgccctcgcgatcgtcggccgtccacgggtcgtcttcctcgacgagccgacggcaggcgtcgatccggtcggcaagcgcgccatccgggacttggtcgccgagctcgccggatcgggcgtcgcggtgctgctcaccggccatgagctcgaggagatcgatcgcatggtggatcgggtgctgatcatcgaccacggcatgcccgtcgccgccgggagtcccgcagagcttcgggagcgcttcggagaggccggggtcgagttcaccgtgcgaggcaggctggacccaagcgtgctggcggcacgactcggggtcgaggttcggctcgttgccgaggatcgggtgcacgtcggggcttcgccgacccctcagttggtcgcgtcgctcgcggcggtgctcgacgagctcggcgccgaggtcggtccactcgagacggtggagtcgtccctcgagtcgatctatctgcgcctgctggaccgcggggagacgacatgagtgcccatccagtacgcgcccaggcggtgtccgagctcaagctcgtcctccgccaaggcgaagccgccctccttacgatcgtgatcccgatcctcggtctcgtgttgttttccaaggtcaaggtattgccggtgcctggcggcatctcgcgcgtcaacttcattctcaacggcgccatcacgttcggcatcatggcttctggcatggtctcgcagtcgatcaccgtcgccttcgatcgttcctacggcgtgttgaagcgtctcgggatgacgcccctcggacgcagtggggtgatcgccgcgaagctcgtggcggtcgcaggactcgagatcgtcgagttggtactcctgctcgtcgtgggggctgtgctcgggtggcacccagctggcaatcccatcgagttcgtcgtcggttgggtgctcgcgaccgctgcgttcgctggtgtcggtctcgtgctcggaggaacgttgcgggcagagctcgtgctcggattgtcgaccctgctctggctggtgctcctcggtctcggcgcgatggtggtgccgctcgggagtctgccgggcccagtcgccgatatcgccaaggtgctcccagcagctccggcggccaccgtgctgctccatggcatcgctgtcggcgggagcgcgccactgtgggcgtgggtgagtctcgtcgcctgggcagtcgtcgcaccggtcgcggcgtctcggctgttccggtggagcgcctgagtatccgccaagagcgggccgtcgaagcgtcggtaggatagagccatgcatcccgtcgtcgagcgagttcggtcggccgtaccggtctcgccgcaagtcttccgacgtgtggcgctcgccacgctcggcgtgtcgacgttcatcatcttcaccggcggcgtggttcgtctgacgcagtcagggctcggctgcccgacctggcccgactgcacgaccggccacttcgtggcgggcttcgagatccaccccatgatcgagttcacgaatcgggtcgtcacgttcttcgctggcctgctcatgtccttgacctgggtggtggccctgttgcgacgtccattccggcgggacctcgtgtggtggtcgctcggtctcgtcgtcgaggtcgtcgccgagagcgtgctcggcggtatcaccgtgctggagaagctcgcaccccccttcgtcatggcgcacttcttgctcgcgctcgtcgtgctatggaatgccgtcgtgatctaccacaaggccggccagcccgagggacgcccaaccttggcggtctcgtccgaggtgctgtggctgtcgcgggtgatgttcctcgtcctcggtgcgctcgtcttcgtcggtacggcggtcgcgggtaccggaccctactccggatccccggggagcaagaggctgcacatcctcaccatgctgcaggtgacctacctgcacgccgacatcgccctcgtcttcattgcgctcacgctcgcggacctgttcctgctccaccaggggcgctaccccgcacagatccagcgtgcggctcggagcatcctctggctgggcgctctccaaggcatcatcggctacacgcagtacttcacgggcttgccgcagtggctgatcgcgctccacatccttggtgcagcggtcatctggctcgcgatgaaccgctactacctcttgctgttccgcgtgccctcgacgcgcagggcggaccacgcggtcgcgccgcagcaggcgccttccgtcgcggctgccgactagcgatcgcgacggacgctagccttggtggtgttcgtctcgggaggtgcgtggtcgatgtcaccgtcaccagcccttgcgccggtcgagtccgaagaggtagccgagactcgcaccgaagagagctgggcgaccattctgtgggatgacccagtgaatctcatctcttatgtgatctatgtgctgcaggccaccttcgccttctccaaggtcaaggcgaccgagctgaccatgcaggttcacaacgagggcaaggccatcgtggcgaccgggtcgcgcgaggacatggaagatgcagcgtcaaagttgcatgcctatggcttgtgggccacggtgtcgcgcgcgtgagtgccgggccgttcgtccgtgatggcgacgtcgtcgtggtggtgctgtcggcgcaagctcgagatgttgtgagtcggagtctcgagctcgtcgctgggatcgttgcgtcgggacgcgaggaagcctggcgggttgctccgccgctctacgacgacccgttgctcgaagccgaggcgtcgctcgcgagccgaggtgatgccggcggcaccctcgatgaggcccagtcgctcatcggtcgttgggcgaagcgtgtccgcgacgtcgagcgcctcgatctcgacgcggctgatgaattcatgcgcgcgttgaacttcggtcggctggtcctcgcggagacccgaagcgtcaccgatgatcgaggactcctcgacctgtttgcttggctcatcgaggcactcgtggaggccctcctcgagggttgacgcaccctacccttgcgtcgtcacgctggacgagcgcaccgcacgacagtagggatctcgcacgtcgacgtcgacccgcgcggctcggcgtggtcgtcgagcagcgcggcctcgggcgtcgtggtgcccgaggccgtccctgcgacgcggccgctcagtcgccgagctctctcgggatcgcggtctggaagctgcggaacagctgcgtgaggtccgcgtagccgaggcccgatcccggattgaacacggcgccttgggagccggtgtagaagtcgttcgtgttggtgaactcaccggagatcgcaagctgggcgttgccgatctggccgctgtagtaggccgagccgtcgatggtgttcgaatcgagcggcgtgaacggcgacgacgtcgaggtcgcgaagcggtagatgttcggattccagaagccgagccgtacgcccccgagggcgctctcgtagacggcgtcggtcccgttgagctgaggcgcgatgaagctcgtgccaccgaagtccaccagctttgacccgtagacgctctggaactgtgggtcgtagaccgcatagccggtctgggggtcggcgttgaacgccaggtccggcgtgacgcggccaccgctcatgcccgtctgaagcgtcggggcagggttgaacgagaactgcgtcggctcgacgaggcctggtgcgacctgctgtggatcgatcggcgtcaagaactcataggccgagtagctccctgcccccaccatctgaccctgttggtagagcggacggccgaagagggtggagtagccaccgcctgatcccaccggcaagctcgtggctgcttgggcctcgttctggaagccgagtgcgatgtacatcggccacaggtagtcccagccccaggtcatctgctgcgggatggtcaccgactcggtgccgacttgggtcccgttcgccatgatcgggtaggtctgagtacccgggagcgtcgtgccgccagcggcggtgtcgtagggggagtcggagggcgagataatgccgaggttggtggtgccgatgtcacgagctgggttgtaggccccataatcgccgctcgcgatgaagttcgactgtccctgcgccgccatctcgaggaaggcctggttgaacgaggccgcataccccggtgactcctgcgctgcgtccaccgcagcttggatcgcggtctcggactcaccccagctcgacgagacggagccggcgacgttctggctggccgcctcgtagaaggcgtcgacgaagccgtagtcggtgttgggcgcctggtacacgacgatcttggccatcggcgcgatcgtgcccgactgctcgacgtcgagggtggtctcgtcggagccagcgttcagcgacaccggccctgcaccgccgtcgacgttgacgagcgcaagacgattcggcaacgtcacgacgtgcgcgatgttcctccagaagtacatcggcaccgaagggttcacgctcgccaaggtcacgatgccgatggtctgcccctgaccgaggtagcccgcttgctggagcggtgtgaggttgtagtcgctcgtgaaggcctgcggcagctgatcggtgggtgctgcggtttgcgacgacccagccgtgggtgcgacctggttgatgccgggcaccgcgagcgactcgtagggcgcgtagttcgacaacccgagcacggccagaatgttcgacgccaggttcaacggcatctgcggcgcgctgcgcgtcccgtagaccgtctgggtcgtcgcgggcgcactggctgcgggcctggtggtgacggtgaagttctcgagcaagatcccaagggccttgtcgtactgtgcggccgtgccctgcgaggtgacatcgaggccatcgctcatggcctgggagctgatgccgaactcacggaggaacccacgcagcgcgaggatgtactcttcggtctggccgtactcgagcgcgaactcatggggcgtcaggtacggaccacgccaaccagcagccacccgagaggcaagctgtccctggttgcgcatcttcaggatgaacgacacccgcatcatcgtcgacccagccgtggtgcccgtcggggtggcgtgcgagagcacatcggcaccgatgccctgcgacaccggcaccagcggatcagacgccgacgcgagcgactgcgcgcctggcatcgccagtgcagcgccgacgaggccgatggatccgaggattcccaggtatttcgtgcgagccaaacgcttcatcgctccaaccccctctgtggatgtgacgagggatctcgcagaccccgctggatcatacatcgcgtcgcgtcgtgcggtgggatttctacggagagtttgtgcgcttggcacgcagcggcaacattaccactcgatgtgggcgcgagaccacaaacgatgggccagagctgggcgcggcgcgctgaagtgagtggtcgggcgcaccgtgcgaggtggcccttccctgccgccgcgactcgcgctttcgaccagacagagccgcgtgggaacggtgcttgggctccatatcccagggcatcgagccaggactcatcgtcgtggcgctgagttcggctcgcctccgagctttcgacacacgcattggcgctcggagttcgccgacgtcgcagcggtcgaccaacgaggagccgagcaggtcgcgggcgcccgacgctgatgatgtcctggccgcgtaaggctctggtcgacaagggtggtctcggacagaggtcgtggtgtgccccgccggctgggtggtgagccgaaggcggtggctgtgcgggtgctcggtcggcgccgggcacgggctgtgccggcgatgtcgggtcacacgaagcactcgtgtcgacgacggctcagggcacgaggatgaccttgcccacggtggtgcgaccggcgagggcttcatgagctcgacgggcctcctcgagggggatgcgctcggcgatggtcacctcgaggaggccagcggcgacatcggcaaagatcgcctgagcgcgccatctgagctcctcgggcgtcgcgacgtagtgcggcagcgacgggcgcgtgaggaagatcgatccctgccggttcaggatctggggatcgacgggcggcaccgggccgctcgcctgtccatagagcacgagcatccctctgggtgcgagcgccgcgagcgatccatcgaacgtcgcacggccgacaccgtcgaaggcaacgcttaccccaccgagcctacgagcggcatcgacgaatccgtcgtagtcggtcacgatctgagcgcccagacgacgggcacgggttcgcttctccgcggtcgaggccgtcgccacgaccgtggacgcgacgcgacggacgaggtactgcacgagcagggaacccacgccgcctgcggctgcgtgcacgagaaccgtcgcacccggttccactcgagcgcaggagttgacgagcgcatggacggtcatgccctggagcagcaccgcggcggcgacatcggccgtgacgtcgtcgggaatcgtgacgagccgaccagccgggacgaccaccacctctgcgtaggcgccgagatgattggcaaaggccacgcgatcgccgatgctgacggaggtgacaccttcaccgacctcgatgaccgtgcccgcgccttcgctgcccaggacggtcgggagcgagaggggataccagccttcacggtggtagaggtcgatgtagttgacgccgatcgcctccagtttgatcgcgacctcaccgggggcggggtgcggctcggggacgtcggcgatctcgagcacctctgggccgccgtggcgctggatcagcaccgccttcatggtcgcctcctggttcaggtctgtgcgctagcaacggtagcctcgtggtgcgacaaggagggtcacggtggggcgagtgttggtggttggagccggcatcgtgggtttgtcgacggcatggcacctcgcagagcggggggaggacgtgacggtgctcgagcgccgagacgtcgctgccggcgcttcctacggcaacgccggctggctctcgcctggcctcgccatcccgctcaacgagccgtcgctggttcgtcagggcctctcgtcccttgcgtcgccgtcatcgccgctgtaccttgcacctcgtctcgagcgaagctggttggagttcgtgatccgtttcggcctcgcatgcaggacggacgtctggcgacgatcgatgcagatcctcggtgggctgaatgctcggtcgttggaggcgtgggaacgactcggcgatgccgtcggctaccagccgacgaccgcaccgatcgtggcggcgttcgcccgccgtagcgatgctgcggcgctggagcacgagttcgctctcattcgcgaggcgggcttctcgctcgagacgaaggatctgagcggcgacgagctgcggcagatggtaccgatcgcggcccccgcgctctcgttcggcatcgccatcgaggggcagcgcttcgtcgacccggcgcgcgcgacccaccgtgtgggttcggccctcgctgagcgcggtgtcgccgtcgagcgcgcagacgtggttgatctcgagcggcgcggagctcacgtcgtcgtgcgtacggtcgagggggccgagcacctcgccgatggggtggtggtcgcgatcggagcgtggctcggcccgctcgcccgacgtctcggcgtgcgagtaccgctgcaagccggtcggggctactcgctgcgcgtgccgatcgaacgcccgctcgacgtcccggtctacctcccgactgcgcgactggcgtgtacaccgctcgacggtgagctgaggatcgcggggacaatggccttcgagaggcccgacgatccgccgcgccaggcgcgcttcgacgccatgcgtcgtgccgcgcggcggttcttcgaaggggtgcagctcgatgcgccacgcgaggcctgggtgggcccgcgacccgtgacggccgacggcttgccgttgatcggccccaccgcggtgccgggggtctggctcgccgacggacacggaatgtggggcatgacccaaggcccccttaccggggaactggtcgccgagggactgctcagtgggacggtaccggaagcgttgatcccactcaatccgctccgctgaggtgaagcgatgtcacgctcttgtcgctcgaatccaacgggcgccagggagtgtgccgcctcgtcagtggtgttctcgagcactgcaggctgcgcaggtgccgacgatcgcgaagtgtgacaggcgtgcgcgaaagccccattgggtctcgatgcgcgcgatggcgggcgcaaagacgtcctcgggaatctccgtgaccgtgccgcagtgctcgcacaggaggtggaagtgcgacgatcctgcgaggtggtaggtggcggggctgtgaccgatgtggacgtgttcgatgatcccgacgcgttccaaggcgtcgagggttcgatagatggtcgcgcgatggacgagtgcatctcgctgctcgagggcgcggacgagttcgtccgccgtcagatgaccgcccgcctccgcgagggcatcgatgatggcgcgtcgcgcctgggtgacccttccgccccggcggcgcagacggtcgagggcttcgtcgcgatcgagggtgacgcgcgtgcgctcaggcacgggcgtggtctcgttcgagccggtagccgacccctcgtaccgtggcgatgatgctcgggttgttgggatctggctcgatcttggagcgaaggcgcttgacgtgcacgtcgagcgtcttcgtgtcgccgtagtagtccgacccccagactcggtcgaggatcagatcgcgcgtgagcacgcggccggggttgcgcaggaacagcaagaggagatcgaactccttcggaggcaggcggacctcggtccctcggacatcgacttggtggcgatcgacgtacacggtgatgccgtggctctcgaggatctcctctgcggcctgggcttggccctggtgcttggtgcggcgcatctgcgcacggatcctggcgaccagctcgctcatgcgaaacggcttggtgacgtagtcgtcggcgccgagttcgaggccgagcacggtgtcgagctcaccggaacgtgccgtcaccatgatgatcgggaccgaggactcctgtcgaatggtgcgacagacgtcgagccctgacaggcgcggcagcatcacatcgagcaggatgaggtcgggatggtgcgagcgactcaacgccagcgcctcttcgccgtcgttggccacgatcgtctcgaagccttcgcgcgtcaggccgaggacgagggcctcgacgaagctcggttcgtcgtcggcgatcagcaccgtgccgacgtgggcgcgcttgtcgtcagcggccatcgttcggaccacctcgtggaagcctcagctcgaatgtggatccaacgccctccatcgaggtcacgttcagcctgccgcggtggttctcgaccacgtgcctcactatagagagaccaagaccagttccgcccgttgcgcgtgagcgggcagcgtcgacccggtagaagcgttcgaagatccgctcgcgatcgcgagcggggataccgatgccctcgtcgcgcaccgcgagcacgatggtgtcgtcgctcgcgtcgaggctgatctcgaccgtgccccctggctcggagtacttgatcgcgttgtcgacgaggttggacagggcgctctcgagttgccaacggtcgccgacgaccatcgtgggcgtgacgggtacgagcgcgtccagggtgagatccgctcgacgtgcggtctcgtcgaagcgttcacgcaccgcttcgaccagggatcgggcgtcgaactcggcgagcacgacgccgctgccctcttcgatgcgcgacaggtcgagcaggtcggagacgagacgagcgaggcgatcgccctcgtccacgatgcgctggaccaggcgttgcgccgtcgtgggctcgtcctcctgggccagggcctcggcgaggagaacgatcgcgccgaccggggtcttgagttcgtgcgagacgttggccacgaaatcgcgccgtaccgactccaggcggcgcagctcgctgacgtcctcgacgaggatcagctggcctcgatcgtcgagccaggttcgacgcacgagaaaggtccgccttggcggaccgaacagctcgacagcgcgctcgacgtcgccgtgggctgccgggtcgtggagcaacgtggcgatcgctcgatcgagcaagatgcgctggttgagactctccgcaccgaatttcgcctcgacgtcacgatagagcgtgtgtccttcagggtcgacgagcacgatgccaaagggcatcgtggatgcggcgctgtgccagagccgcgcctccgcagtcgtcgtcggcatctcggctgggcttggttcgggagtgtccaccgtcgctccagtctaggagcctcatcgcgccctgatcgtgtcagtgatgacattctatgctacgctatgcctactcatggatgatggtgtcgtccgcaagggcgtcactcgagcaaaggagtgcaaggacatggtcacatggacgttcctcgacgtgtcgctggcgccggatccctcggcgttgccgggaggctccgtcctccagaccctgatcaacggcctggcgggctgggcgctgctggcaagcttggcaggtctcgtcatcggtgcggccgtgtgggcactcggtgcacacagtcagaactaccagcaggcctacctcggtcggcgggccgtactggtcgcgggggccgctgcgctgctcgtcggggcagcccctgccatcgtcaacttcttcttccacctcggacttggcgtggggtaagtcgtgggcttcctccttgcacacggcgcggcggcgatcgcccgtgcggtgtggacgacgttcacctccggcctcgatcacttcgccaccagcgcgatcgtggcgctgctcgcatggctgctcggcaatctcgggcctgttgttgccgctgccccgaccgtgctcccgaccgcgccggcactcgtcggtccgtacgatcacgtggccacggtcgcgggagccttgctcctgccggcgttcatcgtggcgatcatcgcgcgcgtgcgggagccggctcacggatcgatcgccgaggtcctcgcccgacctgcagcctgggtgctgtcggtcatcgcgacgccgcccgtggtggccacgctcgagcgctgggttggcgtggtctcggccagcgcctacggagcgttcgccgtggtgccgtccgctgctctgtcgttgcggccgaccgtggtggccggagggttgcgctcgagcgccgcggtcgtactcgcccttgtcgcagccctcgctgccctcgcgtgctatctcgaggctgtgggacgcggggttgcggtcgacgtcctcgtcctgctctggccactcgtctcgatcgggctggtcctgccgggggcacgaaccctggtgcgccgaagcgccgaggtcctcgccggtctcgtcctgctccaactcgtgctcgccctcacgctcgggctcggggccgcgattgcgcaggcgaatggttcgcgtacaacggccctaccggtgatcggcgccgccctcgtcgtggcggcgagcctggcgccggcgctcaccttcggcatcgtgccgatcgccgaggtgcgtctgttcgaggtgacccggggccttcgacatctggcgagcacgggcctccgacggggcatcgaggtcggagggggagtcgtcgccgaagccatgccacctggagacgctcgccctacgatcccgccgtacgaggggtatcccccgcccccggaggtgctcgagcgcgcgaagcacgacccatgggtgcgggcgctcgtcgacccccctcgtcgtcgtccgtggcagcggaggcggggatgagcggcgtcgagctcggcacgccggccctcgggtcgcgggtcttcggggtgccggttgccaaggcgctcgcatggggcgcggtcgctgtggtggtcgcggcggctgcggcgcgcatcggcgggatcttgggcgtggtggtcgcggcggtcgtcgcgaccggcgtcgctggagctgcctcgatcgccgggtggcacccactctggtgggtcgtggtcgcggtgcgggagcgcgcgcgacgcgctaccgagcgggttggccagccgcgacgcgccgttcgcttcgatcccgatgccggcagtgtccgcattgctcggctcgtggcacgccacgctggcgtcctcggtcgggggcatgatggaagtctcgacgacgcgtggggcgagctgctccgggtgctcgggacgagcttgcgtggccgcgaacggtttctcgtgcgttcggatgtgatcccggcgatcgaacgagagcagttcgctctcgagccagacgatcgctggctggccgagcggacctggatggtcgagacccatctcggggtcgcgagtgacgagcgccgtgggcgtggacggcgcgtccgactcgtccgcgctctcgaggccgccgaagctgcggctcggggccagctcgcgctcgagccgatctcgtccccgtctgccgtcgcatggagcgtgctcccgcgcacgggtgaccgtccggatgccgtcctcgagcggaccgacgcactagagatcgacggcggcttcgtgcgcgccctccacgcggcacgctttccggttggggcggtccacgcgtggcagctggcagggctgttcgcccccgcaggaccgcgccgcgtcgtgaccctcgtcgcccaaccgctcgatcctcgaagtgcgcttcgccaactggggcgccatcgtgtcgagacagctgccgaccaggagcttcgccggcggcatggctatcggctcgggatcggtgagctcgggcgatcggatcgtctcgacgagatcgagcgggagctcgcgaacggtcacgccctgtgtcgatgggagctgttcgtggtcgtggccgcgccgacgctggccgagctcgcagctgagaccaccgccgccatcgagcgggccgcagcctgcagcgtcgatcttgccaccgtgctcggacgccagcgtgaggcggtcgaactcgcgctcttgggggtgtccggatggacctaggttggcaggactcgacccgtgcgctctcggtgctcgcgtttgcgcccacgcctccgccgcagccggcgccgagcaccgtcgtcgggatcgctggcagtggcggactgtttcgcttcgacgccttcgacctctacacccatgggtggctgacgaatcccaatgtgctgatcctcggcgacgtcggccgcggcaagagtacgctcgtgaagctgctcctcgtccggtctgcgatcgcggcctccggcagcttgctggtgctcgatccgaagggcgaatatggcgccgtcgctcgcgccgtcggcgcgagcgtcatgcgcccgcgcgcggaccatggcgggatcgatcccctcgctggctcgctcgatcagcgagagcgggctcgcgccctcggcagcgtgctcgaagcgttgtgtgagcgtccgctcgacgagctcgagcggcgtgcggtgtcggccgtgtgcgtgggaccgctcgcggggctcgccgacgccgctcgacgcctcgcggcgcttgacgcagaggtgttcgatgcgcgacttgccagtgccggtctcgaacgggcggcgcggctggcgctgtggctctcgcgcgtcgtcgacggggatctcgcggggatctgggagacgcgaggtggggggagtgcgctggctccgcgggtcgtcgtggatctcagcgacgtcggcgccgagcgttgggttcggatcgcggtcgcagcactcctccgcatgcggttggcgcagcttggcagcggtgaggttgcaggtgggctcgtggtcgtcgacgaggcatggacgctcgcgagcgagaccagtacgcgaacgctgctcgtgcgagcgctcaagctggcgcgcgcctacggcgtcagtgtggtcgcggtgacacatcgcctagccgacgtcgccggtgcgatggatctcatcggcgacgtcggtaccgtcgtcgccttcggacagtcgtcgtctgcagcccaggacctcgtcactgagctccatctcgacgagcgcgtgcgcgagctggtcgccggtctcgggcgcggtgtcgcgctgtggctcctcgggggacacagctggctggtccggcacgtcgttcgggaggaggaggtcgcactcgtcgacaccgacgcgcggatgcgggctccagcaccatgagcctcggtgcactgatcggaggcctcgctgccatcgcgaccctggccggtgtcggcaggccccgtacaagagagcatcgcagtggcccgcgaccactgccgcgcaccgcggggatcggcatcgtccgcagcgacgagatcgtggttcgactcgggcgctggcgccgtgtcggcgtggggcgaggatcgtcgttgctcgtggtcggcccgacccagagcggcaagacgcgcagggtcgtggcggagaacctgcgacgtcatccggggaccgtcctcgtcacctccgtcaagggtgacgtcctcgatgcgcgtgcgctcgagcggcgtcacgacctcggggacgtgtgggtcctcggtgatacgccgcgagcgacgcacgagtggcagccctggttcgaggccatcgacgacacccatgcactcgcgatggcagatcgactgctggcgatggtgcccgagcgcagaaccccgagcgccgaggttcggttctggcacgagcttgcacgtccctacgtggccgcgtggctgcgccttgcgtggtacggagagcaggtgccggtgggtgagttgctcgtccgcgcagccgaggtggcgggggacgaacttcgtgcggcccttgatgagacggtcgccgatggccgtcagcgtgactcgctgcacgtgaccatccaggcagcgctcggcgcggcccgaggaccgaggagtcgtgggtggccggtccgactcggcgaggccctcgccccgacggtcgtggtggtgggttcgctcgccgagcaggagcgccgctccgcctggtatgcgacgctcctcgacacggccttcgaggccatcttgcgccagccggccaacacgctcgtcctcctcgacgaggtggcccacctcgcgccggtgcctcgcctcgcgcacgtcgctgccgtcagcgtgggtctgggcgcacggctggtgacgatcgcacaggactttgcccagttggaggcggccttcggggtcgaagcagcctcattggttgccaaccaccgtgcccgactgttcctcgaccccgcccacgatcctggggttcgagcgcacctcgcggccctcgggctgcgaggtgacgagggcgccatcctcctcggccctcgtggtgcgcggcgtccgatccttgggtcggtggcttaggttcggcgaggcgctgccgatagctcgcacatgagcccttccacgattgcgcaggcgcttgacgacgtcgaggtcgcactcaccgctctcgaggcggcactcgaccgagacgacgtcgctgcgctcggacccgcgtccaacgagttggctcgtgcggcggtgtcgctcgggtcactcgtggccgaggaggcgccggtcgacgccctggatcgagaacgttatcgctccctcatgccgcgcgtcgacgcggtggtcgctggctgtgcgtggcgtgccatgctggtcgcgcagctcctccgcgacctcggagcggatcttggtatctacggtccggatggactcctcgaggtgaccatccccgagcgctcgagtcagctcgcatgagcggcggtgccctctacatcgcactctccggcctcgaggcgcagcaggtcgggctggacgtcgtcgcgcagaacgtcgcgaacgccaacactccgggttaccagagcgagtcggtggacctcgcgaaccagcaactcccaggcagcccggtcggcgacggggtcaccgtgcaaggagtgctccaggcgcagaacacgttcgcgcgctccctcgagctcgggtcgcaggcggcgtcgtcgtacgcgacgcagttgtcgtccacgctcaccgcggcgcagtccgggtccttccaggagccgtcgtcgaccggcatctccgagcagctcaacggactctggagtgcctttggccagctgtccgacacgccgacacagctggcatcggcacagtcggtcgtcgctgcggcgcagcaggtcgccgaggcgctcaaccaagcggcctccaacctcacgggtctgttcaacgacacctcccagcaggcttcgctgctcgtggcacaggtgaacacgcaacttgcgcaggtggcgtcgctcaacggccagatcgcggcgcagagcggcggtgaggtcggagcggcgaactccctcatcgatgcgcgcaaccaggtgctgtcccaactcgccaacgagatcggtgccacggtggttccggcgtcgtcccagcaggtgaacgtcctggtcgggggagtgacgctggtccaggggacccagtcgaacgcgctcgccgcagcgatcgcggctcccggctctccgccgaccgcatctgggacggcccagatcctgctcgcggggacgagtacccaggtgccggtcacgagcggatcgctcggtggcatgctcgcgtcgttgaacaacaacctcccgcgctacggcacccagctcaacgcgactgctcaggcgttggcgacccaggtcaacgggctgctcgcgtctggtcagacccaaggcaccactggcccgattgcaggccctccgttgttcgtcgcggctggaggtggcacgctcgatgccggctcgatcgctgtcaacccccagatcgaagcctctccgtcgctgctcgcggcctcgacgacgccctatgccggtggcaatggtcagaacgccgccgcgatcgcgaacctcggcagcgccgcagacggcccgaatgcactctggtcacaggcggtgggtcaggtcggactcgatgtgcagtcggcgacgtcgctcgcgacctccgcggcccagcaggcccagagtgctcagacagcggagcagtcctctgtcggcgtcgacgtcaacggccagctcgtcaacctcgtcacctatcagcaggcctaccaggctgcagcgaaggtgatctcgacggtccagcaagccctgtcgtcgttgctgtcctcggtgtcctaggaggggcgatgcaacccatcatgacgtccatcagcctggcgaacacgctgtcgtcctcgctcgatagctaccaaagccagctcagccagctccaggtgcagctgtccaacgggcaagccatccaggcgccgtcggacaaccctgccgggacggtgaacctgcttggggcccagacccagctcgccgcctaccagcagtaccagtccaatctgtcgtacgggcagacggtggcccagctcgcgaactcctcgctgacgcaggcggtgagcatcgtccagcaggctcgaagcgtcctgctccaagcaggtgctcccggggtcacctcacaggtcgcctcggggcttgcaacgcagcttcagggactcgagacctcgctgctcggcgttgccaacacgacgtatgagggccaggccatcttcgccggcacggcggacgtcgcaaccgcctatgtccagcctggcgggcccggtactgcggtgacctatcaggggaatcagcagagcgcgacggtcgcgggcgcgccgggcgtcgctctggcgacctcgttggccgacccattcggggcctccagcccgaccggcggcgtgttcgccgcgctgaaccaggcgatctccgacctgagttccggcaacacctcggctgcgaccaccaccgatcttgcgtcgctgactaccgcgctccagaaccttacgaaccaagcgggggcggccggtgaggctgtcacgcagttccagaacctcacgcagcaggtcacggcggcgattacgcaggtgcagagccaggtctcctcgctgcaggggctgaactatgcccaagtcacgacccagtaccaaacgctgctcaacaactatcaggttgccttgtacgcagcggcccaggtcaagcagccgacactggcctcgtacctcgcctaagggatctcgcatgacacgcacaacggaggatgccgctatggccatgaccaccacgcagccggcgatcgcgacggtgccgatcaccttcccggtcggtgtgcccggcttcgaggaacatcaccgcttccacctcgtcggactcggccccgcctatggaccgtggctcgcgctccgatccgcgatcgagggaggtccgaccttcgtcgtcgcccagccctatgagctcggcgtcgagctgacggtcgagatcgacgacctccatcaggccgtgctcggcattgcggatccgcagcaggtcctcgtgctggtggttgcgacgctgcgcaacccacacccgaccgtcaacctgcgcgctccgatcgtcgtgaacgtcgaagtgctgcgcgcggcgcagatcccgcaggatcgggacgactacctgctcgaggcgccggtgaccgtcccgctctacgacaccgctcgcctgcgcccgtcggaggcgagcgacgagcccggggctgatcgctgaggccccaccgtcaggatcacgcgtggcgctgcctcggcgcgacgggatctgccgacgcccgaggttggcgccctcgaccgacacggttggttggctgccaggatggggagctgcggcctctccgcccccgcatcggctcatggctcgcgagtcggtgagcggccactctcgtgtcatgacggtggtcggccacgagggaggcgtcgttcgacgtcggtctcgagcgacaggctcgttcgcactcagtttcgcgattgaccgtgccgtcgtcgtggtccgcgctcgacgtggcgaagcacggtcacaactggccgccgcgccggtcgcaagggcgtgtcgagagcgtgatgagtgcgacctcgatccctaggcctcggctcccgggcctgaatcctcgagatgcgctggatctgtgagtactcgagcactctccgcggcctcacggttcgcctgttggagcgcctcgaagacttcttgtcggtggacgtccacggatttcggcgcctcgatcccgatccgcacctgatctcgatgcacatcgagcactgtgatgacgatgtcggtgccgatcacgatgctctggctcgccttgcgtgtcaggactagcaccgcgcctccttgcgcccgaaggcactcgttcatgcccccaccagggggcagttcctccacggtcgagaggcctcttgcagctctttgcgctgctctgtgcccacgacgcgcctcgttcgcaagtgtagcatcacggtcggactccgatccgagttccttcatcgatcgctgaggcttcaagcgaacgtcgcaacgtgccgatgcgccaaggtacgagtgatcggaggagcgatgaccggcgcttcgccagaggagcttgcggagttccttgcggagtcacaggagaacttggaccgcttcgatcgtgacgtactcgcgctcgagtcggacccgtccaaccgtgacgcggtggcctcggccttccgcgcgatccacacgctgaagggcacatgcggcttcctcggcttcggccgtctcgaggggctcgcgcatgacggggagagcttgctcgcacgggtgcgcgacggggcggtgcgagtggacgccgcggtagcagacgcgttgctggctctcgaggacgcggttcgcaggagtctcgacgccatcgccgccaccggcgacgaggacgacgagcactgggaggagctccgcgcacgcttggttgcgctcgcggagcaggcccacgaggcgccgcggtcggtcgcgggcgcgaacgccgtcgtcttcgcgccagcgccatcgtcgggcgcgcctgccgagctctcgtcgggacccgagtcgcaggcgtccgtcgagggcgacgtggcgcgcggcgccgagccggatgggaagtctggcgctcggccgacactcggcgagaccgcggtgcgcgtggacgtcgggctcctcgaccgtctcatgaacctcgttggggagctcgtgctcgcgcgcaatcgggtcatgcagctcgcccaatccgagggcagtgcggcgctcgcagcgagcacgcagcagctcagcatcatcgcctccgaactgcaagaacaggtcatgaagacgcgcatgcagccgatcgacaccctgttcgcgaagttgcctcgagtcgtccgcgacctcgccagggaactcggtcgcgaggtcgaactcgtcctcgaagggcgcgacaccgagctcgaccgcacgatcatcgaggcgatccgcgatcccatgacgcacctcatccgcaacgccatcgaccacggcatcgagccacccgacgagcgccggtcccagggcaaggcggcccatggcgtcctgcgcatcgacgcctaccacgagggcgggtcggtgattatcgacgtgagcgacgacgggcgaggcatcgatctcgaagccgtgcgggctcgtgcgctcgcccgcggtctcgtgcacgccgacgagctcgcacgactcgggccgcgggaggtggccgagctgatcttcgtgcccgggttctccaccgcgacgaccgtcagtgcggtgtccggccgtggcgtcggcatggacgtggtcaagaccaacgtcgagagcgtcggcggcagcatcgacatcgactcggatccgggccgaggtacgcggatgcggctgcgcatcccgctgacgctcgcgatcatcccggcgctcatggtcgagacgcacgggcagcgcttcgcgatcccgcaggcggcgcttgccgagctggtgcggctcgagctcgatggtcggcactcgctggtcgagatcgtcgaccacacccccgtgctccgccgacgcgaccgtctggttccgttgctcgacctcggagcgatcctcgggcttgcgccgcccttccccgagcgaggactcgatgcggtgagcgtggtgatcttgagcgctggcgccacgagcttcgggatcgtcgtcgatcggatcgtcgacacgcaagagatcgtggtcaagccgctcggacagttcgtgagccagctccagtgttactccggggcgaccatcctcggcgacgggcgggtcgcgctcatcgtggacgttggcgggatcgcgcagctcggcggtctcgcggtggagcgtgcacacgagacgacgtccgagtcggtaggggaagccgagtccgaggctgagcccgtgatcgtccttgctgcgggcgggacggagcgactcggggttcgtctccgcgagatcgagcgcctcgaagagttcgcgctcggcgcggtcgagtacgttgaagggcacgaggtcgttcagtatcgcggtggcgtcatgcgtctcgtccgcctcgctcacctggtcgggctggcgtcccagcctgcgcgccccgacccgatcaacgtgatcgtggccgttgatcctgctgggcagctcgtcgggctcgtcgtcgacgaggtgctcgacatggcgctcgccccggtgagcaggacgcacggcgcgatcgtgctcgacggcaagctcgtccgggtcctcgaactcgacgcgctgctcgagcgtgcgggtgaggtgagccatgtctgaggtctcgacgctcgcgaccttccaggtggcccatctccggttggcgctcgatgtcgagcgcgttcaggaggttctgcgccgccaggaggtcacgccggtgccgctggctccgagttcggtcgaggggctcatcaatcttcgaggccagatcgtgaccgcactcgacctcgccgacccgctgggggtgaccgagtccgggacccgcgagacggcgttgatcgtccgtgtgggcgacgagctgctcgcgctgctcgtcgacgacgtcggcgacgtgatcgaggtgcccgacgagcagcgtgcaccgatcccggagacgctcctcccaccgctgtcggacctcgccgccaacgtcgtcgtcggcgctgacgacgtggtcgtcgtgttggacctcgagcgactcctcggtgcgttccgttgaggtcactgctcgtcgtcgacgactccggcgtcgtgcgcatgatggtgcggcgctggctgctggaggcctgtcgtgatctcgaggtcgtcgaagcctcgggtggtcgagctgcgctcgagctcctcgagcagcgcaccgtcgatctgatcctccttgatgtcgagatgcccgacctcgacggcctgagcgtggtgcgcacgctgcgcgtccggggcgttcgtaccccggtcgtgatgttctcgaccctcacgagtcgcggcaccgacgtcgcggtggcggcccttctcgccggcgcaagcgacgtcatcgccaagccgcaggcatcgaaccagggcgcgggccgtcaagcgctcgtggaacgtgtctgttcgttgctggcggccgaggaggagctcatcgtggccgcggcaacccagggcgtgcctgcgtcggcccgggtcgtcgagcccgccacgccgcgcgtgggcgcgggtgccccacgcatcgcacaccgcgtgccgtggcaggccccggcgatgcgcacgagcccaacaccgcgtcgtcaggaggtgccgacccatcgtgcggcacctccgctgaccgtcctgcgccccagacggccacaagccccgggcctcgtcgttgtggcctcatcgaccggtggaccccaagcgctggcttcgttcctcgcgggcctcggtcgagtcgcggtgccgacggtgtgcgtgcagcacatgcccgccagcttccttccgctgctcgctgcccgcctcgccgagcagctcggctcggacgtcgccctggccgaggacggtgaggtcgctcgcgcgggcaccgtccgactcgcggctggaggccgtcatctcatcgtgacggcggatcgccctgacgggagccttcggctgggctacgtcgatcaaccaccggagaactcctgtcgcccatcggcggacgtgctgtttcgctcggccgccgcgaccggcgtgcgagcgatggcggtcgtgctcacgggcatgggggccgatggggccaagggtgctgctgccgtcgccgaggcgggcggtgtcgtcgccatccaggacgcggcgagcgctgtcgtctgggggatgccgggtgcggtcgatgccctcggcgtggccagcgtggttgcgccgccagccgagctcggcgaccgcgtccgtcggctggttggcatgccctgatggtcgatcccggcgtcttccagcgcattcgtgcgttcctgcgccgcgagatcggtgtcgatctgggtgcggatcgggcctatctggtcgagactcgcctcggttcggcgcgatcgctcggccgttggcgctcgatcgatgcgttgacgcaggccgcggaggccggcgacctcgaggcgcggcgtcgcttggtcgaggcgctcgtcaccaccgagacgttcttcttccgagacagtgcggccttcgacgcactgcggacgcgcgtcttgcctgagctgttcgagcagcgccgcggtggcaccatcgcgatctggtgcgctgcgagttcgtccggccaggagccgtactcgatcgccatcttggtggcgagccgatttccgtcactgcgctcgcgggtgcgcatcctcgccaccgacgtctccgaggacatggtcgagcgcacgcggcgcggggagtactccgcgttcgaggtgcagcgcggcctggaaccgcggatgctcgagcaagccttcgtcccgatcgccggagggtttgccgtacgcgacgagatccggcgcatggtcgaggtccgtctcctcaatcttgcccagccgttcccgtcgatcgggcccttcgacgtcgtcttcgtccgcaacgtgctgatctacgtgccgccaacggaccgacccgccatcttggcacgcgtcgcagaacggatgcggcccggcgcctacctcgtcctcggcaacggtgagtcggtcggccctgaggtgcgcgcgttcgagcgcgcgagtgacctccgggcaccgatctatcgtcgggtcgacggagtttgccgagcaacgcagcatctgcgagactcaagggcagcgccgagccgaggaggagggggtgccacggggtagcgtcgtgccgctttcccagagcgcgtaccagagcatcagatctgccatcgtggacctgacgttgccaccgggatcgttcttcctggatcgagacgtcgcggatctggtcggtgcctctcggacgccgattcgtgaagcgctcgcgcgtctcgaggtcgagggttgggtcgagtcggtgccgcgcaagggctttcgcgtgagcggcgtggacctcgacgaggtcagtgagatggccgagatggtggccgggatcgaagcggcgggctgcatcagccttgccaccgagcaagatcgagtgcgtacctcgctgctccgtgagaccaacgcgcagctcggcgtgttcgccgaggagggcaacgtcgtggccttcctcctccacgacgaccgattccaccgactcaccgcggcgggtgggctcggtcatcggctcaccggttcgatctactcgctcttgatcgatcaactccatcgcgcgcgccgactgcgccccgcgtctcccggtgacctcctgcgtcacgtcgaggagcatcgcctgctcatcatgtcgctcgagctcggtgatgccgaggccgcggcgctgatctgtcggggccatcgtcgccgcatggtcgagcgactgcgcacgacgatcgagagcctcggacgtgaggtggtcgagacgacctcgatgctggtagacgccgcgggtgacgagacctcgtcgagcgcgagcgatgaggaggccgcggtcggtgacgcggcgcgatcggacgccaaggaacccgaggaaatcatcggccagatgagcgctgaggccgccgagcgttcgcagcgtcgtcgggtgaggctcgggcggcgacgccgcagtgagggaggctgaggaccaggaggcgtcaagcgtaggccgcgccgtgccgataccacgatggaagaacgagtggcgcaaggaggcacggtgaagattctggttgcggacgactcgcgggcgatgcgcatgatcgtcattcgacagctgcgtcacgcggggctcgacgacgccgagttcctccaggcagagaacggcttcgacgcgctcgagctggtgcggcgcgagcagcccgatctcatcttgtcggactggaacatgccggagatgaacgggctcgagttcctccaggcgcttcgctccgagggcagcgacaccccgttcggcttcgtcacgagcgagggaaccccggacatgatccggatggctcgttcggctggggcgacgttcctgatcgccaagccgttcacgcccgagggattccgcgagacgctcgagggtgcgggggtcttcgcgtgagcggtgtcctcgacctgtggtcgacggcactcgccgacggcgtcgcctcgatgcgtgaaggcatcttcgcgctgttcgatggcgtggtcgagcaggttcccggagcgagcgtcgagggcctgccaggtgcgtgggtctcctacgtgggggagcgcctcgccgtggagtttgccctcgtcgcgccagacgtgaccttggtggcgctcacggcggccctgacaggcctcgcagagccctcggaactggccgtcagcgacgctgtgatcgagatcgcgaacatgctcggcggcgtcgccaagcgtcgcctcgtcgccgctgatccgacgttgcgcaccggcatgccgaagttcctctacgccggtgcggtcgtgccacgccagaccgattcgctcgtcctcgaggccggcaccgtggccggtccggtgctccttggcgccatggtgagccgcgcagcggatcgcgagcttgcggagctccacccatgaccgtcgctggctacgacgtaccgttgctcccacgcctcgacgacctcgagcggttgttcatcaccttgctcggtcgagaggtgcggatcaaccgactgcgccagggcgtgacgatcgccgagcccgatcgcatcggcacctatgtggaccgtagcggcgccctccggtgcgtcgtggccgtcgatcgcacgctcggtgctggcctcggcggagcgctcgcgctcatccctcccggggcggttgaggaggacctcgccgagtccgacgagctgcccgagcacctcgcggacaacctccatgaggtgctcaacattctcgcgagcgccttcaacgagacgcgcgagcgggcgctgcacgtgcgccttagcgacgtcgtcaccgccagcgagggctcggaggcagttcacgcactcctcgcaggaggcacgggtcgcgtcgactgcgacgtcatcgttcctggctatcccggcggccaactcgcgattcggatccagtgatgctcgttcgcgtctgtgaccacgagcgtgtgggggccgacggtgcggcgtgggtgctcgttcctggcgagtccgtccctcccgaccagatcgctgctgcgcctgccgtggtcatcgtggtcgaggatgcgctggtcgatgcgcggagcgcgcggcgtctcgtcgaactcgcgagccagggggtcgtcgcggtacctcgctcgccgagtgtcgtcggcagaggacatgtcctgctcacgaccggtgacgacgtcgggaccgtcgagggtcgtgaggcgctcgccgaacgagtctcgaagcactttgcgggcctcaccgaggacctcgagctggtgcccacgctcgccgtggccgtgcccggcgcttgggcagcgagagcgctggacgaacgttggacgacggtccatgagctcttcgcgcggctcgtcgactcacggccagccgaacttgcgttcgatgccgtcgcggtggcgcggcgtcccgttgaggggctcgtgccggctgcaccgcggcgacgccccctggtgtcggcctgcatgatcgtgcgtgatgaggccgtgtggctcgctgacgccatcgattcgttggctggcttcgcggacgaggttgtcgtctacgacaccggttcgaccgacgcgacggtcgatgtggctcggcgtcacggggctcgtgtgatcgagggcacgtgggatgacgacttcggagcggcgcgcaaccggagcgcggcggacgcgcgcggcgagtggatcgtttggctggacgccgacgagcgcctcggtggcgatctcgccacggcccgggcacgtctcgcagacccgctagcgcagtgggagggctacagcgtccggatccgcaacctcacgggtgtggggctgacatgggcggatcactttgcgatgcggctctttcgccgtgcggcgggcgcctggcgcggagccttgcacgagacggtctggtcgcgtgatcacgctcggccgctcaacgcgcacccggcgagcgagctgcatctcgttcatctcggctacttggacgtggtgatgcgccaacggggcaagggggagcggaaccttcgggttgcatcgcacaacgagtctgcgtccgaaccgctcgaggcgctcgtgcacgagatccgctcacggttgctcgccggtgagcacgccacggtcgttgcgctggtggaggaccgggtcctgccggctcctcctgggccgttgcgcaagctcggactgctcgctggcttcgagagcgccctcgcgctggggagcttcgacgtcgcccgtaccttcgtcgacgcattggccacgcagcccgatgtcccagccgccttcgcgctcgaggcgagcgctcggttggccgccacgaccggcgacctcgagggggcccttcgcgatctcgccggcatcgacacgcgcgtcgaggatgtcgacggtctcgtggtcgatcccgagcgccttgccggcctcaccgctcgctgtctcgccgggctcggccgcttcgatgaggcgagcgacgtcgtcgtcgcggcgctcgcgcgtggcacggtcgacgtcgatcttcgcgaagtcgtcgcctggttcgaccacgccaaccgaccactcgccgatcttgagtccgcgatccatcccgagcagcgtcagctcatcgcggcctcggtactccccgctgcggagcttgccgagcgtctcttctgggcgttcgtcgaggcgaaccccgcttgcaccgtctggcttgccgcgggcgagctggcagcgcgacgcgtcggcggcccggtccacgagcggtggcgtcgactgctcgccgacgccggcctcgtaccgagtgcctagtaggggtgcactggactgtaacgcactggactgtcacgcgcgggcgctgcaagagccatcggctccaggcgggaagagagtggcgcctccgggacggccggcgctggtgtgcggcgtcctctctccggtggctggagcagagatcgcaccccggtagctccgagtggcgccagccactgcctcgcgcgtcgtcgtccccgacgcaggcgagggctccggtgccggtcctctcgctgcgcggacggccgtggggcgtggtggcgcgtgcggaaggccccggagcgagccctagtcgtcatccacgtggataggagcgctgctcgtgtcggtttcgcgagccgtgcggggccgtacatcttggtcggtgcgacgacgtgagctcctcgccggggatgattccagaatctgacccatcccgtgctccgctggtgggtgtcgatcgggagagggcagagcagttcaagcacgcggaggagcgtgactgacgcgaaggaagccttctcggccctcaggcggtggtggcgtcgctcaaggggagtgtgacgtcatcgaatgcgagttcatggccctgacgcaggaggcgcaccgtaccgactccgacgcgctcgagggtgccgtcgcctcgaacgacgaggcccgtctcttcatcgatctcggcaaccgtgacgttgggtggagcaagacgaaccgtgcggcttcgtaggtcgcgtggccaggtgtcggcgtgcgggatgacggcgagaccggggatcatcccgagccccaccgtgagcgcgccaccacgtgggtcgaccatgggatcgccgatgaccatcgccccagccgacgaggcgaggacggtcgccccctgatcgagtgtggcgcgcagtgcatcgaggatcggggtcgcgcgcagcacgcctcgcaggtgaaacggtgagcccccgatgaggtagaggcaccgcgcggtgcgaaccatgtcggcgagcaccggatcgaaggcctgagcgcgctcgtacagcggtagctcgacgacgcgaacccctgctgccccgagtacggattgggctcgttcgacggcgcgttcgggtcgctcgaaggcggccgctgtcgggacgagcagcagttcgccccctgcctcggtggcgaacgtcgcttcgaagctcgcgcgcgaaccgaactcgccacccccgaccaacacgatggttcccagccccacgtcgaggatcctaggccgcgaccgtggcgagcgcgccggccacgtccccgataggatcgcgccatggagggcagtgatccacccttgtcgatgcccgatcccgtcaggcggctcggcgtcgtcggtacggggacgatggcgaccggcatcatcgaggtcgccgcgcgaaaggccatcgacgtcgtcgtctgggcccgctccgaccagagcgcgtcagcggtccgggagcgcttgcaagcccggctcgcgcgcgaggtcgctcgtggcgtcatcgctgagcaggccgcccatgaggtcggggagcgtgtcagcatcacgcgtgcggtggatgacctgggtgggtgcgaggtcatcgtggagtcgatcgtcgaggcgctcgagcccaagcgggttctgttcgcgcagctcggctcggtgaccggtcccgagacggtgctcgcctccaatacgtccaccctcggcatcgggcagctcgcccaggtcaccgagcatcccgagcgtgtgtgtggactccacttcttcaaccccgtgacgcgcatggagctcgtggaggtggtccggggtctcgagacgtcgcccgcgaccatcgctcgtgcgactgcgttcgcggtgcagctcgccaagacgcctatcgaggtcgaggacgaagccggcttcgtcgtcaacgccttgctgttcccctcgatcaacgccgcagtccgcctggtggagcgtggtgtcgcgagtgccgaagacgtcgaccgcgcgatggtgctcggcgcgaaccaccctctcggaccgctggccctcgccgatctcgtggggctcgacgtcaccgtcgcgatcctcgatcggctctgggcggcgactggagacccggcgctcgtgcccgcgccgacccttcggaggctcgtcgcggcgggccggctcggtcgcaagagcgggtggggtttctaccgttacgacggaggggatcggtgatccgccttcccgagcccgaccgaccctgggtcatgcggacctatgcgggtcactcgagcgcccgggccacaaacgcgctgatgcatcgcaacctcgcacgcggtcagaccggcctctccatcgcgttcgacctgcccacgcaactcggctacgaccctgacgacgcccttgctgagggcgaggttggcagggtcggcgtgccgatcgcccaccgcggcgacgtcgccgaactcttcgacggtctccggctcgacgccatgaacacgtcgatgaccatcaacgcaaccgccccctggctcttcgccctctacctcgaccgggcgagcgaggaggggagtgcgtggggggcgctggcgggtacgacgcagaacgacctggtcaaggagttcctctctcggggcacctacctgctcgaccctgccaactcgaagcgagtcagcgtcgatctgatcacgttcgctgtcgagcacgtgccgcgctggaaccccatcaacgtctgttcgtaccacctccaggaggctggcgcgacgccggtccaagaggtcgcgatcgccctcgcgacggcgatcgacgtgctcgatgccgttcgagctcgcggcgtcggtgacgacgtgctcgcacgagccgtgggtcgcatgtcgttcttcttgaacgcaggcattcgcttcatcgaggaagtcgccaaggtccgggcattctcccgcctctgggaaggcatcgttcgtgagcgctatggcatcaccgacccacgtctcgcgcgctttcgctatggggtccaggtcaactcgcttggcctcacggagctccagcccgagaacaacgtctaccggatcatcctcgaagcgctcggggtgacgctctcgcgcgatgcgcgggcgcgggcgttgcaactgccggcgtggaacgaggcgattggcctgccgcgcccggtcgatcagcagtggtcgttgcgggcgcagcagatcctcgcctacgagaccgacctcctcgcctacccggacatcttcgagggatcgtacgtcatggagcagctcaccaccgagctcgccgatgcagccggcgccgagctcgagcgcatcgtcgccgacgggggtgcgttcgcctgtgtcgacacgttgaaggcggagctcgtcgcgtctcaggccgagcgcctccgagccatcgaggccggcgatcaggtcgtggtcggcgtcaatcggttcgtcgagtccgagccgtcgccgctgcgtcgaggcgacgacgtcgtccaccaggaggtcgaccttgccgccatcgaggcgctcatcgcgcggctgcgcgagcatcgacgccagcgtgagggacgtcgtgtcgtcgaggcgcgccgggccctcgaggaagcggctcggagtggaacgaacgtcatgggacccacgttggagctcgtccgtgccggcgggaccaccggtgagtgggcggcgacgctccgcgacaccttcgggtcctatcgcgccccgaccggtgtgggtgcggttgccgaacgcctcggccggcggggtcggtcggtgtccatcgtcgcctcgccgccgccgcgcctcctcgtcgccaagccgggactcgatggccactcgaacggcgcggagcagatcgcggttgcggcacgcgatgcgggtttcgaggtcgtctaccagggcattcgccagcaacctgccgacattgcggcggtagcgcgcgacgaggacgtcgacctcgtcggcctgtccatcctctcgggctcgcaccgcacgctcgtaccgcaggtcctcgaggcacttcgggcagctggcgtgacggttccggtcgtggttggcgggatcataccgccacccgacgcggcctggctcgaagagcacggtgtggctcgcgtcttcacaccacgcgactggcgtctcgacgagatcgtgcgcgagctcgtcgtcctcgcgcgtggtgctcgctcgtgagcggcgtcgctgctcaagccgacgagccctgtgccgatgattgggcatatgcggcggttcgtcgacgtggtggcagcggtcctcggtctcgcgggggtgctgctcggggtcctcgggactcgtacgcaggtggccaacgatggactgctggggtcgctcgtcggcgccctcgggatcgtcgtgctcctcgttgctggagcgcgacgcctcgagcgcagacagctgggtcacgacaaggcctcgacgacggggggtgagaggactatgacacagtcggcagcgtcgagcgacctcgaggtcgtcgtcgatcgcgaaacgggactcatgaacgcagccttcttcgctggtctgctcccgacgaagctcgcgacggcacgacgacgtctctggccgctcagtatcgtcttgatgcgggtcatggaggctgaaggcgaggcgagcgccgagggtcctgcgaccatggccgggtttgccacttcggtgctcgagaccattcgcgctgccgacgtggcgtgtcgggtcgggggcgacaccgtcgcgctcgtcctcgacgacaccgacgaggacggtgcggcatgggtggccgagcgggtacagatccaggctgcgcgttcggggaatgccggcatcgccaaggtctgctgtggcgtcgctgcctatccctctcatggcatcgaggccgacgaactgctcgccgtggcgcacgaagcccttgcgcgttccgtcgccgaggcggaggggccggggctcgggccggtgatcgtggctccgacgcgtccgctctagcgacgagccgaggtggcacatgtcataagctggcgcctggtgagagtcgggtgagtggcgagcctacgacgtgagtgatgcgtccgagcgtgtcgtgctcatcggcttcatgggggcgggcaagaccacggtgggtcgcttgctcgctcgtcgcctcggtgcagacttcgtcgacgccgatgacgcgctcgttgccgagaccgggcggtcgatcccggatctgtttcgagtgcgtggcgaggtcgggtttcgccagctcgagggggatctcctgggtcgcctgctcaggtcggcgcgtggcgtcatcgcgctcgggggtggggcgatcgagcacgacgagctcgcggagctcgttgctccgtggctcgtgatctatctcgaggtcccctacgacgttgcccgtcagcgagttggatcggacgacgggcggccgatgctgaccaggtccgatctcgagtcggtctaccgacggcgcgtcgctcgataccggcgactcgctgacctcaccgtcgacgccaccgacgcaccgtccgtcatcgtcgacgagatcgtcagcgcgtttggtgcgctgggcgacggctgaggaagtcgtagagaacgacgaggaagagcgtcaaggtcatcacgtggacgctcgtgcaccagaggcagatcgatccgatcttgacgatctcggcgtagaccagccaaaggacgaacaccacaccgaccccggccagcgcgaggcgcacggcgtcgagcgcgcgatggcgccacgcgaacggcagcgagagcactcccatcgcgaggaagaatccaagacccagcaccgcgaccgggatgccgaggatggtcgactcaggcgaggtggtgaccttggcgcagttgacgatgccggtgtcggggcacgcgagcgtcacggtggtgtcgtagtgcgcgatggtgagatacgtcgccacgcccaggcccgcgagcgcgatgagggcgacgaggccgcgcacccatcgcggtggcgtggctagagctgcgactcgaggtgcgagatcactggatcggtgcatacggcccctggtgcgttgtgggtgagcgtgcagaacgcggcggtgaactcgttggcgagcgagtcgattgcctgggcgggcttggtcgacgggtcgcgcaggcttgctgcgatcgtttgccaactcagcccatcgaggatcgacggcgtatagctcgcgccgatgtcgaggaacttgccgcccatgtcgatgaagggaatcgatccgtcgtactgcgtcgacggcacgtacggaggggcatcgagcttggtgagcagtgcctgctcggctcgggtcggagcctggagggcttggtaggtccgcgtctcgatctcgaccgggacgaagctcaggtaggggctcgtgtagtgcgaaccatagaaggtgaaggtcggggtgttcgcgaagacatcggtcgacgacgagcgcatgaggtgcaggttgctgaacgtcccaaaccgagagagtgcgacgatgagcccccagcgttcggcggcgcagtagggacagtagtcagcgccgatgtagagcacttccggcttgccatcggcggtgagcgcgggctggccggccagccgatggaacgtgctcacgacggagctgtcgaagccgaccgcgtcgagcgccgagcgaggtaccgaggtgatcgccgtctcgacatcggctgggaccggggcattgatgctcgatgcgtcctggctggttccggaggagcgtagggcgaagaaggcggcgacgacgacgatcaccacgacgacgaccacgctcaccgcgatggcaggtcctcgacgagtcgggggccgttgtgcggttcgcgctcgagccgtcatggttcgctcctttgctaccgtcgtcgacgatcgccagcctacggcttcgatcgtctcgatggctcgcgtctgactcagggaacgctccgaggatgcagagcaacagctgaatcggcgccggctgcactgctagcgtggcgccatgagcgcactcgatcggctccgggaccttggcatcgaactcgttgcgccaccaccagcggtggggtcgtacgtgcccacgctggtcgtggacggttggtgctgggtgtcgggcatgctcccgctcgccgacggctcggtcgtccatccgggcatcgtcggcgccgacgttggtctcgaggaggctcgtgaagctgcgcgcgttgcgacctcagtcctgctgtcgcgtctcgcggcggatctcgggtcactggatcggatcgagcagtgggtctcgctcacgggctacgtccagagcgctccaggattccacgatcagccggcggtgatgaacgccgcctccgacctcgtggtcgaggtcttcggcccggcggggcgacacacgcgcgccgcggtgggggttgcggcgctgccgctcgcagcaccggtggagatcgcagcagtcctgcgcgtccgctagacgtccatgctgggcgttcggcggcgctgacctgtctggcgcggccactgcgccagcgcgagcccgatcgcgacgagcgcgacgccgacgagtggtcgaggaccgatcggtgtggtgtggagggcgagccccccgacgagggcgcccactgggatgagggccacgtagggcgcggcgcgtgcgacaccgagacggtggatgcctcgaaaccagaggacaaatgcgccgacggtcacggcgagcgcgatggcgacgtcggcggcggtctcggtcacggtgggggcaggcggcactccgccggtgatgagtccgatcgcgacgaggccgatgcccgctgcggcagcgctcacggtggtgagctcgccaggttcgaggacgcgcaagagcggcgctgatacgagggtgaaggtggcgtcgctcgcgagcgcgacgactgcccaggcaagtccggcgggcgcgaggctgcctgcgccgttgaccacgatggcccccatcgtcgcgatcacggtgcccgtgatgagcgctcgagggatgccgcggcgagaggcgagtgcagtgcccgcggcgatcacgaggggagcgaggccgaccacgacgccgacgcctgccgcggtgccgtggcgcaacgcctcgatggtcgccacggagaagagcccgagtcccacgaccgtatcgacgacgagcaggagcagcatccgcgcagggaggtgacgctggagcggcagagcccgccgtcgcagcacgatgacgagcaccacggcgccgatgaggtagcgtgccccctggctgatgagcggtgggtaggcgacgagcaaaccggaggtagcgatgccgagcccgacgagcaacggggcggctccggcggtgaggtgagcgccgtagctgggatcatcgcgtggcatcactcttaccttacggctggctcggcgtgcgggccctcgggtggatcccgtagactgagcgcggcactcggggagtggaggtgtgcgagatgctgagtgagcgggtagttcgagccaggactctcggggacgtcgtcgcgcccggggcgctcgcgcgtgtcgtggcggtcgtcggctacgcggccttcatcggagtgctcgcccaggtggcgatcccgctccccttcacgccagtgccgatcaccggtcagacgttcgccgtcctcctcggggccctggcgctcggtccggggctcgccttggcgggcacggcgctctatgccgcggtggggctcgcgggggtgccgtggttcgcgggagcgacggggggcctccacatggtctctgatccatcgttcggttacatcgtcggtttcatggttgcggcggccttcgtgggctggctcggaacgcgtggtgcggatcgtcgaccgctcaccacgatcgtggcgatggtggtcggcaacctcgccatctacgccgtcggtgtcgcctggctcgccgtcgcgctcggcgtctcgctcccacgggcgctcgaactcggcatggtgccgttcgtcgtcggggacctcgtcaaggtcctgctcgcggcgggcctgctgccgggagcgtggttcgcactgcgccgtctcggtgcacgtggtgtcgaggggtcgcgtccatgacgcactccgtcgcggagcggctcgaggagctgcggcggcgtcgtgaggaggcgtaccacgccggcagcgagcgtgccgtcgagcgccagcacagccagggcaagatgaccgcacgcgagcgagtcctctacctgcttgacgagggatcgttccaagagctcgacctgctcgcgcggcatcgggcgcacggccttggcctggaggagcgccggccctacacggacggcgtcatcaccggcttcgggacggtgaacggtcgcaaggtctgcgtcttctcgcaggacttcaccgtcttcggcgggtcgctcggggaggtgttcgccgagaagatccacaaggtcatggacctcgctgccgcgtgcggcgtgcccatgatcgggttgaacgacggcgcgggcgcacgtatccaagagggcgtggtcgccttgcactcttacgggggcatctttcgtcgcaacgtcgcgagttcgggcgtcatcccgcagatcagcgtcatcctcggcccctgtgctggcggtgcggtgtactcgccggccatgacggacttcatcttcatggtcgaggggacctcgcacatgttcatcaccggtcccgatgtggtcaagacggtgaccggcgaggaggtcaccctcgaagagctcggcggagccatgagtcacgcgacgaagtcgggcgtcgcgaccttcgtgctcccggatgagaagagctgtctcgacgaggtgcgctatctgctcgagttcttgccgtcgaacaacatcgagatgccgccggccgtgcaggcgaccgacgatcccgatcgcgaggtcctgtccctgcgcgaggtggtacccgacagtcccaaccagccctacgacatgcacgacgtcatcgcggccgtcgtcgacgatggcgagtatctggagtacttcgcccactgggcgcgcaacatcacctgcggcttcgcacggctcgacggcaaggtcgtcgggatcgtcgcgaaccagccctcggtgctggccggggtgctcgacatcgactcctcggagaaggctgcacgcttcgtgcgcacgtgcgatgcgttcaacatcccgctggtgacgttcgtcgacgtccccggcttccttccgggtgtcgaccaggagtacggcggaatcatccgacacggcgccaagctcttgtatgcgttctccgaagccacggtgcctcgcatccaggtgatcactcgcaaggcctacggcggcgcctacgtcgtgatgaactccaagtcgatcggcgcggacttcgccttcgcctggccgagtgccgagcttgcggtgatgggccctcagggcgcggtggaggtcatccaccggcgcgaactcgcggccgcagcggatccgacccgtcgacggtccgagctcatcgacgaatacaccgagcgctacgcgaacccctacgtcgcggccgagcgcggctacatcgacgacgtcatcgacccggcggacacgcgacgggtgctcatcggtgcgctcgcgatgctcgagaccaagcgagaggatctgccgcggcgcaagcacgggaatgtgccgctgtgagcgagctctcgtccgaggaggaactcgctgcggtcgtcgctgcgctctgggcgcaccgggcgaggtcgtcgcctgctgtggccgagccggcccaggacgacaccaggtggcgtttccagcgccgatggtggctccagggcgtcctgtcgctccgtcagcgacctcgtccgacgctgtgacagacgccttgccgccgagctaacctcgcctccgtgtcgaccatcgatctcgctgcgtatgtcgacggcgtgagccttgcggccgcgttgcgccgtcgcgaggtgggcgtcctcgaggtgctccaggcgacgctggagctgatcgacgagcgcaacccggcgctcggggcgatcgtgtggctggaccgagacgacgcccgccgccgggcggagcgggcggctcggcgcctcgacgccgacgaccccgcaccgttcctcggagtcccgctgccagtgaaggacctgcacccggttgcgggatggccgatcacctacggctcgtggggaggtccggagggggtgagcgcccggagttcgatcgccgtggaggcgctcgaagaggctgggttcgtcctggtcgggcgcagcgcgacaccggagctcggcgaactgcccgcgaccgaaggggatcgctacggggtcacgcggaacccgtgggacctgtcgcgcacccctggcggctcgagcggtggtgcggcagcagccgtggccggcggcatggtcaccgtggcccatggttcggacggtggcggatcgctccggatccccgccgctgcgtgcgggctcgtggggctcaagccgagccgaggtcgtgtgccggcgcgctcggccccctggttcggtctctcgacggaaggtgtcgtgacgcgcagcatccgtgaccaggcggcctgtctcgcggtgctcgccgctccgcgtcgcggtgcctggctcccgcagccgcccgctgggttcggcgacggtggctggcacgtggcgccgacgcgcctgcgtgtgggggtcgtcaccgaaccaccgttcggcctcccgatcgacgatgcccggcggctcgcggtcggcgaggttgcgcgtctcgtcgccgatctcggccatgaggttcgggaggtgaccctcgcgttgcccgacgagctgatcgaggccgtctcggtggtcgttggggcaggcgtcgccgagcacgacgatctcgattggagtcgggtcgagccccatacggcggccgagtacgagcgggcgaaggcgttgccggcgaccgagctggttcgccagctcatggtgctcgagcgcacgggctcagacctcgcggcagccctgccaggcgacgtcgacgtgctcctcacaccgacgacagcgatcgcccctcccccggtcggtacggtgctcgaagcggcgcatgcggccgcccacaccggcctccctgcgctcgaggtggtgtcgctcgcgatcttcaccctgccgtggaacatcgctggcctgccggcgatctcgctcccgacgcacctcgacgtcgatggcttgcccatcggcgtccagctcgtcggaccgcccgctggcgaggcgacgctgctcgcgctcggggcggcactcgaggaggtctacgagtggaccacccgacgacctcccgttcagcgctagcatccgagcccatgacccttgcggaccctgtgtgggtgcgccgatggctcgaggatcacggtgtcgcgttcctcgagcgcttcgtcgccctgaacagtctctcacctgcgttcgatccggagtgggagcgccacggcacgctcgccgccgcgatcgacctcgctgcggagacggtcgaggccgctggtttcgaaggaaccgagatcgtgcgccagacgatccccggccgatcgcccgccctggcggtgcgcatccccgggcgcgggcacggtaccgccctcgtctacggccatctggacgtgcagccggccgtcggcccgtggcgtgacgggagcgatccccatcgtgtggtgcgtcacggcgagaggctggttggccgcggcgtggtcgatgacggctacagcgtcgtggcggttctcgccgcactcgagggactgcgggcgatgggcgcggatgccccgacggtgtgggcactcttcgagacctcggaagagagcgggagcccggacctcgatgcgcacctcgacgccctcgccccgaccatcggcccggtggacctcgtcgtctgcttggacgcaggcggtctcgacacaaagcggctgtggctgacctcgtcgcttcggggcaacctcgtggtcgtcgtcgacatcgccgtgctcgaccatggcatccactccggtgaggctggaggggtcgtaccggagaccttccggatcctacgggccctgctcgagcggctcgaggatcccgtcaccggcgacattcgtgtcgatgccctgcgatctgcggtccccgagcccgtgcgtgaggcggcccgcgccctcgtcgaggcgctgggagatccgttcgccggtgcctaccccctcctcgagggcgtacgcctcgagggggcggacccggtcgaacgactgctccgccagagctggggcacggcgatcgcgctcaccggcatcgacggggtgccgagcgtggacacgggcggcaacgtgctgcgcccgtcactcaccgccaagctgtcggtgcgcatcccacccgacgtcgatgcggtccgcgccctcgatgcgttggtggcgaccctgagcgccgatcctcccaacggcgcgcgtgtgcgcgtcacgccggaggcccccgcgcagggctgggcgggggcggccctcccggactggctcgccgatgcgctggctcgcgggtcgatcgcgagcttcggtgagcccccgcgatcggtgggggtcggtgggtcgatcccgttcctcgcgtcgctgggcgagcgcttccctggcgtaccgatcgtcgcgaccggagcgctcgccccgacgtcgaacgcgcacgggcccgacgaagtgctcgagctgccggccgcgaccggcgtggcggtcagcctggccgaggcgctcggcgcactcgctcagcgatcgttctgaggctgtgccagccgagcgtaagcccacaggcgggcggagcagtggtcggagcgtgcggcgagctctctggtgatggtctcggccaccacacgcacatcgtcgtcgacgagaccgatcgggagcgtggcgagcagcggtacgccgaggcgctgcgcgagcaaggttccgcccccttctccgaagggtcggatgaggtctccgtgttcgcatcggagccaggacaggttctcgatgacgccgaggacgtcgaggttcgccttgcgggcaaaggtcccagcacgtacggcgacctcgacggcgagcggggagggcgtggtgaccacgaccacccgggcatctggcagcaggcgtgccagcgcgagcgggacgtcgcccgtgcccggcggcagatccacgacgagggtgctgggctggccccaggcgacgtcggccacgaagtgctcgagcgcgcgagcgagcatggggcctcgccacatgatggcgtcgtcggcgtcgtcgacgaggagccccatggacacgagtcggagttcgccgtcgtcgacctcgatgcgggccggctcgatctcccagcgatcgctggtccctcgcgcgacgaggcgttcgcgtcgttcggtgaggtggggctgcgagaagccccagatgtcggcgtccagcagtccgaccgcgttgccaccgtgtgtcagcgcacgtgccagggcgtgcgccaccgtcgacttgccgacaccgcccttgcccgaggcgacggcgatgacgtcggtgccgagcagcgcggccggaacctcggcccggcgctgagctgcggcccgcgcggcgcgcatggcgcgcgcacgtccggcatggtcgagttcggtttcgtcgacgatgagcgatcgtccgggggcgagctcgtcgacgatggccccgatctcccctcggaagcgagcgcgcgctggacagccgagcgtggtgagggcgatccccacgcgaaccgtcgttgccgtgaccgtgacatcgccgagcatgccgagttcggagagggtcgcgtcgagctcagggtcgcgaatcgcgccgatgcgagctcggagttcgtcgatgtcgacgccggccgtcatggctcacccgccgactcgaccggcagtgtctcgccaggggcgagtcgcgtgggctcgacgagcccatagcgtgggtcgccgggcaagaggatgcgaacgacgtcgccgtcgcgccagaggcgcggctcgatccgcggcacccgctcgagcgctcgggcccgtgcgagtgcctcggcgaccgagcccacgtcggcgaggaacgtgacgttcgccaccgtcggcgggaccatggggagcgcacctgcctcgtggtctcggagggcttggctcggcgcgagccagcgagcctcggtgacctccccggcgtcggcggacgcgtcctggtcgctcggcgctgctgccacgaagaagcgcgtgtcgaagcgccgtggactcccagccggggtcacccagtgggcgacgtagccgagcacggccacgtcgattccctcgaccgctcgcacgacctcgcggaagccgatggtgccggcgagcagacgctggcgcagttcgcccagacgatcggccccgagcgacacctgggcacccaacagcacgcccgcttcttcgaacgcttcgcggaccgcggcgacaccgagggccgcagcacggggctcgtcgggcatgtgcgctgcgaggtcggcacccgagcgcacgagaccgtcggcgacgagcgcttcgtcctcggcgtcgagcgacccgcccgggaacacgtaggtgctcgcgacgaacgcggcgtccttcgatcgacggagcatgagcacctcgagcccggtcgtcgggttgtcgcgcagcaccatcaccgtcgaggcgggacgaagttcgtcagtcactggtcgggaaggcgggatttgaacccgcgacctcagcgtcccgaacgctgcgcgctgccaaactgcgctacttcccggtgtggcttagtctacgccagctcctccggggctgctgcgccagcgacgccgagcgcgacggagctcgccggcaccggcgccaggacgggctggtaggagtggtcgatgaacacaccgccctcgaggacctcgcggacggccgtccggatgaggaccgggcttgcgggcctcacgacgaagccgtcgacacgagcgcgtttggccgtgaagacgtccgcccgacgatcgagcagcagcaggacgcgcgtcggccggagtcggccggcgtcggcttcgagccgaaggtccaccgtgcaggcgataccgcccatcgtgccgatgtgggcgtcgagcacgacgagttcggggtcgagttcggcgaccgcacgccgaacgcgacgtccttcgtccacgccccagagttcgtagtcgccgtcggcgagtgttgcaacgagctcgtcgcggacttccggagcgtcggttgcgatcaggatccgtgccatgcgccgatgatcctagtgttcggggctcgcagattccagctcgcgctcgccaagccgtgcgccgaggcgtccgagggcctcgaccgacgcgatcggctcggcgagatcgtcgaccgcgagtaggtcgaccgggccgagggtctcgcgcacgcgcccgagaccgcctcggcgtgcgtcgaggagtcccatggcagcgcgacgcaggtccggaggcgcgtcggggtcgctcgggagcgagccgagatcgggcggcagacggttgacgaccacggcgcgaacgtcgcgttcgagctcaccgagcgccgtgcgcagccgacccgccaccgccatggcgtcctcgtggatcgtggtcacgagcaggtagcccgttctcgcggaggcgagcagctcctcggtctgggtggcgcgctcgcgaaaggccccttcgagtcctccgaacgcctggaagaacgcgatagtgtcgtcgaccacttgggcgcccaccacagaggcgatctgacgaacgaggctgcgggtggcgagtgccagcggtcgcaacaggagcggcggttggcgaaggaggagacgaaagacccgattgtcgaggaatcgggcgagtcgactcggtgcgtgcaggaagtcgatggcccactgcgcgggcggtgtgtcgaccacgatgacgtcgtagcggcccgtggctcgcagctcccacaggcgctcgaaggccatgtactcctgggtccccgacagtcgtgagacgaggctcgcgtagaccggactcgagaggacctcggcgacctgctcgggcgagttcgcccctcgccggaccatcgcctcgaaggtagcctgggcgtccagcatgaccacgtcgaagcgtgcgctccccacctcgacggtgaccgggtcgttgccgacccccacgaggccgagcgcgtccgcaaggcgtctggccggatcgacggtgagtacgcacgttcgccgcgaactcgcaaggagtgcgccgatggcagccgccgtcgtcgtcttgccgacgccgcccgccccgaccaccacgatcgtctcgaacggctggagtgcaccggtgagcgtcgtcacggctcgacctgctcgaggtggtcggccagcgcgtcgaggaagtggccgtggggaacgagatcgaggtgcggcaggacgaagctgcgcgctccgaggacgtcgcgggccccttcgagctgcgtctgggcgagcgcccaccgctggcggaggtagctggcggcggttgcctctcgagagcctggtcgagctgatcccgcaggcggcgcaaggggcatctgattgaccacgaccgagaggacgttgatgtcggcgcgcgtcgggagcgcctcgaggagctcgcgcgtctcggcgatcggcgtctcctctgggatggtcacgacgagggctccggtggtgtcgtggtctcctaggagttcgatgacctcggcgctctgctgggcgatcggtccatcggacgcgatatcggcgagcccctcgggagaactcagcaaggagagggcatggccggacgctggcgcgtcgaggatcacgagatccagggtcgccgcgttgacgagctgcttgaccttggcgagcaggaggaggtcgcgaatacccgggatcgcggtcgcgacggcgtcgagcaccccggcctgcaccagccgcccggcgagggcgccgaagccgtgcgtctcgaggtattcgagcatcactgcctcggggcgcagggtgaccgcgcgaacctcggggtgctggcgcggtgcgtcgtcgacgtggacgacgagcggtcgaaggcctgcacgctcggccaagaggccgacgaggagggacacggtcgtcttgcccgtcccgcctttgccggtgacgatgacgagtcgagggtcgccgacgagcgcgccgagacggatgcgcgcggtgtcgacgtccatgcctccaccctagagccggcgcagggctcgagcatgtgcacacagttgtgacgcggacgtcacacgacccttgacagcccgagcgaaggctgcataggctgcccgacaagaggtacggacaaagcgacgaggtggatggagtggacggggcgtgtcgtcgtgaccgactcggaggggcggtgcgaagatgatgcggctgatgtcgagcaggagcggcgtgctggaggggggcgagtgagccgacgtgctcggtgtgtggagatcgaccgggctccgatgtacgcctcggcgatcgagtcgactcgggcgctcgctgggcaccatgccatggcgatgcggggagcgacccctcgggcgtggggcgtagaacgctcccgtgcacaggcgagcatgtggtgtgggcgtcgccggtgcgcgtgggggtgctcgcacgttcgccgcatcagatggtcggcgggtgggcgcgtgtgaggtcgataccgacagtcggtatggctacgttggcgtagggtggtctgacgtcgtggcgtcggaccgatcgatgagctggaggggggcgtgctatgcgatcggagtcctggagggagcgagcccagtgtcggggagtcgggttcgacgtcttcttcccgccggaagatcctcgcatggaagggctcgcacagcgacgacagcgcgaggcgtcagccaagcggatttgtgcgcggtgcccggtcgcgggagagtgcctcgaatgggcgctggaaaatcgagagacgcgcggcatctggggcggacgtacggaacttgaacgcaaggccatcttgcgcgcccagcgtcgcgtgcgactcgtcgtgtgatcccgggcctgatcgagggcatgcggtatactttggacaggcacgctggttgggcaatcggctgcaccaaggtgaggagggctcatggcagtcacgagtgtgaagatcggtaagcgcccttcggtgatctcgctgacggattcggcggttcgcaaggtcgccgagttgatcgcgcaggaggacgacgccgcgtcattgttccttcgtgtggcggtggcgcccgggggctgctctggttatagctacgacatgttcttcgattccgagcgtgcgagcgatgacatcgaagcagagttcggtggagtgcgggtcgtggtcgatccgcagtcggcagagttgattcgtggctctgtcctcgacttcgtcgatggtctgcagggagctgggttccacatctcgaatccgaacgcaacgcgcacgtgcggctgcggttcgtcgttctcctaacccgcctcgttcggtctcgtcacgagccgggcagccctctggggctgcccggctcgttgctgtgagttcccctccgggtcgcatcggaggggtggagggggccgtggctcggcagcagtgtccagttggcgtggcttcgatgtctgggctggcagcgccaggaggcagcggggccgacgcgcggagggggcgcaatgggtgggattggtcgacccagtcgtggtcgggacccggtcaggcgtcgccgaagcggtagccgaccgagcgtacggtgtgaatgaggtgctcgtgcgcttcgccgagtttggcgcgtagccgtcgcacgtggacgtcgacggttcgtgcgcccccgtagtattcgtagccccacacccgcgagagcagggtctcacgggagaagaccttgcccgggtgcgatgcgaggaacttgaggagctcgtactccatgtaggtgagatccagcgcggtcccgttgatcgaggcatggtaggtgtcgagctcaagcgtgagcgggccatagcgaatgacggtcctcacgtcgccgcgtccgaagcgcacgaggaggtgccgaatgcgcatggtgagctccctggcgtcgaacggcgacaccgcgaagtcgtcgagcaggccctcgcggagcgcgaggtcgtcgacctggtggcgctcgacgaggaggagaatgggtggcgggggggcgaggcggcgcttgagttcccgggcggttccgagcgcccattcgagcccggtggttccgtcgacgaccgctgcgacgagtggtccgacggtcggcggcagtgcgtcgagggtcgtcacctcatggctggtccatccgatgagctgtgcgatgcgcgtcgcgtgctgcggcgagatgatcgcgagctgctccatgtcagatcagcgtgaggtagcgggctcgttcggcgtcggagacttgactcgccgaagcgcgccactcgtctcgcttgttgcggaggaaccactcggtgacgtggtcgccgagaaccgagcgaaccaggggcgacgcttcgagctcttccagcgcttctgagagtgtctggggaagacgggcgatcccgagtgaggcgagctcgcgctcgggcatggtgaagaggttgtcgtggacctccggaggcagctcgtagccctgttcgatgccttggaggccggctgcaaccatgagcgcgagtgcgagatagggattggcgccggcatcgggtgcgcggtactcgacgaacgtgtcctccccacgagctgcttcgggacttggaaccctcacgagcgcggagcggttgttgcgtgcccacgcgacgtgcatcggcgcctcgaagccagggacgaggcgcttgtaggagttcacccactggttggtcaccgcggtgatctcccgagcgtgccgcaggagtcccgcgacgaacgatcgtgcccggcgcgagagaccatcgggagcctcggggtcgaagaaggcgttgtgttcttcgtcgtgacggtcgtagagggctaggtgggtgtgcatgccggacccttggagcccctcgaacggtttgggcatgaacgaggcggtgatgcccttggcccgtgcggtctcggtgacgacgagtctcgcgctgatgacggcgtcggccatctgcaggacctcgtcgggcgcgaggtcgatctcgtgctgagacggcgcatcctcgtgctgagagtgcttgacggggatgccgagctcttcgagtaccacgaccgcctcgcggcgcagctcgctcccgaggtcgttcaatcgcagctcgaagtacgagccgtggtcgaggggctcccagtgtcccggggtggtctcgcggaggtagaagtactcgagttcgggggctgcgtggacgaggtagccctgctgtcgggcgcggtcgatctggcgacgcaggacgttgcgggggcaaccttcgaagggcgttcgatcgaggttcaagatgtcgcagaacatcctcgcggtgctcggtaggcccggcaccacgctgaacgtggccgggtcgggcatggcgagcacgtcggcctcgtggatgcgtgagaagccgtcgatggccgatccgtcgaaggtcatgccctcgtcgagggcggtggcaagttctgcctgcgtgatttggaaggctcgtgggatgccgagcacatcggtgaaccagagctggatgaacttcacccggcgatcctcggccatgtgacggacgtagtcgacgccgacactgcgctggtccggcacgggccacctccttcgcggtcatgctacgggggacgtccctggatcgctcgtcgcgccccgagcatttaactcggagttcacatggctctccggtctgcgtgctcgctggccataggttgggcgagcaacggcgacggatggaggagcccatgcaaccacgcgcaccacacgaggtgatcgcgatggccgaggagcagggggtcgagatggtcgaccttcgcttctgcgaccttccaggaacgatgcagcacttttcagtgccgatccgacagctcaccgaggattccttcgaggaggggttcgggttcgacgggtcctcgattcgtggcttcaagacgatcaacgaatcggacatgatcttgaagccagatccccgctcggcgtacctcgatccgttccgcaagcaccgcacgctggtgctgaactgcttcatctacgatccggtgaccggccagccctacgatcgtgacccgcgtcgcgtcgcagcggctgcggaggagcacctgcgcgcgagcgggatcgcggacacggcctacttcggtcccgaggccgagttcttcatcttcgacgacgtccgctaccaccaggacgagcactcggcatcgtacgtggtcgactccatcgagggtgcgtggaacaccgaccgtaacgagcagggctcgaacctcggcggcaagattcccttcaagcgcggctacttccccgtacccccaatggacaagttccaagacctccggtcggagatggtgctcaccatgcaggcgctcggcatcgagatcgaggtgcagcaccacgaggtcgccacggcagggcaggccgagatcgacatgcgctatgacaccctgctcgccatggccgacaagctcatgctctacaagtacgtcgtgaagtccgtcgcccagcagggtggctacaccgcgactttcatgccgaagccgctgttccaggacaacggctcgggcatgcacacgcaccagtcgttgtggcgcgacggtgagccgctcttctacgagtcgggggggtatgccgacctgagcgagctggcgctccactacatcggtggcatcctcgcgcacgcgccgtcgatcctcgccttcgcggcgccgacgacgaactcctacaagcgcttggtacccggttacgaggctccggtcaacctggtgttctcgcagcggaaccgttccgcggcctgtcgcatcccgatgtactcgctctcgccgaaggcgaagcgtgtcgagttccgctgcccagacgcgatggcgaacccctacctcgcgttctcggccatgctgctcgcggggctcgatggcatccgcaacaagatcgagccggccggacccgacgatcgcgacctgttcgacttgccgccggacgaagcccgggctctgccgacggtcccgtcgtcgctggagggctcgctggctgctctcgaggccgatcacgactacctgctcgaggggggtgtcttctcgcaggacctgatcgacacctggatcgcctacaagcgtgccgaggaggtcgacgccattcggcttcgcccgcacccctacgagttcgcgctgtactacgacgcctagcgcgtcgttgatccttcgcgaggccctgctcgtcctcgggcgagcggggcctcgttgctgtcatgggttttggtgcgatgggatcgagcgcgacacgatcgagcaacgtccacagggcgctcgacgatggccagctcaggcgaggcctgcgctcccgaggagcgcgcgcgggtcgaactcgtcgatcgggatgatccgaaccctcggcaggacgacgtcgtcgaggaacgcgtgcatgtcgcgctcgagatcgaggagctcgaggtcgtgtcggttgagcagctggcccgcgacgtactcggtgaagcaggccagcgcgacgcggtgaccgtggtcgaggagctgctcgagtgccggagcgaagtcggcgtcgtgcgaggcgagcacgacggacccgtgacgccgtccgatctcgccgagcgtcgccacgatcgcatcgtcgacgaccttgccgggacccgagaggaggaccggcgtgtagccgtgggagcggatcgcctggatgaacggcccggggatgaggcctgaggtggcgttgatgaagaagtagctcttcagcggcgccgatccccacgacgctgcggcgccagcgactcgatcccagcgaggtcgctcgttgggttctggccggtggcccaggatctggccgaggacgccgtcgatgttctcaccgtcgacgagcaagaacgtgaccggcgctaccaccccggccaccccgccgggagtgagccgaccaccggcccgtagacgatcccgcccggggcccccagtgccgacaggagctgtgagaagttgagtccgaaggccgtggagttcgagttgttccactggccggcgtagcccgcgtaggcctcgccgatcccgcccggcgccgcccagccggtctcgatgccgtcggatcccgggaaacaggttgcgatctgctgtccagcgctcaccgcttggcctacggcgaccgttgggaccacgtcctcggcgacgtagacgtagtcgccagcggctggaccgctcgtcagttgataatccaggaatacgccgttgggccagccgccttcgtaggtgctcacgatcctgccggccccgagcgcggtgatcgggccgttgcagaggtaatccacaccctggtcgatccgttcgacctggaggatctgggtgtcggcgagcggattgacgtagccgctcgggctggtcggcgttggggctggggccgacccgccgctcgggctcacgaccacggccggggtgggtgctgagtcctgggcggcacgggcttgctgggcctgggcggctgcgagtgctgccgcctcgcgctgggctgccgcggctgccgcctgggcctgggccgcttgttcggccgcgagttgctgggcgacgagctgctgaatctgggagttgacgctcgcgagctgggcctgggcctgcgcctgggcgttctgggctgcttgggcggcggactgagcctgtgcgctctgggtcgcaagatcgctcatggcgcttcgcagcgaggcttgctggagctcgagggcctgcttggcggtgacgtaggctgcaacggcggcttcctggttcgcggtcgcggcggtgacgtcggtctggatgatggccgcgtcgttcggggtgcccttggcgatcgagatcaccgacgaggacgcccctgcttgcgtgaagatgttcaccgcctccgaggcgaccttggccttgagccgggcgacgtcggcctctcggcgaacgatctgcccttggagggtggcgatctggctcttcgtcgtggcgagtttgagctgcagctgatcgtaggtgttcatggctgcctgggcctgttgatcgagcttggagatctgggcagtgagctgggcggcctcagccttggcctgggagagttgggtggttgcgtcagcgggtgtcacgttcggtgtcgccacggcgaacgtggcgatcgctgtggcaacggtcgtcgtcacaagcgtcttccaacgcacgagcgaacctccgtgcgagattcggggacctccgacgtcctcgacgaggtcatcggcatggtcgacaatcggttgagcccgtcgtgggcgccggcaccgcgagcctagcgggcgaggactcggggctcgggtgctctgtggcaatgttgccaaagttgccgtgctgcctgggaggagctcgagccgtgtcccatcggacgcggcgagcaaacggtgacgggcggtcgggacgacgggattggcggcgcgggttccgatccctgggtccgcgtggcgccgagcgcggcactatcgtggtcgcgtgcgctccctcgtgatccaggctgcgcagctcaacctgaccgtgggggccgttcggcgcaatcgcgacgcggttcgtgctgccatcgagtcggcacgtgcagccggcgtcgacgtcgtggcgttcccggagctgacgttgaccgggtacccacccgaggatctgctcctcaagcccgcgttcatcgaggagcagcgagccgcgctcgacgagctcgccgggtcctgtcgtgacatcgtcgccgtcgtcggtttcgtcgatcgcgagagcgacctccacaacagcgcggcagtcctcgccgacggtgcggtccaagcggtctatcacaagcagctcctcccgaactacaccgtgttcgacgaggctcgctacttccagcctggctcggtggcgccgccggtggtcgaggtcaacggggtgcgtctcgggctggcgatctgtgaggatgcgtggtccccgacgggtgcgatcatgcaggcagccgtcgctggtgccgaagtcgtggtcgtgatcaacgcctcgccgtacgaggctggtcgccaagccactcgcgagcggctcgtcgcggtgcgagccgccgacgcccacgtcgcggtgtcctacgtcaacctcgtcggcggacaggacgaactcgtcttcgacggcggatcgttcgtggtggacgcggtcggtgcggtcatcgcacgcgcaccgcagtttcgcgaggcgaacctcgtcgtcgagctcgagctccgaggcgaccgctaccgacagcgtctcgtcgacccgcggggcaaggtcgcgctcggcacgtcgagcgagcctgccgtccgactcgccacacccggagtgcgcgtggcgcgcgatccgatgccgctcgccccggctccggtcgacggtttcgaccccggcgaggtctacgcagcgttggtcctcgcaaccagcgattacgtgcgcaagacgggcgtaccgggtgcactcgtcgctgtgtccggcgggatcgattcggcgctggtggcgacgatcgcggtcgacgccctcgggccggatgcgctgaccctcgtggccttgccatcgcggtactcctccgagggctcgctgcgcgatgctcgtctgctcgccgaccgtctcggcgtcaccttggaggtcatcgccatcgagccggcgcacgcagcgctcctcgagatgctctcacctgccacggcgacgtccggggtcgtggaggagaacctccagagccgcgtacgcgggacggtgatgatggcactgtcgaacgccagcgggcggctcgtcctcacgaccggcaacaaatccgagctcgcggtcggctattcgacgctctatggcgacatggccgggggtttcgcggtcctgcgcgatctctacaaggaacaggtctacgccctcgcgcggtgggtgaacgaccgggcgggcatcgaccggatcccgacggctattctcgccaagccgccgtcggcggagctgcggcccggtcagctcgacacggactcgctgccaccgtacgagatcctggatcgggtgctgcgctccctgatcgacgaggatcgcaccgcggccgagtgcgagggcgtcgatcctgagctcgcgcgcaccatcgaggcgatggtcgatcgcgcggagtacaagcgacgccagggacccatcggcccgcgcatctcagagcgcgccttcggcaaggaccgacggatgccgatcgtcaaccggtggcggttgtgaccgacgagctgcgtcccaggtggctgggtggtggtgattggtggttaccgctcgcggaggtttccgaactcatccggcgtctctcggcggtgctcatcgatctcgcacgggtgtgcgcagacgcgcgcctgccggacgtattggtgagggccagcttcgagtgctcacgcgttctcggaggacatgcgggcgagcttgcccacttggacctgcatccacagcccgatctgctccagccagtggccctcgacggcaacgacgcgttcgcggcgctgcgtgatcgcctcgtcgagatcgcacccaccgaggaggccctcgacgtggatcggtggcgtgagacgctgcgtgtggggttcgacgaactcgaactggtcgcacgagggctcgggtcgtcgagcgggaccggccagacgaacctcgccgcctgggcacgcgagctgggctcgagccttgcgacatggcgcgagcaactcggtatcgacgggagcgtcggtacgaacggccgcgatcgatagcatgaatgcgtgctgtcctgcgtggctcggctccgcatcggttcgtgcatccagcgagccaggagtcctcggggggtggggaactcgtgacgaaggaacgtcaggaacgtgaggacgaggacctcgtccggctctacctcggagacattggcagccacgagctgctcaccaaggatgacgaggccgaactcggtcggcgtatggatcgtgcgcgtgacgcccagcgtcagctcgatgccggtgtgaaggaacctgcgcgcagggccgagctcgaggagctggtgcggcagggagaagaagccaagcgcgccttcatccaggcaaacctccgcctcgtcgtctcgatcgccaagcgctaccaggcttccggactacccctgttggacctgatccaagagggcaacatgggtctgatccatgcggtcgagaagttcgactggcgtaagggcttcaagttctcgacctatgccacctggtggattcgtcaggcgatcactcgaggtatcgccaacacgggccgaaccattcgccttccggtccacgctggtgactcgctctcgagggtccagcgagcccaggtccagctggaggtacgactcgggcgtgccccgacggttcgtgagctcgctgccgaggtggatctgccctacgacaagctggtcgaggcgcttcgcttccgtgccgagccggtctcgctgtcggagccactgcgcgacgacggtgatgctgagcttggcgacgtggtcgaggacagccagtcggcgacgcccttcgacgtcgcggccgagcacctgctcccgtcggaggtgtctcgtctgctcgctccgctcgacgggcgtgagcgcgagatcctgaggcttcgctatggtctcgatcgcggggagcctcgaacgctggaggaggtcggagagtatttccacctcaccagggagcgcatccgccagatcgaggcgcgcgcgatgtcgaagttgcggcacccatctgctgacatcggcgcgcgcgacctgttgaccggatagccgctgccgttccgagatcgcggcccgtcgcggctaggctggatgcatgaagaagctgttgatcctcgcggttctcggagccctcgctgcgttcgcggtgaagaaggttcgcgaaacgctcgcatagctcgtgggggcgtgggcagtcgtgtccacgccctttgcggccatggtgtgcaaaccggcgggtcggaggaccgacctgctgaggccggtgttgtcgggtggcccgatcggatgggaatcctcaagggcgcggtcgagtgtcgtggcgccacgagccagcgcgacggtcgcggcgcatggcgtcgtggcaaaggtcgcccgttgagcccgagacgcacgaggccgaggctcgggtggcctgatgttcggacggcttggctccgatgggtcgtaaggccgagggcaacagttggggctgtcggtcgtcatggcgcatctcccgggtgaggtcggtgcccaacgaggtcgtccgggtcttcgagtgaggagctggcgatggcctcgcctgagggttgtcagatgcccgggccggcccgactggtcctgaccgacgcctcgccggtaggctggtagtgcgccgctgtgtgatgctgtggcgtcggatgggtgccaaagagaggtccggtgtcgctcgttgctctgagcatcgcggaacgtgaggtcggtggccggtttgaggcgtgtgcgctcgaccgcgaccggaccgagcgcctcgaggacggtctcgcccgtctggtcgccaagggagcgattgtcgaggccgctgtgctcgcaacgtgtgcgcgcaccgagttgtaccttgccgtgacgcagttccatgccgccgtcgagcaggcagctggcgtgctcgccgaggtcctggacgtgccgcggagtctcgtcgagcagctcgcgaccgtccacttcggcaccggcgcgctccgtcatctctaccgcgtgagcgcgggtatggagtcggtcatcatcggcgagtccgagatcgtggctcaggtgaaggacgcgatcgcacgggctcagcgtcgacgtctcgcaggtggcgagttgacgcgcgtcttcgaccgagcgctcgaggtcgccaaggacgtgcgcgcgagtaccgaactgacgcacggctcggcttcggtcgtcacgatggcgaccgagctggctctcgacggagcatccgcgcgcgacgtggcggtcggggttgtcggcaccggtgcgatcggatccgaggtggctcgcgtgctcagcgaacgcggggcttcggtgacggtgctcacccgtcgggcagacgtcctgagtcagcaacccgtcggcgtcgaggtccgagccttcgagcagctccggagcatcatcgaatcgttggacgccgtggtgctggcgaccaccacggattcggcagtgctcgatgcgtcgatgatgccgagcggacaccccttgcggatcgtcgatctgtgtcggcctcgtgctgccgatccggcgcttgccgccgtggacggcgtcaagctggtcgatctcgaggaggtcaacgaactcgtcgcggcgcaactgtcgaagcggcgtgaggcgctcaccgatgcggaactcatcatcgagcgggcgctcgccaacgacggagtgctgctccacgctggtgaactcaaccccaccctcgctcgtctgcacgcgtggggtgaggcgttgcgccagtcggagctcgagcgcgcgctcgctcgcgtcggcgacgacgagaaggcgagagccgcactcgaggaactgagccatcgtctggttcgcaaggtgctccacgagccgagcaaggccctgcgtgctcacgcctcgtcggaggatctcggcgcattgctcgcgagcgtgcgcacgctcttcgatctgtgatggctccggtacgcatcgccactcgtcgtagcgccttggcgcgctggcaggcgagcttggtcggcgagcggctcggtcgctacgagctcgtcgaggtccacaccgcaggtgatcgcgaccaggcgagctcgcttgccgagatcggtggccagggcgtcttcgtcaaggaagtgcaggccgcggtcgtgcgtggcgaggccgacatcgcggtccacagtgccaaggatctgcccacagccgcaggcccgctcctgctcgcggcggtgctcgagcgcgcggacgcccgcgacgcgatcgtgggcgcgcggctggaggagctcgcgatcggcgctcgggtcggcacatcggccccgcgtcgagctgcgcagctgcgcctcctccgccctgacctcgaggtggtatcgatccgcggcaacatcgcgacccgtctcggtcgcgttggggagctcgatgcgatcgtgatggctgtcgccgcgctggagcgcctcggcctcgaggagccgccttggtggccgctccccgaggaggtcctctgtccacaggccggtcagggggccattgcggtggagtgtgcccccgacgccgatgggctgatcgagcgccttcggtccctcgacgacgatcggagccgccgcgagatcgaggcggagcgggccgtcctcgccgcgttcggtaccggctgcgcgctcccgctcggtgcgcgggcccatgccgatgggtcgagtctgcggctccgggcggtcgcggttgatcccgatggcacgcgccagctggaggtcgagcgcgagggagtcgatcccgcgacgctcggtgcaacggtcgccgaggtgctgcggcgcctgggcgccgacgcactcgtcggagctcgtccctgatgggacgcgttgcgctcgtcggtgccggccctggcgacccagagctcctcacgctccgcggtctgaggctcgtgcgtgcggccgacgtcgtcgtcaccgacgctctcgttgatcgacgtgtgcttgccgaggtgcggccggcggtcgcggtgcacgacgtcggcaagcgtgctggagcacccttctcgcaggctgccatcaacgaactcctgatcgacctcgcccgcggccatgagctcgtcgtgcggctgaagggcggcgacccgttcttgttcggtcgcggcggagaggagctcgaggcgctgctggcagcgggggtcgccgtcgaggtggtccctggcgtgccgagtgcgacggccgcggcggacctcgtcggtgtcccgctcacccatcggggcgtggcggacggcttctgtgtgatcaccggtcatcgccacggcgacgcgtcgctcgactacgactggcgtgcactcgtcgcgagtgggctcacgctcgtcgtgctcatgggggccgcttctcgtgcgaccatcgccaaggagctgatgggcgccggagctcctggtgagaccccggtcgcggtcgtgacacgcgcatcgtggatcgatgaagaggtccgctggacgagcctcgcggcgctcgggtcggtgcctgtcgcgtctccgagcacgatcatcatcggcggcgtggtcgatccgcggcgccgatggcgaccctcgctgccgctcggtggcctccgtatcgtggtgacacgcccgagagcggtcgcagatgcgctcgcggtgcgcctccgcgatctcggtgccgtcgtcgtggcgagcccggcgatcgagatcggtccgccgtcggatggcggtgccgcactggccgcggcgctctcgcacatcgaggactacgactggctcgtcctcacctcgcagaacgccgtcgatcgcgtcgtaggaggcatcggcgaccttcggcgtctcggtggcgtgcgcatcgcggccattggccccgcgaccgctcgggcgctcgagcgggtccacctcacggccgatctcatccccgggacgtgggttggggaggggctggtcgaggtgttcggccctggtcctggctcggtgctcatcgccagggcacgccaggcccgcgacgtcgtgccacggggcctcgaggcgaaggggtggcgcgtcgacgtcgtcgaggcgtacgagacgcgcacagcagcggcgagcgtgcctccagagctcgtcgagagcgccgatctcgtcgtgttcacggcaccgtccaccgtcgagggtttcgcgacccagtacccggggctcgtccctcgggccgcggcggcgatcgggcccgtcaccgaggaggcgctggtgcggcgagggtggccggtcgcgctgaccgcgacgcactacgacgccgatggcctcgtggaggtgattcgcgaggcgcgcgaagcgggtcggctcgtgcctcgatccgaggcgccctaggctcgtcgtcatggcttcgttcccaaggcccaggcgcctgcgtgccacgccggcgcttcgtgacctcgttgctgagaccgtcgtcagaccccaacagctcgtgctcccgctgttcgtgaaggaagggatctcgacccccgtgcccatcgcgtcgatgcctggggtcgtccagcacacggtggactcgctcgttcgagaggtcgacgaggcgctcgccgtcggcgtacgaacggtgatcctcttcggcgtcaccgacgagcgggacgaggacggctcgctcgcgtgccgcgcggacttcgtgctcgagcgcgcaatcgcggcgctcgttgcgcgcttcgcaacggacgtgacagtggtggccgacctctgcctcgacgagtacaccacgcacgggcactgtggggtgctcgatgctgccggacgcgtcgacaacgacgccaccctcgttcgctaccaggcgctcgccgtggcccttgcgagcgcgggcgtccacttcgtcggcccctccggcatgatggatcaccaggtcgccgccatccgtgaggccctcgacgctcatggattcgacgacgtcggcatcctcgcctatgccgcgaagtacgcatcggctctctacggccccttccgcgacgcggtcgaggtcgagatcgcaggcggcggcgaccgcgcgagctaccagcaagatccccgcaaccgtcgcgaggcgtggcgagaggtcgacctcgacgtcgccgagggcgcggacctggtgatggtcaagccggcgagcttctacctggacgtgctgtcggacgtcgccgaacgctcaccggtgccggtccttgcctaccaggtttcgggtgagtactcgatgatcgtcgcggcgagcgcgaacggttggctcgatcgccgtctggcggtgctcgagtcgctggtcgccatccgacgagccggagcggacggcatcctcacctactttgccaaggaggcagcgccgtggctgcgatgatcttcgagtccaacgaagcggcgttccgtgccgcgtccgaactcatggtcggcggggtcaattccccggtgcgttcgttcgcgtccgtcggcggcacgccgtatgtggtcgagcggggcgagggtgcgtgggtcatcgacgtcgaggggcggcgctaccttgattacgtccagtcgtacggggcggtgatccatggtcacgccgatgcgcgtatcacgcgcgcgatcgccgatcaggccgcccgagggaccaccttcggtgcaccaacggtgggcgagatccggctggcgagcgcgatcgtcgatcgcgtggccggcgtcgagcgggtgcgcctcacgagctcgggcaccgaagcgaccatgacggccatccgattggcgcgaggcgtgaccggacgatcgcggatcgtcaagttcgatggctgttaccacggccacagcgacgcgctgctcgcggccgctggatccggggtggcctcgctgtcgctcccggggtctgccgggatccccgatggagcggtggccgacaccatcgtcgtcccctaccaggaggtgcccacgctcgacgagcgcgtggctgcggtcatcgtcgagccgatcgcggcgaacatggggctcgtggcgccggagccgggattcctcgagggcctgcgcgccgagacccagcgcgtgggagcgctgctcatcttcgacgaagtgatcaccgggttccgcgtggcgcgcgggggtgcgagcgagctgctcggcgtgcaaccggacctgtggtgcttcgggaaggtcatcggcggcggtctcccgatcggggccgtcgccgggccagggaccatcatggatcacctggcccccgctggctcgatctatcaggcaggcactctctcgggcaatcccgtcgcgaccgccgctggcgccgtcgcgctcgaactcctcgacgccgggtcgtacccgcagctcgaggggcgcgcacgggcgctcgcgaccggccttgcctccgtcatcgccgaggcggggctcccggtgcaggttccgcaggtggcctcgttgctgggcctgttcttcagcgacgaaccggtgcgtacctatgccgatgctcgccgggccgtcgggtcgggttggtacgccccgttctttcatgcgatgctgcgacgagggatcgcgctcgcgccaggcccgtacgagatcctcttcccgggactcgcgcacagcgccgacgacgtcgaccggacgatcgacatcgcctcggcggccgcccgtgacgcgttcgtcgccgggcctgtgcgctaacgggtggaggcgcgcggagccagcgcgctgatcactcgcccgcgcctgcgaggcgcgcggagtagatcgagtagccgtcgaccgtgcgtgccaccgcggtcgcgagcaccgttgcgatcatgagcggcacgatgaggtcgaggcccgagtgggtgagctccagtaccagcacgatccccgcgagaggggcttgcattccggcacccatcatcgccgccgcgccgatcatggcgtaggagccgatcgctgcccccggcatgacgaacgaccagatgccgccgaggaacccgccgaggaccgcgcccgtcgacaacgtcggggtgaacaggccgccggaggcaccggtacccagtgccatcgcggtgacgatgggcttcaagaggaagagtgctgcgagcaagccgaggctaccgagctggttcaagaagaccgcgtgcgccatgtccttgccgttgccgaagagctggaaatagcgcatgccgatgaagccgaggatcgagaacgacaggagtggtccgatgaggacccaccgaccggtgaagcgatggtgcgtgacgaggcccatgaggcgcacgaaggcgaccgagaagaggccgatcagcggtccggcgatcacggcgaagacgatctgggcgaggtggaactggtagttggccaccccgacgtaggtcgcgtggtcggggaggtagaggtagccgacgtacgtggcgatgacggatgctgcgagtgccgggaggacgacgggcagggtgacctcacccatcatgatctccgcggtgaacagggcgccgccgaggggaacgttgtagacggcggcgagtcctgcccccgcaccgcaggcgatgaggaggcgcttctgcgctggcgacagcttgccccatcggccgaggtagctgccggacaccgcgccgaggagcttcggggcggcctcgcgtccgagcgaggcgcccatgccgatgacgacctcttggatgatcgaggtgccgaggctcttgcggatgtgcagatcgccctcgcccttccagacgacgtcgtccacctcggagcgctcacctttggtgaacttcgagaggatgaaccatgcgggcccaccgatcgcgccggcgagcgtgagcatctcgaggcggtagatcggcgcggagcgcccgacggccgcctggaacgagccgatgtggtagtggtacgtgatgtgctggacgttgaagaggatgaccatcatgaggtcgccgaagagcccggccccgacgcccgtcaggatgaggaaaatccagaacttgagcgtgagctctgcgtcaccatcgccggtggcgttgggctgctcggtcgcgcctcgcccggtggggagtcgacgcctgatgagcggctggggtgagcgaacgcgacgcaggtgccagggatgctcgcggtccgccttgaccatcgggactctctccagtcgctcgcttgcgttcggtgctgtcgcggggcctcggacgtcactcggcacccgccggggtatgcgcgctgagtctagtggccgtcacgtccggacaagtgcaacgcgtcgcatgctactgcatgagtatgcatgtcactacgacccagccgccccaccaggctaggcggcgatggtcgggaacagcgaggatcccccaccggatcaccgccccaggggagccgtgacgacgcgaggacgtggcggactacgccaaccagggaaaggctgaccagtcgggttcgcgtcgctggaggaaggcgtctcggccctccgttgcctctcgggtgccatagagcaggcgcgtcgcttcgcccgcgaagagctgttggccgaccatgccgtcgtcgaccaggttgagcgcatacttggcgaggcgttgcgcggtcgggctgcgatcgaggattctgcgcgcccatgcgacagcaaccgcctcgaggtcctcgtggtcgacgacggcgttcaccatgcccatggcgtacgcctcctcggccgagtagtcgaagccgaggaagaagatctcgcgggcgcgcttctggccgacgagacgagcaaggtacgccgagccgtacgcgccgtcgaccgaggcgacgcgggtgtcggtctgcatgaagcgtgcatgctggcgacttgcgatggtgaggtcggcgacgacgtggagcgagtggcccccgccgaccgcccagcctggcaccacggcgatgacgacctttggcatggtgcgaatgcggcgctgtacttcgaggatgtggaggcgtccatgggcgtgctcggtgtcgtggtactcgtagccctctgcgccacggactcgttgatcaccgcccgagcagaatgcccagccgccgtcggtcggggacggaccattgccagtcaggagcacgcaaccgacgtcgtcgcggagcgtggcgtcctcgagcgcacgtgcgagctcgtcgaccgtacggggccggaaggcgttacgcacctcggggcggttgaaggcgatgcggacgaagccgccctcacgggcgcggtggtaggtgatgtcggtggcgtcgaagccttcgacgggctcccacagcgacgggtcgaagagcggtgagggccgatcaggctggtgcacgatgccatgctatcgacgacgcgcccggtcgtctcaggctcgagcgcaggcgcgcctccagcgaccacgcagctcgggggcgcgggtcccgacatccaatcgtcggctggacgtaacctcgtcgtcggacgggctcactacggtcgaggtggggcggccaagtggcgccgcgcaaacgtgaggaggtggcgtgaccacgctgctgcacatctccgatctgcactacgagcgagctccggagcgcctgagcgtgggcgtcggcgagcgtctgcgccgcgcaaggaccgcactgcgctctcgtacgttcgatctgctcgccgtgagcggggatctcacgagctacgggacctgggacgtccgcgagctcgtcgaggcgcgccggtggctggaaggcttcgagcgccggatgctcgtcgtgcccgggaaccacgatctcggggccaatcccgagcgcgccgaacgatttccggtcttcgagcgctacgaaccagttccctggagccggacgaacttcggtatgaccttcggggagggcccgctcgtggcgcgtgcgacgggtgacctcctggtcgtcggcgtcggcctgaggcgcggcgatcccgatggcgcgctcgcgctgttggagcgagcgctcgcaggtgcgacgacgcccgtggtcgtcgttggccactacccgatcgtgccggtacgcgagtcgggcgtgctcgcgtccttcggcgcgatgggctacgtggatggcgaggtcgcggagctccatcgtctgatggtccagtccacgcgggtcgtcgcgtacctgtgcgggcacgtgcacgcggcgagcgcggcggtcctcgaaggtggtgtgctccagctgagcgcgggagctctcggcccaggccccgcgctgggatggctcgtgcacgtcgagcgcgatgaggtgcgcttcgagcaggtggaagcgcctgggcgaacgacgttttggccgagcgatcagttggggggtgtcgaccccgtggcctaccacgcgggggccgtcaggagtggcgtggtgccgctcggtcggaccggtcgccccaccctcgtcgattgagttcgcggttcgcgggcgccgtcgcgagaccgccgcggccagacgctgagctccgacgatcgccgcggtccgtgcgcggtgtggaagctgtgaggcgctgcgagcgttgccacctgccatgagtcatggtgctgcgcgctatgtcgtgaccggagcgaccggtgccgtcggccgctcgctcgtcacgcgtctggtcgaggggggcgccgaggtcgctgtcgtcgtacgcgatcgggatcggctccacgagcgcctcggtccggtcgccgacgcgctcgccgccgtcgaggttgctgacgcgcgcgatctcgagcgattcgaggcggcgctggtggcggcagccggtgcccttggttcggtggacggcatcgcccatctcgtcggtggcttccttcttgcgacgccggcacggacctcgatcgcgcagttcgaggagctcatgcgcctcaacctgacgagcgccttcgtggtcgtgcgggtggccgagcgcgtgatgggatcgcgcggtggctcggtcgtgctgatctcctcggcggcagcccacgtcggcctcgcctcgcacgaagccgtcgcggcttcgaaggctggtgtcgaaggactgacccgatcggccgctgcgacgctcgccagagctggcgtgcgggtgaacgcggtcgcccccggactcgtcgaggccgagatgacgcgcgggatcgtcgagcgagaggatgcgctcgcggcgtcgatcgagctgcacgccctgggtcgcatcggcaccggtgacgagatcgcccgaggcgtggcgttcttgctcgacccggagtcctcgtggatcaccggcagcgtgctcggcatcgacggcggtctcgggtcggtgcggccgcgcccgcgccgacggctcccttctcagaccgggggccaaggatagggccgtccgtgctccggcatgggcgggagcgcgccgcgtcgaacgagacgcattgctcgctggaggagcgcacgtcgttcttcgggctcgagcagccgtgcgaggtcgtcgggcagatcatctgccaaggaggcaagacgtgcggccaacgcggtggggagcggatgacccgcgagatcccagatcacggttcgtagcttcgactccgggtggaaggtgagcgcgttgtcgatcgcccagagtcgcccctcgtcgtcgaggaggacgtggctccccttgcggtcggcgttgtttgcgacgatgtcgagtgccgcgatcaccgcgagagactcgtggtgggcctggtcctcgacgagctcgaagtaggtgaggtcgaagtctgcgtccacgaaggcttggagggtgccgctgccgtagggtaggtcgtggcgcacgacgataggcggcacgtggcagatgccgacgaactcggcgagtgctcgaaaggcgagttcccggcggcccagccccggggggaagtcccacaacgggcgctcgagggcgtcgggcttgtagatcgcgagtgctccggagtggaccagctcgacgaggtgggcgccgttggacgacgcagtgatccgcccgaggaggcgaacctcgtcgtcgaggatggcaggatcgtctaacgcgctggggcgcgatgcccgttcgtccgtggacacgcgtggccttcgggattgatcggatagccgcagagcggacaggtcggtctgccttgttcgaccacctcggcgatgcggatcgcgagacgcgctgcgagctcccgcgagagggtgaaccgtgctcgacgtggctcgacgtcgacgtcgcgctcgtcttcgatggcctcgatgacgagcactcctgcatccacgtcgaccgcgagctggagttcgccgacgcggaaggctggttcggcgggttcggtgagcggtgtcgtcggtggcagctcgccgggtcgcgcgaggtcctcgagcgccgtggcgatggccctggcaagggcggccatctggagcttttcgacgaggagggtcacgatctcgccgttggcgccagcctggaacaagaagacgcgttcgccgggtctgccgtgggtgccgagggtcgcgaactccgcaggatcgaactcccagacgaactcgttcacctccgccacctggccccagtgcgttcgttgagcgtgagcaggccaaggctcgtcggcgtcacgctgaaggtggtcgacgaggccgtctcgacccagatccggtggacaccgtcgacgtggataccgagcgcatcggcggcgagcaggcggatggggtccgcgtgtgaggtggcgacgacgacctcgccgggatggcgctcggcgatcctggttgcgaagcctcggatccgggcgagcacatcgacgagtgattccccctcgggaaaccggaacgtcgacgcagccgcgaggagcgttgcccactccttgcggcgacgcacgcgtcccaacgaccagccggtccaggcgccgacgtcgacctcggcgaggtcgtcgtcgacgatcgcggtggtgccgaagacagcctcgagtgcggctgccgtctggcgagcgcgctcgagcgggctcgagtacagcctgatggcatcgaagcgccctgcaagcaccgctgcggtgcggcgcgcttcggcctcgccgcggtccgagagggcgagacccggccgtcggcccggcaactcggtgccggtcgtcggtgtgcggccgtggcgaaccagcaccagcgtcgccggtcggtcgctcatcgggccgtggctgtggtaggagcgattggcaccctcgtcaccttagcgccgaaggcgcggtccgtacggatcgacgcctcagtcgaggcgctcgacgatcatggccataccctggccgccaccgacgcacatggtctcgaggcccagacgagcccccaactcatcgagctcgtgcagcagggtcgtcatgatccgagcccccgtcatcccgaacgggtggccaagcgcgatcgcgcctccgttcgggttgagttggtggtcgatcgagatgcccgtctccttgacgacggggagcacttgggctgcgaaagcctcattgagctcgacgacgtcgatgtcgccgatcgtgagaccggcgcgttcgagcacggcgcgtacggcatcgatcggtccgacgcccatgatctccggagcgatgccggtcacggcggaggcgacgatcttggcgagtggccggatgccgagtgcctccgcgcgtgagcgctccatgacgatgacccctgcagccccgtcgttgagcgggcaggagttacccgccgtgacccgtccgtcgggcctgaacgctggcttgagcgtggcgagcacctcgagggtggtgttggggcgcggcccgtcgtcgcgccgaacgacgttcccactcggcgtcgtgacggcgatcgtctccgcatcgaagaagccccgttcctgggctgcgaccgcacgctcttgcgagatgaccgcgtaggcgtccatcgcctcgcgcgtgacgccgtagcgatcggcgacgttctcggccgtgaggcccatggggatgtacatgtgattgacgaagtccgcgcggctctcgtcggtgaagcgagggttcatgtcctcggggtcgaaccccttgatcgatgcacgtgtcgtcgactccacaccgccagcgatgaaggcgtctccctcgtcggccatgatcgcatggaacgccatgcgaatcgcttgcagcgacgatgcgcagaagcggttcacggtggtgccggggacggtctcgggcaggccagcgagggctgccacgttgcgcccgaggttcatggattgctcgccgtgctggatggccgctccccagatcacgtcgtcgacgctcgccggatcgagggccggcactcgggtaaggagctcggcgatcacgaggccagagagatcgtcagggcggacgtcgacgagggatcccttgaaggcgcggccgatcggggtccgggcggtggcgacgatcaccgcctcgcgcgccgtcatcgctcgcctccggtcgccagcgcgctccgttggcgcagctggcggagcacgcgctcgacgtggccggtcgcgcgcacgttgtagagcgcgtcgacgacggcgccgtcggcgtcgatgagcaatgtggaccgcaggacaccttccgtcgtgcggccgtaggacttcttctcgccataggcgccgagggctgtgatgacggaccgatcgggatcggcgaggatgtcgaagcgtaggccgtgacgctccgcaaagcgggcatgggatgcgaccgtgtcgggagagatcccgacgacgcgccaaccgagcgccgccagctcgtcgacggacgcgttgaactccgtcgcttccagggtgcatcctggggtcatgtccttcgggtagatgtagaggatggtcgcggtgccagcaaacgagtccgcgcagacctgctcgcctcgttggttgggcaggcagaagctcggaagacggtcgcctggcgcgagccggttcgtttcggtcatgggccaacgctagcgcgatcgcgcggcggtcacagggcgggcgtcgctacgctccgtcgaagaaggaggagccatgggagatgacgagctcgtagccctcgcgtcagcacttggccaagcacgcggtgatgctgagacgctggcatcggtgctcgccgatgcgctcgagcgatggctgggcaccggcgcggtgcgcgtgcagcggcgcgggttgcgcacgcgacggatcgtcgagctcgcggtcgacatcggcgaccgtcgactggtgttgcgcccaggaccaccggtcgtggcggagatcgtcctccgttcaggtggcgttgcgatcgctcatgatcgggtgtcgctctcggcgtggttgtccgcgctgaccgaggcactcgccgcgcagctcgggacggcaacggacgacgtgcgggcactgcgccgtgccctgggcctcgatgactcggtcgactagcgtggcactggtcccaggaggtttgcgtggaactgcagccatttgaagcaccccagtccgtcctcgtgatcagtgcgcacccggacgatgtcgatttcggactcgcgggcacggtggcccgttggaccgcggcgggcacggaggtcgcctactgcatcgtcaccgatggcaacgtgggcgggttcgacccgtcgatcccccgttcggacattcctgcgattcggcgccgcgaacagcgggctgcggccaaggtggtcggtgtcgagacggtcgagttccttgggtacgtggatggcgaggtgacggtgacgctcgggttgcgacgcgaccttgccgcggtgatccgacgtttccgtcctcacaccgtggtggcgcagtcaccagtgcgcaactttgcgcggatcggtgcgtcgcacccagatcacatggccgtcggtgaagccgcgctgtgcgcggtgtatccggacgcgcggaaccccttcaccttcgtcgagctggcagaggccgggctcgaggcgcacaccgtcagtcaggtcgcactgatggcgtacccggagccgacccacttcgtggacgtcacggaaacgctcgacgcgaagctcgaggccatctcgtgtcacgcgagtcagttgcccgatcccgaggcgacgcgcaccttcgtgcgtggctggctgcgtcaaggagccgaggctgccggtctcggcgacgatcgctacgccgagctcttcttcgtgttccccacggcctagggcgcccatggcgcgcacgtacggatcgggtcgccctcgctcgcgatcaggtgacgcgtgtgcggcttcgacgtggcgcacgcgtcgtcgtggcccagatgggacctctgccgtgggtgtgctcggtttcgagtagtgtggtggttgctgagtcggcagggctcggcgctccccgtgttcgagcgcgttgctccccgccaggtgagcgggcatgagttcgcgcgtcagagacgagcacggcgtgtctcaccacttcgtggtcatcggcgtgatgttgaggagtctcgttgcgtgctgctgtctttcatcgtccgggtctgatcacggtcgacgagcgtcctgatcctcgggtgctcgagccgaccgacgcggtcgtgcgggtcgtgcgagggtgcgtctgcgggtccgacctctggtactggcggggcctcagtgagcgcggtccgggctcgatcggccacgagttcatcggggtggtcgaggagatcggctccgccatcgacggcctccgccccgggatgctcgtgatcgccccgttcgcctttgcggatctcgcctgccccaactgccagtggggcgccaccgtgaactgcgtgcacggtggcctgttcggcgacggcactatcgacggaggccagggagaagcggtgcgcgttccgctcgccgagaccacgctcgtgcccgtcccgggtacctcgtggtcggacgccgagctcgcgtcgttccttgcgctctcggacgtcatgccgaccgggcaccacgcggcggtgtcggcgggggtcacgaagggtagcaccgtcgcggtgatcggcgacggcgctgtcgggctctcggcggtgctcgcggcgcatcgactgggtgcggagcgcatcgtggccctgagttcgcacgcggaccgacaggtcgtggcccgggctttcggggcgaccgacatcgtcgcccaacgcggcgccgaggccgtcgcgaccgtgctcgagatgaccggcggcatcggtgccgacgccgtgctcgagtgcgtcggtacccaggaggcgatggagaccgccgctgcgatcgcgcgccctggatcgatcgtcggtggagtcggcgtgccccacggtgtgatgcccgcgacggcgctgttcggtcgcaacgtcggctggcgcggtggcccggctccggtgcggatctacctcccggagctgctcgaggacgtgctcggcggcacgatcgatccaggtcgcgtctttacgtacgagaccgacctcgacggcgtcgtcgaggcgtaccgggcaatggacgagcgtcgggcgatcaagtcgatcctgcgcgtcagcgagccgtagcacgttcgctggggcgacacgacagggcgaagggcagaggcgagacgagaagcggaggtgaccatgcagtatcgaatgctcggcacgacgggggtggaggtctccgtactctgtctcggggccatgatgttcgggagctggggtaacccggaccacgacgagtcgattcgtatcgtgcaccgggcgctcgatgcgggcatcaacttcatcgataccgccgacgtctactcggagggcgagtccgaggagattctcgccaaggcgctccgaggtcgccgggatgaggtggtgctcgcgaccaaggtgcatggtcgtatggggcctgatcgcaatgccaagggcaactcgcggcggtggatcatccacgaagtcgagcagtccttgcgccggctcggcaccgagtggatcgacgtctaccagctccatcgccacgatcccgacaccgacctcgatgacacgctcggcgcgctcgacgacctggtccgcagcggcaaagttcgctacgtcgggcactcgacctggcccgcgagtgccatcgtcgaggcgcagtgggtggccaaggagcggggctacgcgcgtccgcgcaccgagcagccgccctactccatgctcgtgcgttcgatcgagcgggaggtgctcccgacctgtgagcgctatggactcggtgtgttgagttggagccccctcgccggaggttggctctctggccgggaccggcgcgatcgcttcagtggcccgcagtcggctgcacgccagcgggtcgctcgacgtttcgatctctcgctgccggagaaccagcgcaagctcgacgcgaccgagcgcttggcccagatcgcggcggaggcggacctttcgctgatcgaacttgccatcggcttcgtgttggcgcaccccgccatcacttcggcgatcatcggaccacgcaccatggagcatctcgagtcccagctgtcggcggccgatgtcgtcgtgccgaccgcggtgctcgacgcgatcgacgacgtggtggcgccaggaacgacgatcaatccggtcgacgatggctgggttccgccctggctcgagccgactcggcgtcgccgtccctcgggtgcgtgagctcgacgcagtcggcgcgctcgatgagctcgtgggttcgttcgggccgcacctcgcgttcggccgacggagctgctcgcacctcgacgacgatcttcgggaatcggcggtgctgcgacgaacgatcgaaccgagtcggtgatgcggcgtcctggccgcgtcgtggtcgctcgtgcaactcgagcaggacacggttcgcgaacgccgtctagcggcgacgcatcgtgactctccagagccgtcggggcaggtcgccctcttcgaaggcggtcacgtcctcgagctcgaagccgtcggcgaggcgatggacgaggtcctcatcgaagaagtggaccgcgaagccaccgttctcgaagcgatcgtcgccgaggtcgatgccctggccgtagtgggcgtcgcccttgtggcgcaccgtgtagacgcacgtcgcgcccggtcgcaggactcggtgcagctccgcaccgagggcgacgagctcggacgtcgtgaacgccatcgtgaagagcatgtgcgcgaagcaggcgtcgaagtagccgtcggccagcgggagaggccgacataggtcgtgggtgaccgaggtgagccgggcgccggttccacggccatgtgctgcgtcccagagggctgcgagtccactcacggcgtagtcgaccgccgtgacctcgaggcccgcatcgagaaagtgcagggtgtcacgaccgtgcccagcgccgagttcgaggacccgagcggccccgtcagcgagcatgcgtgagagagcccatcgaccagcctcacttggcgccgaaccgtagagctgcgggctggcacgaaaggtggcctcccagtgggcttgctggcgtgttccgagatcctcgaccggtgtgctcattggtctgcttcctccgtcgcgtctgcagggtgtgcgctcccttctccccgatgccatggcgtcgctggtcgtagcggcggcccacggtccccggcggctcgatcgggagatcgtcgatctgcgctctcgactcgatctgcgctctcgaccccctgcactgctcgtccgtccatgccacgatcggatttgtcgtcgggaacatcacggagggccccgtgagcatcgccgtcgcgctgatcggcaccgtgaccatgggtcttggcctcggtctcgcgtggctgtatcgccggctgatcgagccatccgaggcgcaacgcacccttcgagcgtactcgagtcgcgagcgccgttcgatggaacgtcggctgcttcgcggtggtggtgacgagttgcctcgctcgtacctgatggcgctggtccaagatccgtcaggtcgcccgatcatggtcgccatcgcggtactcatcgcgatcgtcatcgggttcggggtttggctcgtcctctccgccctctggggaccgctgcgacccggagtgatgctgtgggacttcgtggcgacccaagtaccggcgtggagcggcgtcgcttatcggcgacggcggatcgtccgggcagcgcaacgtgctcttggatcctcaccggcttcgttgcgtcgttgacccgctgaacggcacgatgcgtgctgcgtccctggagcgtgtcgctcgtgcgacctcgctgtgacgtgcctacactcaggagcatggttacggggaagtcgcagagcgtgctcgatgccatcggatcgacaccgctcatcgaggtcgagccctccatcttcgccaagctcgagtacctcaacccatcgggctccatcaaggcgcgcatcgcgcgctacatgatcgaggcagcggaggcacgcggcgagctcgagcccggcatgaccatcgtcgaggcctcgagtggcaacacgggcaacgccctcgcgatggtcgcggcggtgaagggctaccgcatggtcgtcgtcatgccagaggggctctcgtcagagcgcgcagcgatctcgcgcgggttcggcgcggaggtcctgcgcgtcgggaacttccacgttcagcatgcccgcgagaccgcggtggagatgggcgagcgcccgggtttcttctgcccgcgccagttcgattccgaggacaacgtggccgagaaccgtgagtggctagggccggagatcgtgaccgatctcggtgcaccgccggacgcgttcgtcatgggtgtcgggacgggcgggacgctcatcggcgttggtcaagcgctccgggcggtcaaccccacgactcggctcgtcgcggtggagccggaggagagctgcacgatcctctgtggtgaagttcaccaccatcgcatcgagggcatcgccgatggcttcgtccccacgatctacgagcgccaccggacgatggtcgacgaggtgatcccggtcacgagcctggacgcggttcgcaccatgcgcgagctcgcgcgccgcggcatgttggtcgggccgagttcgggggcgaacctggtcgccgcccgtcagctccgcgagaaactcgggccgaacgccacgatcgtgacgatctttgccgacgagggggagaagtacctcacggagtacttcttgacccgtggcgagctcgctgcgatcctcgagggcagccacgacgacgactgggtcgccgcctcgggcggcatcacggcgccgttgcctccccttgctcggtgaggaactgacgctcgaagagctcggcgtagagcccacctgcggcgagaagctcggcgtggctcccttgctcgacgacactgccggcggccatgacggcgatggtgtcggcaccgaggacggtggagaggcggtgggcgatcacgatggcggtccgtccctggagggtgtcgccgatcgctgactggatgagtgcttcgttctgagcgtccaggctcgaggtcgcctcgtcgaggatgacgatgcgcgggttgcgcagcaggacgcgcgcgatggcgagccgttgcttctcgccgcccgagagtcggtagccgcgctcgccgacgagggtgtcgaggcgatcagggagggcctcgatggtcgcgaggagctgggcgcgcgcgagcgcatcgcgcagctcgtcctcggtcgcggatggcttggcgtagcgaaggttcgcgcgcacggtgtcgtggaagaggaacggatcttgggtgacgacgccgatctcggcccggagctcctcgaggtcgagctcgcgcaggtcgatgccgtcgagcgtgacgcgaccgcgctctggatcccacatccgcgtcaccagcatggtcaccgtggttttgccagcccctgatgggccgacgagcgcgagggtatggccgggctcgacgtggagcgtcaccccggcaagcgcccaatcacgctcctcgctccgcgggacaccctgcttggtgaggctcgcgaccgcctggttccgaggatagcgaaaccacacgtcctcgagggcgaccctaccctcgacgcgctgcaggtgacgtgggttcgggggcgaggtcacggcgggttggacgtcgaggacctcgaagatgcggtcgaagctcacgagtgcctggagaaggttgacccgagccgaggagaggtcggtgatgggcccggtgaggcgggtgacgtactgcgcgagcgcgacgagcgatcccagggagagtgcgccgcggatcacctggtcacctccgagggcatagaccgcgatggtcccgatcgcgctcgcaagcccgagaatagcgaagtagaccctgccgaccagggcgaagcgcacacccgcgtcacggacgcgacccgcatgatgggagaaggtgtcgagctcgtcgcctcggcggccgaagagcgcaacgagcagcgcgccggagacgttgaagcgctcctgggtgaaggcgttcatctcggcattggcttgcatctgttcgcgcgcagcgtgtgcgacacgacgcgacaagaggcggtcgacgaggacgaagaccggcacgatgagcaacgagagggcggtgacgagcggtgagagcgcgaccatgaagccgagcgtgaagatcagggtcgaaagatcgctcaccaccgagccgagggtcccgacgacggcttgtgagctggtgacgtccgaggagatgcgcgagagcaccgagcccgtctgtgcctcggtgaagaagccgagcgacagctcctggaggtgggcgacgagacgggtgcgcaggtcgaagatgatccgctcgccagcgaccgaggagacgtagcgcgttcccacgccgagcgcgctctgagcgagcgacagcgcggcgatgatgacgacgtcgatcgtgaggcgcccgatcgagcgccgaacgatggcgacgttgatgatgtctcgcaccacgagcggcaccagtgcgccgaggagtgcggagatggcgagcgtggccaggtagacgatgatgagggcccgatggcgcttcgtgacgctccaggcccgccgaagcgtgcggcgatcgatcgagcctggccgcaccggatcggcggccatgcctcgcagcgcgcgcattccgccgaagccccctccaggctgcaccgcgcctcctctctcggaaccaggctagacgcggtggtgttggccgagcagggcggctcgcgtagggttgagccgtgaaccagctcgcgcagtcgctctacgaggtcgtcgtccgtcgtcgagacgtacgtcgggagttcatcgatgggcccctcgatcccgaggtcctcggacgaatcctggccgcggcccatcacgctcccagcgtgggcatgagccagccctgggacttcgtggtggtgcgcgatcgcgagctcagggcggcctttcgagatcacgtgctcgaggaacgggcgaacttcgccgcgtcgctggatccggagcgtcgggaacgtttcgacaacgtccggatcgagggcattctcgaggcgcaggtcggcatcgtcgtcacctacgacgcctcacggggttccccgaacgtactcgggcgccacgcgatcgccgatgccggcctctactcggtgtgtctcgccatcgagaacctctggctggccgccaccgccgaggggatcggggtgggttgggtctcgttctatcgggagccgttcctcgcctcgctgctcgggatccctgcggggatccgtccggtggcctggctcgcggtcggtccggtggcacgattccaggaggttcccgatctcgagcgagccgactggcagcgccgtcgcccactcgcgcccttcgtccacctcgaccgcttcgacgccgacgcccccggcgaggacctggtggtcctgccggagcgcctggtcggggaatcggcggacatggactgagcgatctgcgggtcgcgttcgtctagggcgcgatcgtcgtcgcgaccagcagcgcgagcagcacgtcgcgggcgccgagcgctcgttcgagctcgcccagagcgtcgtcggaaggacgcggggccccgtcgatgatctcggccagggcgaggcgagcgatccgatcggtgatctcctgcagtgccgccgcttcgacgagattcgccgggaccaacgcgcgtgcgcgctcgcgcaggcttcgtgcccaggtctgatccagcagccttgctgcgtcgtccgcacccacgcggccagcgatgatggcggccagcgcgagggtcgcgccgcgccaggctgcgaggcctgctacgtgggcgtcgtgtccctcggcctcgagcgcagccgcctctgtgcgaagccgctcgtcggccgtcagctcgttgacgagagccgcgcgctcggcaagcgtggttgggtcggcaagctcgagcggatcctccacgagcagacggaggtcgagcgccgcgtcgacgagggtgtcgcggatccgtccataggcaccaagccgacccgcgaagctcccgtcgcggcgccagagaaggcggcgagcgacgtcctcggcccccgtcgcgaagatggcgatcgtggcaaactcggctgcgcgcagatagctcgttctgccaagctgggcgatgcgggccacaccgaggatgccgaggtggttcacgaggaggttggcgagcgccgtcgcgaccaactcgcggcggagcgggtgcgccacgcctgcgtccgagacgaggcggcgtacctcgatcgggaagtagttgaggaagagctcgtcggtgatcggatgatcgagcaatgaggaggactcgaggagctgcgtgaggtggatcttcgcgtaggagatctcgatcgcgagctccgatctggtgagcgggcgccccagcgagcctccgcgaacggccgctggatcgggcagcgtctcgaccgccacgtcgagctcggcctcgcggaccaggcgctcgagcagcgcgccatgctcctcggcccttcgtccggcctcgtgctcctcgaggctgaggacccagttctggtagacgttgtcggccaggacctgcgcttcgacctctccggtcagctgtgcgaggagctggttgcgctcttcggtggtcaggtgaccctggcgccgcagctcttcgagggcgatcttgatgttgacctcgtggtcggaggtgtcaacaccggcagagttgtcgatcgagtcggtgttggcacggccaccgtgcatgcagtactcgatacgccctgcctgcgtgaggccaaggttgccgccctcggcgacgatgcgtgctcgtagctcggatcccgtgacgcggatgcgatcattggcgcggtcgccgacgtcggcgtcgcgctcggtcgtcgcacgaacgtaggtgccgatcccgccgttgaacaggagatcgaccggcgccatcagcatggcgtggatgacctcgtcgggttcgtgagctccgggggcaaggtccaggagcacggcagcctctggcgagaggtcgacgtgcttggctgatcgcgagaagacgcccccgcccgccgagatggcatcggcgggatagtcggcccagctcgtgccggccccgcgtgcgaagaggctcgcgcgtgcggcaaacgaacgttccgggtcggggtcggggtcgaggaagatgtgccggtggtcgaaggcgcccacaaggcggatcccgtgcgagcgcagcatgccgttgccgaagacgtcgccggacatgtcgccgatgccgatcacggtgatggggccgtcggggtcgcgctcgagttcgtcgaggtggtgtcgtaccgagatccacgcacccttggcggtgatgcccatctccttgtggtcgaagccgttcgacccacccgaggcgaacgcatcaccgagccagaaacccatctcgagtgcgatctcgttcgcgatatcggagaaggtcgccgtgcccttgtcggcggcgaccacgaggtagtggtcgttgccgtcggtgacgaccgtgcgagggggatggacgatggttccgtcgacgaggttgtccgtgagcgagagcagggtgcgcatgaaggtgcgatacgagcgctcgaccttgtgcgggttgcgctcaccgggtgcgaggtcgcgaacgacgaagccgcccttggagcccatcggcacgatcaccgcgttcttcacggtctgggccttcatgagtccgaggatctcggtgcggaagtcgtcgggccggtcggagaagcggatgccacctcgagcgatgcgtccgccgcgcaggtgcaccgcctccgtggtgcgcgagcgcaggtagatctcgaagcgtgggcgcggcgagggcaggtaggtgagctggcgcgggtcgagcttgaacgcgatggcctcgcgttcgggctggaagatattggtccgcgtcatcgccatgacgatctcggcgagcgcgcgcagcaccttctcgtcctcgagcgtcgctgcggcctcgatatcggtggcgagctgggtcgtgatggcctcgacgtcacggggtcgatcgagttcgctggcgtcggggtcgaaccgcgcgtggacgagccggacgagatcgcgagctgcgagcggggtgcgggtgagcgtgcgtcgggccgaagcctcggtgacaccgagcgtcccaaagcgcaagtaggcacacagcgcgcgtgtgaggtcgatgtcatcgaggtcgagcgcggccgtcgtcacgagggtgttcaggtcgtccgcctctgcctgacctgcgatgaccgcttcgatggcgcgttcgaggcgatgggccgctgcgtcgtcgccgagcccatcggcgacccccgctggccagcccaggcgaagctcgatgatccacacatcctcgccggcgacccgtcccgtgtaggggacttcctcgcgtacgcgtgcgccgaagccctcgaggaccgggacgatgtcggacagcgctggtcgttggccgaccgcgacgagccgaagtcgctccacctctccggtcgcgggtcgacgtaccgcgagccgtactggcgagcgtcgcgctcggccgagcgcgaggacgtcgagcgccgcctcgcgctcggtggtgtcgatggcgtagctctcctccatgccctcggcgagcgccgtggcgaggctcgaggtctctggatcggcatcgggggtgctgagggcattgacggcagcctcgaggcgcagacggaagggggtcgtggcggcggcgatcgccgcctcgagctgactcggatcctccgggacgcgatcgaggaggtagtcgaggacgagtcgccgctcggagaggttctgcgtgagctgtgcggtggcaacgaggccacgctcgacgagcaccgcctcgaggcgatcctcgacgccatagtcgacccgagcggccggcaccacgaccacgagcctcgcccccgcctcgaccgggatcacgagggcacggggcagcccgagttcctcggcgagcaatccagcgcgacacagctcgtcgaaggttgcgtcgtcgactccgatcgccaggtcggcagggagcgagccgacgaagtcgcgcaacacgcgccatgagtggctcgatggcaggagcgcgaggagctggcggacgcgctcgaggcggctggcgatctcgggtgcgccaaccccgatcccgctgacgagcgacgggcggaaggtccccacgaagtgcacggcgcccgacgacgtcccgatggacagtgtgcgcagcggcgagtgatcgaggatgggggctgggatcgcggtgggctcgaggcgccactgccctgccgagaccgccagggttggcacggcgacgtcgatgccccgccgctgttcaccctcggcgctgactcgcagttcggcgatcgggaggaagtgggcgatcgccgaggttccgggcgtctcgccaccgtcgaggccctcggtcgcctccgcaagcgttgcgagctcgtcgcccatggcctcgcgatcgtgctcgagtcgcagcagctgcgtcgcctgcgtcgcgagggttcgcgcgaggtgctcggtctcgatgcgtgacaggcgggtcggtgtcgtcgctgcgaagaaggagacgaggtgggagccctcgacgaactcggcgttcgcgtcggtgagctcgccttcttccaagatgggatggaacgtgctcgcgttgtccacgatctggcgtaccgcggcgatgaaggtgtcgacgagccaagggacatcccagctcacgaccacgatgctcgtgagggggcgcgccggttcggcgatgacccgctcgagatcggtcgcgccgtcttggccacagtgcacacggaggacctcgttgtcctgggcgatctcgacgatgcagcggtcggagcccttggcgttcgtgagcgcatcgaagagggccgcgaccgcgacgccgatgcgctcggtggtgagcgcgctggtctcctcgtcgtcgaggtggcgcgcgaggctcgcgacgaagtgttccagggcgccagcgtgcgacggcacggcgccagaatgtctgcggaccgatgacaagagggacgccgtttctggacgcccagtaccagcttcgagcatcgtacgactcctttgtcgactttgcgatgccccgagcctaccgagctcgtgcgacttcgccaagggctcgccgggcgctcgaggcgctcggagccctatcggcagcttcggcgacgacttgcgtgcgtcgtgcacggctgcggtggagcgagctgcgacctggaggttctcgcccgtcgcagcgcccctcgcagctagcggcgcgcgatctcaggggccataatcgagatgaggtggtaggcaacgtgggaggccgcgatggtcgtgacctcagcgtggtcgtaggcaggtgcgacctcgacgacgtcggcgccacggatggaaagatcgcgtagcccatcgaggatcgcgagcaattccctggaggtgagccctcccgcctctggtgtgccggttccgggcgcaaaagccgggtcgagcacgtcgatgtcgatcgagacgtagacaggtgcggtgccgacacgatcgcggatgcgctccaccacgccatcgacgccgatgcgatcgacgtcacgtgcggcgaggacgcgaaagcccatgtcagcgtcctcggtgaggtcggagcgcgcatacagcggtcctcgggtgccgacgtgcacgctcgcgtcgggggcgaggaggccttcttcgaacgcgcggcgaaacggcgtcccgtgcgtgtagggcgcgtcgaagtaggtgtcccaggtgtcgaggtgagcgtcgaagtggacgagggcgagtggtccagtgcggggcgccagggcgcgtaacagccccagtgcgatggtgtgatcgcctccgagggtgacgatggttcgaccagcctcgccgagctctcgcgcagcactcgtgatggcagtgagcgcagcgtcgatcgagaacgggttcgccgccacgtcgcccgcgtcggcgacctgtacttcggcgaatggccagacgtcgaggtcggggttgtatgggcgcagcagcttggagcccgctcgaatggctgaggggccaaagcgtgctcctggtcgatacgacgtacccgcgtcgaaggggacgccgaggacgaccaggcgagcgtgaggcgcctcgtcgagacggggcaggcgtgcgaaggttgcggggccgccgaagcgcggcgcgacgagcgcgtctggcggtccgatgatctcgtcagtcatggagccctcctccgttccccgggcccatgcgcgctgtgcgctggtgctccttgcaccttagaggcagtgtgcggcctccgccatggcgagctagcgtgaggacgtgcaggctccacgctttccgatcggcgagcggctgcgccatgctcgcgagcaacggggtctctccctggccgcagttgccgagcgcactggcctgtcgaaggggttcctctcgcgggtcgagcgcgacggggtgagcccgtccatcgactcgttggtcgcgatcgccgatgccgtcgggctcgccgtcgcggacgtctttgcggtggcaccggtggtggtttcacgctccgtcgatcgcttccccgatggactgcctggcgagggagtccgggacacgttgctctccccacccgacgatcggcgcgttaccgttctcgagacggtcgcggcacccggagggagcggcggtgacgagctctatcacctgccatcgcaggtggaactttgctacgtggtcgccggtcgtatcgaactcgttttcgcgagcgagtgctacaccctcgatgcgggtgactcggcgaccttcgctgccgacgcagcccacacatggcgcaacctcggcgacggcgaggcccgggtgctctgggtgctcgcaccggcccttcgggatccctggacagccaaggagcgccgcgacgacggttcggtcgcggacgtgcagggcgaacgtgtctaggaggacgcctgccaccgcaggagccgctcgtgtcgtgctcctgacgcgcgacctgttgggcgcgagccgactcgactcggtccggatcgtgcgctcgagcacgagcctcgtcgacggagacctcgacctcgtcatcgtcgatgtgcgtgcggcgcccgagggatggcgatcggccgtggcgggactctcatgtccttgggtggccgtcgtctcgcacgtcgacgacgctggccgggatgaggcgctcgcactcggtgctcgacgcgtggtgacgcgcagctggctgttcggtgcccgcgacgtgggcgcgcgtctcgagcgcttgctcgtcaccgacacgaaagcgacgggaacggacgcggtggcggacgcggaggacgactgatgcgccaccatggcttcgtcctggcgcccgtgttcttcgtggtgctgggcgcgttgttcctcgggtccgttgcgttgatcggactcgatgtgctgtcgtttgcctatgtccgcgttggcgtgccggccgcctggctcttcggtgtgctcgtggcgtcgctgctcggaagcttcttcaatgtgcctgtatggcacctcgagacgcctggcgatccctacgacgagggcatcgtgagggtgttcggcgtgcagtatctgatccgacgcccggtcgcaccccagcggacggtcgtggcggtgaacgtcggaggtgccctcgtgcccaccgcgttgtcggtctacctggtcgtccacgaccacatcgagctcgttgccctcggtgccaccgtgatcgtcgccctggtcgtccacgtcgttgctcgaccggtgcgcgggctcgggatcgcagtgccgacgctggtgccggcggtgctcgctgcgctcacagcactcgtcatcacgagtcgcgacgtcgccgcggtcgcctacgtcgccggatcgatcggagtcctggtcggcgctgatctgaccaacatgaccaagacgcgttccttgggcgctggcatggtctcgatcggcggtgcgggaaccttcgatggcatcttcgtgacggggatcctcgccgtgctcctcgcggccctctaggaccgctctcgggttcgtcgcaccgatcgggtccttcgctgcgtgcacgcgagccgaaggaccctggtggcgcgccgcctcgctcatcacactgaggtgccccagatttcgtagacacccaggttacttcacgcgagcctcctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatcccgtgtcgggcacagaaggccacaactcgatggtcgctgaactgactccctcggtcggtgtgccagatgaccccctgcgcgtgggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccggcgatgccgcgcctggccatcgctgctgccaccgtgttgtggctcgtcaccacgccagcggcgaggagtgccgccgtgatccgtcgtgcgccgtaggtgccagaggatgcctggtggaccgcgaccactcggttctcgaggtcgcgtcttgcacatgcccgacgcgacggtgctacctgggtgcgtcgccatcggtagtagccagcccgggagacctcgagtaagcgtgccatccgtttgatctcgaagcgagcgtactccgcctccatcagcgcgaatctctcttgcttggtggcttcgcggcgaagtacgcggctgcttttcccaggaactcgttgtccttgcgcagctcctcgagctccctgcgcagcctgatgagctccgtgcgctcctgcgccgtgaggggcgggctgccagtggcgttggctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggggcggctcacactgtcaatggcggtcgttggagtgcgaatgactccaccgtcgcccatgcatccagattgaggaggtacaccatgagacgccgcgtctttgacgtgctgacgagcgccgtaggcctggcgatggtcgtcgtcttgctcgttgcaggatccttgctcatgtgggggtccagctttgcgagctcacaggtccacaaccagctcgcacagcagcagatctacttcccgcctgccgccgcgttccgccacgccaagcccggtacggagatcaccccatcgatgatcccgtcggtctcgcagtacgcagggcaacagctcctgaccggtcagcaggccgaggtctacgcgaacgacttcatcgcggtccatctgtccgagatgccctatcacggtgtctacgcgaagatctctgcggcagcgatggcgcagccgaagaacgccgagctccaggcgctgcgcctgacgtcgttcgaaggcaccacgctgcgcggcctcttgctcgaggcctatgcgttctcgatcttcggtgagatcgcattctgggcttcggtcgcggcgttcgcgctcgcggcggtgatggccgtcctcgtcggactcggcttctggcacgcggggcgcgtcccgctcgacaaggagatcctggtcgattcgaactccgaacgccaggtccacacgatggcttgagggcgagatcgttcacacggtgtcagcgcgctctggggcaggtcctcagggcgcgctgacgtctgcgtggttgtctcgccacgtagagttgggtcgtgagcctccccagtcgtcgatcgcaggagcgtcgagccgatctgacaacccctgctcgcacctcgacaggggtcgggcgccgaacgacgtctggagccctcgggccagagcagctcatcgagctgcagcgcacgatcgggaacgaagccgtgcagcgcaccctcgcacgccacggttccgttggtcgccggcgctcgggcgccgtcgccgggatccagcacgctccgtcgacgttggcggcgatctctgcacacgggtcgacgatccggcacgcggtggcggcggcggttgctgcggtcgtcgttgcgggggtccagaaggcgacgggatcgaagggcgggtcaccggagggtgacctgctggatgcggcgctgggcttcgcacgtgcgctcggtgcgagcctcgagcgagacgtgcgcacggggagtggtctcgtcgcacgatctggcgacgatcgcgcgacgcttggcgcacgggcacagttgctggccggcgaagggagcctgtccgacacgaaggcggcctcgacgatggccaccaggctcgccgaggtctacctgaccacggctctgaccgaggaggcagcggccgccgctgagcgcaggctcgccgagatcgcgcccgagatcggtcagatcgacggcgagctcgctcgagcgatcgcgcacgcgcagtccgaattggaggtcgaacagcagctctcggcgacgacgcacaccctgaccgatcgtctcacgaaggtcgccgtcaaggcgatcggtcagaagcagcaccgtgcggtgcgcgatgcgatcgcggccgatggccttcgtggcgcgacggacgtgctcgagcggacggtcatggcggagtccggcccgaaggccaccttgagccagacgtcgaagtcggtcatcgccaaggcactcggttcgtcgctcagtgcggacgcgctcgaggtcgtcgacgaggcctatcagtcgctgcgtgcagcggtcgcgacggcggttgcggcggagatcacctcacggatcgagggtggatggttctcgcggggatcgaagcgagcttccgtgctcgaggcacgagccgaggccgcccggctcgccgacacgctggcgttcgccttggagcgggaccttcggaccggcaccggcgtcgccggcacctatcgcgcgaccggagacgcagccacggatcgggtgggttcggcgacccacacccgataccgggctggtctgctctcgaaggagcgcagcaaggcacccgagacactcgtgtcgcagcttgccaaggcctatgggcatctgtcgctctcgcgtgcggccacgacggcggtgacgtcacacctcgacgagatcgatccgtcgcttcccgaggcacggctccggctcgtgcgcgcggtcgacggtatcgccgatcgggatcaggcgcgcgccgtggtcgccaagcagctcgcgtcgctcacgagccgctccagcgcgaacgccgtcaaggccatcacctcctcgtcgaacaagccgcttcgcgacgcactgaaggatgagagcgcgaagggcgccgtcggcgagctcgaggctgtgcagcgtcaggagtcgggtccgagcgctcgccaaagctccttgaccgatcaggtcctcgcccagaccgtcacgttgccgtcgctcacgccgttcatgtcgctcgtcggggcgatcatcgatcgatcggtgcagcacaacggggacgagatcacccttgatcacagcgtgcgcatcccggtgtcgcacggcgcattcgtcgggctccgagccgtgggcaaggcgtcgcgtgaccacgacgcgacacgtgcgggcatgaccttcagcttcacgggcggatgggacgccgccatcgcccgggcgatggccggtctcggtggctacctgaccatgacctcgaaccgtggtggacacggcgccatggagatggcttcgtacaccctctaccgacgctttcgggagtcgcggttggtgcccgccgatctcacgagcaccctctggggcatggggggcatcacgaagggcgccgacgaagagcaagctgcggcacagtaccgtgaggcagagtcctgggcctcgggcatcgagcagtcgatgacggaggcagatgccgctgagtcgggtctccacgccgaggtgagcggtcgcctcgggcatgcgagcgttgcccaggtcgagggtggattcgctgtcaacaccggtactcgctacaccaagcagacgttggagcgctctggtgcgctcgcagcaccgcttgcaacagcgggctccggccgccagccgttgcgcggcgagcgggtgacgaccttcgaagcgttcgccggagcctcgggtgggggcggcatcggcaccacggaggcgtacctcacctacagcgctcccgacgcgagcctgcacaagccctatcgcttcagcgtccaggcctcggccggggccatgatccccggcatgcccggtcagatcgtggactgggcggtcgagggagcgtccaagctgacgagcgctgcgatgggggcggtcaacaagtgggagcagggcagtaaggggagcgcggcgctcaaaggggcggaagtcaccgccaaggccgggctcgaggtcatcgagttcccggtgctcaagaacgctctcaaggaatcggctggtgtggcagcgatcctcggggcgccgatcgtcgacatcgccgagtcgtcgacgctcgcccaccagcccagcgtcgtcggcgtggccgctgcgcccctcgtcggaaaggccaatcgggagtacgccaaggaggctggctcgctcgcctccacgcggttgatgtccgcatcgaacccgacgagtgggctttccttcaccctctacatcgacttcttgcacccgaaggagcgcagctacttcgcgctggcgcgccagacgtcgacgcaccatgacgcgcacgtggtcgaggcgaaggtcgtcaagcgcacgtcgctcttctacttcgatccgaagtcgggtcgcctcgaggctggcggtgcgcgcctgggaacgacgcgctgatggcgttcgatctgttcgacgtcgttgtcgatgcgtgtcgtgtgcagggcttggacccccagcctgtcggcggctacgaccatgtcgtcgtggccgaggtcgaccggggggatcgccgttggcgcttgttcgccgaggccgatggggcaacccccggcgtcatcgtctactcggtgttgccgtacgccgtcgcgtcgacccatcgagacgaggtggctgggttcgccgtgcgggtgacctacgtgctccgctacggggatctcgaggtcgatctcgacgatggggaggtgcgtgttcgaacgagtgtcctggtcggggctggcccggtcgcactcgatgtcgtggcggaactcatcgagcacaacgtggcgatcgccgagacggtcttcccgctcgtcgagcgtgtcgccgtaggcgagctgagcgccgacgaggcgttcggtgtgcttgcgtcatgatctggggagggtcgacgttcgtcgtcgcattcgccccgactcggacggacgctcgagggacggcgctgctcgagatcgagggtgacctctcggatcagcgaacgggagtgtcgagaggcttcgggccgcctgagggtcggtggctcgcgcgggtgggccgttcggcgcgaggagcgggccgctgcggtgttgcggtgtgtgcacgcaagcggacggtttctgtggggcgttgagacggcaggacgcggtgccgtggttgcctgtctcggtggggctgtcgtaggatcgtcgcgtaccgatgaccatccgagtggaggttggtatgcggagtctctggcgtgttcgccatccggtgcgggcggcgatgccacgctccatccgacgagcacggcgtcgggcgtggcgcctacgtcatcctctgcgtgcgtcgctgtggacgctcgcgagaggtcgccgtccgcgccgacaccgccatcggtgaacaccagtgcgatcgacgggcgtccgtctcgatcctcccacgtggcgtgagctacgatccgctcatggatcgcgcggctcaggcgtcgtgggagacctggtgggtcgagggcgaagcgtgcttcgcagccgttgtggcgacgctcgaggccgatgccctgacagggccatccttgctcccgggatgggatcgtgcgacggtcatcgcgcacgtcgcaacgaacgccgacgcgctcagcaacctgctccgctgggctgcaacgggagttccgaccccgatgtacccctcaccggaggcgcgtcgtcgagcgatcgccgagacggcgagcctccctcgcgaccagctcgtcgcgcgagcggagagcgcgcgaggcgagctcgccgcacgcatgcacgatctcgctccagaggcatgggatcgcccggtcgagacccgtgacggacgcgcgatcgtggcgagagaggtggtgtggatgcgttgtcgcgaggtgtgggtgcacgccgtggacctcgcggcgggcgttgggttcgagtcgatgcctccagccctcctcgtcgcgctcgcggacgacatcgtggccatgtgggcgaggcggagcgtcatggcgccgtgtcggctggtcgccggtgagcacgcctggggcgtcgaaccgccggtcgtggaggtcgatctcgcgaccgcggtggccgttctgagcgggcgtaccccgctcgagacgctcggccctgcggtggcagggctcggtatgcctgcgtggatctgaggttgtcgtgcgcaggtgctgtcgggtcggtgtcggcgccggcgcggatgtggcaacgacctgtcgggcgacggtgacggccacgtgcagcacggcccgctgcccgacgaacgctccgcgcgaccgacgttaccactgggtcgggactcctcagagcgcatcttgttcggggatcgttgtcccatgttggccggcgcgtctcgcacacggccgtgaccgagggcgagggcgaccacactgggacgatgaccaacgtcgagaacgtccctgaagttcgtgtcgtgagtgccgctcgagaggtgcacgcgacaccggcgaccatcttcgagctgatcgccgacccgtcccgtcatgcgtcgtgggacgggaacgagaacgtggcctccgcgagcgaacaccagcgtgtgacccgtgccggcgatgtgttccgcgcgaccctcacgaccggcgctgtccgggagaaccacgtcgtggagttcgaggagggtcggcgcatcgcgtggcagccggctgagcccggcaaggagccgcccgggcacctgtggcgctgggagctcgagcccctcgacgcggagcgaacgctggttcgccacacgtacgactggacggccctcaacgatccgaatcggttcgctcgggcccgagccacgacctccgagcggctcatggcatcggtcgagcggctgtgcgcactcgcagagcgcgaggcctcggatcctgcctgagcgtgcgcacgccgttgagcgtgtgttcgatggggcgaacgttcgctcgtggatcaaggccgatgcctcagacgtcgatcgggtgatctcgaaggcctggcagagccggcggtgggattcgaacccacgacctgacgattacaagtcgcctgcgctaccactgcgccacgccggcgggcgcctgcaggttagcttgcctccaccgaacgtcgggttcaccgcagcgccgctcgccgtacggttcagcgagcgtcgtgggcgaggccacggtcctcggggccctcgcgatcgcggggccgagtgctgaccgcgaggaggtgggcgatggtcgttgccgcggcgaccatgcgatcggtctcgcgcatgatgacgcggttgcgctcgctgacgtgaggtgcgctggactcggatgcgaggagcgcggtcgccagctcgatctgggtcgtgcgggcgcgagcgacgtcgacggcgaaccgatctccgcgggccgccgccgcacagctttggaggaggtccgcgaggtcgttgccgaggcgtccgaggggcacgcttggagccggtgtcgtgcgttcgaggtcgaggagtcggtccagcacgagggcgctccagacatagcgccgcacggcggcgaggacgccgaggacccgctcgtcgtcgttgacggggtcggagcccgaatgtcgtggctcgtcgagccagcggctgaccgaggcctctgcccgctggcgcgccagccgtgctcgtcgacgcgcatcggtgaccgcgacccgagcagtcggggtgcctgactcccacgcgctgccgagtagcgctgcgtgctgcgcatccgcctccaggagggtggcgagccgctcgccgactcggcctcgttcccagctcggccacgcgatcaccgccatcaccgcgaggagactgccgagcaccgtgtagacgctgcggtcgatcgcgaggccgagcgcaggcgctcccgtgaaggcgagcagaacgacgacgagcgatgacaccgcgaagctgaagagcaggtagttcgcgcgctgggtcgcgatggcaaggccggcgagtgcgacactcgccgcggccagcgtgacggtggatggatgtgtgagcgcgagcagtgcagtcacgagcccgacgcctatgaccgtgcccatgctgcgcgcgaacgcacgacggagcgtcgtcgtgaagtctggtcgaagcacgaagatgaccgtcagtgggagccagtagcggtgggccaccggaagcgaggccgcgagcgctactgctactacgagtgtcgccgcgacacgtgcgccatggtgaccgacctcggacgagggtgccagggaccgtcgaagcgtcgccatggcgtcgtggagcgatgcgcggagctcaccctcgacgcggagattcgtgccgtcggcacggcgcatcggtgccgctcgccccaggaccactgcgccgagatggtcgaggctgcgcaggctcgcggcgaggttctcgatggcgaccgtcgcctcgcgagccccctcgccgagagctccgtgatcgtctcctgcacgctcgagcgtccagagggcgacgccgagtatccgcgcgatcgtcggcggcggctcatggtggcgctgggtcatgagccgacgtgcgagcacgtcgagcccgtcggcgagcgccgtgagcgccgtgtcgatcgcgtcggcgacgatgcgtgcgtccgggacgtcatcgtccagcgccacctgaacatgggttcgggccgtggcgatcgcggctgcctcgaggcggatgcgctctgcctcgtcggcgatggagcgtagagcgtcgaggatcgctgggtcgctaaagggctgcggttcgcgaagagcctgtcggagcgtctccgatccctctaggtcgagcacgctcggaggcgcagaaccgatcgcacgaagggtcgaggcgcgctctgcgagaagcgtcgcggcggcggtccgctccatcggtgacctgacgaagggaagggcgaagccgacgaggagcagctcgccgagcccaccggcgagcgtccaccaccctgcgacgagcgctgggccgagcgccaggtgttgatccgcgaacagtacgacgccaagcacggcctcgaggccgatgacgccagccgcagggccgagcgcgacggcccaaccggcggccaggccccagatcgcgaggatggccatctcggctacgaggacgtggccgagggtcgcccccacggtggccgaggcggcgaagacgatcgccccgaccaccatggtcacgatgcgagatcggtaggcaccttcgagcgagctcatgccggcgatgatggctccgatcgctgcctcgatggcgcccccgagatggtggctcagcgcgccggccgtgatagcgaccgcgacggcgagggctactcgagcgccagcggcgactcgcaggccgcgccgatcgaatcggtggagatcgagagccgggcgcgaggccgctagcgccgtcaccgtagccccggccccagtgctccggtgctggcctcaagacgcaggagccacgtcttgcgttcgtcgccgccggcgtagtgaccgggcgcaccgtctgcgcggatcacacgatgacagggaatcacgagcgggagcggattgcgggcacacgcagtgcccacagcgcgcgcggctcggggccgaccgatggcggctgcgatggcgccgtagctcgcggtggtgccgtagggaatgcgcacgagcgcggtgcgtaccgccgcgtcgatgccgcgtgctggtgcgagatcgatggggacgtcgatgtcacggcggcgcccacggaggtatgcatcgagcgcgcgctcgacgacgacggcgagcgccgcacgtcgcggcgagagtccgggcgtcggctcgaccgcgtcggcgtcgaacgtgatgcgcgcgagcccacgatcgctgaggccgatcgccacggttccgaggggtgtctcgacgagtgaccacgacacgtcgtgtccgttggctctgccgtcgtcaccgaggtccgctcgcacgtggcgtgccgtgacgtcgtgaccagcccctcggggtccccgatcgtcgtgcgggctgatcgctgtggcatcgatgccatgtggtgccagcgcgctgctcaccgcagtgcctcctcgtgttccaacagagaacccgatgcgcggcgcaagcgctgcggctcgggacgccccgtgcggtcacggtgcggccaccaggcggcgctggctagcgaccactggggagagtctactcgcctcgcaggtgctggtgccgggccgcgcccgactccgtccccctggtcgagatctcgctcgcaccagctagggtggttccgatgccgtgagcgttgggctcgcggacgctggcgcctcgtgacgccaggcgggccaacgagatcagttctcggccggtgtgatgcactggccgtggtgtcaagtcggccgttctttctcgagccgacaggagacattacgttcatgcatgctgacctcacgacgcccacctccaagcccgttgctggctcgtcgttcgccgacctcggcgtcccggaaccgctcgtggcggtggcgacggcccaggggctgctcgagccgactcccattcaacgcgctgcgcttccggacgccctcgctgggcgtgatgtgcttggctcggcgccgacgggaaccggcaagacgctcgccttcggtcttgcggtgctcgcacgtgtcagcgcgagcgcacgcgcgaagcatccgagggcactcattctcgcgcccacccgggagctcgcgatgcagatcgcggacgcactcgatgccttcgcacgtgcagagcgccgctcggtcgcggtcttctatggtggggttggctacgggcgccagctccagcagctgcgccgcggcgtcgacgtcgtcgtcgcgacgcctggtcgcttggctgatctccgcgagcgtggcgacgtcgacctcagccacgtcgaggtcgtcgtcgtcgacgaggcagatcgcatggccgacatgggcttcttgcccgaggtgcgtcgtctcgtgcaggcgacgtcgagcgaacgtcagacgatgctcttctcggcgaccttcgagggtccggtcgagacgctggtgcgcgagctgtgccacgacccggtccgccacgtcgtgacgcgaccggacgacgagcagggtgaggtgggtcaccacttctggaacgtcgatccgagcgagcgtctccaggtcacggccgccgccgtgcgagctgcgggaccggcggtcgtgttctgccggacccgtcgaggcgcggatcggatcgcggagcggctccgcggcgagggccttgcgacggccgcgatccacggcgatctcaatcagcgtcaacgcgaacgcgccctcgagggctttcgtgctgggcgcatcgatgcgctggtcgccaccgacgtggcggcacgcggcatccacgtcgatgacgtgccgctcgtgatccacttcgatccaccagagcggacgaccgactacgtccaccgttcgggccgtactggtcgagcgggtcggcgtggctcggtggtctcgttggtcggaccacgtgagcgctccttcgtccgatcgctccaacgcgaactcgggttgccgcacggtcttggagcaccggacgcggctctccttcctggctcaggtcgcgtcgagcatgtcgggggccgccgtcccgccgtcgggcgcgaggtcgaagagtctcgtgcggcgagcgaggggcggggtgtgccacgtcagcgcgatccgagagcccgccgtggctctatcggctcgcgtcagggtggcgccgttcggagcgacgcgcgtagcgcgcgtgcggacgcaccgagaggcggggctgcttcgcctcgtcggcctcgtcgtccggagcgctaggcgcgaggcgtctggtcgctgctcggcgcgctcgagcgtgcgtgtgttcgccaggcgccgagcagcgccagtcgacgtcgctgctgggaggcggcggcgcgatcgaggccgtggtcgcgctcgatgagagccgcgctcaccgcatcacggagctcgaccggcttctgatcgtcgtacttgaacttggcgctgacctcgacgatctcgagctcgagcgctcggatcgcgccgagcatggtgccatagggcggctcgccggggacgacggcagcgtgacgaccctcgggctggagatcgccgagctggcgctcgaggatcgccgcctttgcctcggggtcgtcgacgatgcgtggtcgacagacgaactgaacggcgctgtagtagctcgtcggcacgccgtctgccggggccgtcgcatctggcgcgcgccaatagcccggaatgaacgcgtagtcgccgtggaacgcgacgcgcacgcgcgtggctcgctcgaggtgtggccatacgggattggtgcgcgcgagatgagcaacgagcacggtgtcgacgagggagaggtggagcggcaggacgaggggagcctcgtcggggtcgaggttggcgacggcgaggacgccgaacggctcgtgctcggcgagccaacgacgccactcgtcctcgctggtggctgcgtcccacgggtgaatcagcatggcaggtcccttgcgtgtgtcgcgacggctctcggtgcgccacagcgcacctgcgcagcgtaacacgatcgccacgcggacccacacggtgccgtcgagcgcgccctagccttcgcgctgcgcacgagcgcttgtgcggactcgtaggtgacgacggcgcacgagtctcgtccgaggcatgggtcgtgaggggatgatggcggagtggctcgaggaccatctggcgatcctgttcgtggtcgcggtcgggatcggcgtcggcgttgggcggcttggcgggggaggtgccgtcgcgatcgggccgacgctcgcactgctcgtcgcagcgagcgccgtgaccgtgggcgctggcagtggcgtgcggtcaggttcgcgttggcgactggtgctcgtcgtcgtcgttgcccaggcggggatcgtcgtcgtcaccgagctcgtcgccgcgatcgagtccggcccgcttcgcgatgcggtgctgtgcctcggggtcgcgcccagcgaaatcgcaacgatcggtctggcggcgttggtggggcgggaggcagcccgcgctgcggcggtgctcgtggcgggctcggcgatcctgagcgtcgtggttgcgggccccgtgctcgggctcctcgcagtctcggggcatgtcgcgtcgaacggcgtcctcgtcgctctggcgctcgaggtggccctgccgggagcgatcgggatgggggtcgcgcgtctcgtccgacgtccttgggttcgcggcactgggcgtctcgtgagcccactcgcgctcctcgccctcggcgtcgaagtggggacgttggcgccgatcgccatcgctgacgtggctgcgatcggaagcttcgcgctcgtcatcgttgggagtgcggcggttgcgctcgcgatggcgatgctggttgggacgactgcacgtgccggtgtggtgctggcggtaggggtgcgggacttcgcggtcgcctcgggcatcgccgaggcggcgatcggggcgcacgcagcaggcgtgcttgcgctctacggactgctcggcgttggcgtcgcggccggtgccgagcgctggtggcgctcgagaggagcgcgctcctagcggctcccgagcaccatcgccgtcggcgaggcggcgtgcgcccgccgcctcggtggtctagcgtgaggcgcggaggcgatgggcgtgggagcgacggtgcgcatcgagcgagcgggtgccgtgtggacggtcctcatcgatcggcccgcggtgcgcaacgccgtcgatcggccgaccgccgaggcactggccgatgcgttccgagccttcgacgccgatgacgaggccgctgtcgcggtgctgagcgggaccggcggttcgttctgtgccggtgccgatctcggggccttcgggaccgagcgcgagaatcgtctcgacccgaccggtgacggtccgatgggcccgacccgtatggtcctctcgaagccggtcatcgccgccatcgagggctgggcggtcgccgggggtctcgagctcgccctctggtgtgacctacgggtcgcggccgaggacgccgtgctcggggtcttcagccgtcgctttggcgttcccctcatcgacggcgggaccgtacgcttaccgcggctcatcggtcgatcgcgggctctcgacctgatcttgacgggtcgggcggtcgacgcgaccgaggcgctcgcgatgggactcgtcaatcgcgtcgtcggtcgaggggccgcgctggatgcggcgacggagctggcgaggcagctcgctgggtttccgcaggcgtgcttgcgcagcgatcgcgcggcactgtatgcggccgagggacagtccgaagccgacgcgcttcgcacggagttcgtcgcaggtcagcgtccgctcgaggcagaggcgagagccggtgctgggcggtttcgccgtggggcgggacggcacggacggccactggatcaatgaccagggacgtggctgcgttgacgatggcgggccgcgcccagatcagggacgatcacgaccgcacccgtgcagtggtgcgcgacgcgggcgctcacggacccgatgagtgcatcggcgaaggggcggtgtccgtgcgcgccgacgacgaggagctgggcgtcgcgggcttcgacgcagagctgctcagcggggtctccctctcgaaggaccgactcgacggcgacggtgggatggtcctcgtcgatgtcggcgagcacgtcgtcgagcacacgtcgagccgcgcttgccaatgccgtgtcgtcggcgatcggtccgagatcgcccgctccagcgagttcgtagtcgtagggcgagcgccagacatgcacgacgcgcaccgtcgcgctgcgcagggcggcctcggcgagcgcccaacggagcgcgagtcggcttggttgggagccgtcgacgccgacgacgatcagttcggccatcagatcatgtcctccttccggtcgtggcctcggtagcgcccgctggagcgagggccgccgatggctccgctctcgacggtgcgctccgtacctgtctgagcagaggcgccttgatcgtgtcgagtgcgagtgtgagcaccccgacggcaccgatgaggccgacgacgtctgggaacggtacgggggccatgaggatgcccgtggtcgcaaggaccgccacgatcacgagatcggcaagggacgtgagggcgagccaccaactcgggggcgaggtccacagatggccgggttcacgcacgaggtagaccgtcgcctgaccggttgcgacgagcatgacgaacgcgagcgtctgcgtggatgccagcgacagcccgagcacgtcgcgtccgatcgcgacggtggcgaaggccacgaggagccacggcacagcgatgacgagggcggccagggcgagctggttcactcgccaacggtccggggagggggagtagctgacacggtcggtggcgagcgacatggtgacgacgtcgttggcgaacagcaggaggaggacgagtcggggcgtcgtcacgaaggtgttcatgacgaggagcccgagaccgagaaacagcgagacctggaaggtcttcgcgatcttgttgagtgtgtacgtgagcatgcgctggtagacacgacgcccggtctcgacggccgcgacgatgccgccgaggcccgggctcgtcagcacgaggctcgccgcactcttggcgacgtccgtcgcgttcgagaccgcgataccgacctccgcacgcttgagcgcgggggcgtcgttcacgccgtcgccggtcatcccgaccacatggccgcgtcgctgtgcccgctcgacgaggaggagcttgtcctcgggaaggacgctcgccatgacgtcgacgtcgatcgggccgtcgcttcgtcgccgaaggtcgtcgaggtcaccgaggcgctcgccgatgccgacctcccgagcgaccgcgagtgccgtctgtggtgtgtcgcccgtcaccatgatgacccgaacgccgagctcgtgcaggtggctgacgagcgcgccggagtcggggcgagcaggatcgccgagggcgatgaggccgacgagctcgagggtcgtcgtgcctcgcgcgaccgcgaggacccgcgcgccgcccgaggccagcgccgcgacggcgtcgtcgaggccggggggtgggttctcacagaggctggcgacggtcgctggcgcgcccttgacgatgcgcgtctcggtgtcggccgcgtcgcgccagagcgcctcggagcgcttggtcgcaggatcgaacggcgtgaactgcacgcgctcacctggtccggctggcgacagtgtgcgagcgagcaccgcgaggtcgatcgggtcttgggtggctgcgtcggaggcggctgcggcgaggccgagcacgtcgtcgcgggaagtgtcgccgaaaggggtgaccgccgtgaccgtgaggacgttctgcgtgatggtgccggtcttgtcgctgcagagcagatccatcgccgcggcctcttcgatcgcactcaggtgcgtcgcgagcacgccctcgcgcgcgagcgccatcgccccgacggaactcgccagcgtgaaggtcgccggcagggcgaccggaaccgccgcgacgagcaggatcaagacgaacgggacgagggttgcggggtcgagatggcgaacgagaccgtcgacgacgatcgcgaccacgagcagagcgtccaaggcgagcagggcccgcacgatacgcaggatcgtctgctcgaggtggctctgggtcgtcgccgtccgcaccagttgtgcggtgtgaccgaagtaggtgcgctcgccggtcgcgctcacgacggcggtcgcctcgccgcgcacgacgaccgaaccggagtagcacgtccccgagccatccaggttgaccggtcgcgattcgccggtgaggacggatgcgtcgagcgagatgcgtccgtcgacgacgtcgaggtcggcggggacgatgtcgccgacgcggacgtggacgacgtcgccagggacgaggtcggcggcgtcgacggtgcgccaggtgccgtcacgccgcacgcgagcctgtacggcgagtcgttggcgcagcagtgcgagcgcgccgtcggccctgccctcttggacgaagctcagggcgccgttgaagacgatcaggagggcgatgatgatcgcttcggtgaggtggtgatcgagcagctcgagcacgaccgcagcctcgaggaggtaggcgatcgggccggtgagcttggacagcaagcgccgcaggacgtgtggccgttcgggtgcgacggcgttggggccgatggcggcgagtcgagacgcggcttcgcgctcggtgaggcctgcgggctcgggcgccgaggggctggtcgcagactggaagggatccgatgtcgtcggttccgtgtccgccatcgggcctcgctcagcgatcggtcgcagattgcgggaggtccgtggtgtccggcacgatgacgatggggaccggtgcgtggtgggcgcacgtcgtcgcgatcgacccgaggaggagtgccgcgagcgagtgggtgcctcggcgccccacgacgagcaggtctgcatcctcggcgtggtggcacagctcgcgtcgcgggtcgccgcctacgaccacggcttcgacctcgaccgaaggcgcgacggaggcggtctcgtcgatgaccgcctcgaggcgctcgcgcaccgcgcggagcgcgacctcgtggtcgacttggaacctcggggcctggagctcgaaggtgagatctccttcgtaggggtcggaccagaccgagagcgccgtaacggaccaccctcggcggcgagcgtcatccttggcccaggcgagtgctcggcgcgatccgtcggacccgtcgatgccgaccaggatgcggccggaccgcggaggcgcgtcgcctgcgtggccgggccgtgtgatgagcagcggggacgccgcgtggcgggcgcaggccgaactcaccgagccgaggagcaggcgctcgaagccgccccgcccacgtgatccgacgacgaggagcgacgctccgatgctgcgatcgcagaggacgtggtcggggccgccttctgagacgaccgggtcgaccgtgagcccaggcgggaccgacgtggcctggagcgcatcagccagcacacgtcgggcggcctcggcgatcccgtcgtcgagtgctgggtcggggacgtcggctccacgtgcggccacgccctgccatgcggtgaccgcctcgaccgtcgcacccctgatggcggcctcgtcgagcgcccatcggagggcgccgagcgatgcgtccgagccatcgacgccgacgacgacgcgctctgccatgacgacctcctttgccaccgtgtccgtgagtgtagggctcgctcgacggctcgaccagggacctttggtcatggggagcctgccgaccggctcatgggcccgtgatcctacggtcgtagcgatcgggcggctcggtcgatgccctccgacgccatggggtgggggaaggccatcgtcgcgagctggtccaccgtgagcccggcgtggatcgcgagcgcgagcggcgcgatgagctgcgctgcgtcgacgccgagcacctgggcgccgagcagggtgccgcggtgcggctctgcgatgagggcgaggaacccttcgcgttcgtcgaggatctgggcgcgcgcatcaccggcgaagtcgtagtgacccaccatgacgtcgccatggcgcgtccgcgcctcgacctccgtcagtccgacgctcgcgacctcgggctcggtgaagacggtcgtgggcaccgcatcgaagtccattgcgtcggtagatcgaccccctgccatgatgcagtgggcgacgaccaggctctggcgtacggctgcgtggaacagtggggtccgtccattcacgtcacctggggcccacacacgtgggtgcgaggttcgaagctgggcatcgaccgtcggcgcgcggtcgggagcaagcccgagcgcgtcgatcccctcggggagctggacgtggcggcccgtggccatgatcacgagatcaccccgggtgacgtggacgtcgccgccgtgctgccagctcacctcgtagtcgctgccgacgcgcgtgatgctccgcacgagcgcgtcgacgtggagctgcacgcgctggccgaggaggctcgcgaggcccgtcgcaagcgccgcgtcgtagcccggcagcaggcctccggttgcttcgaggatcgtcggtgcggcccccaggttcgccagcatggaggcggtctcgacgccgatgtagcccccgccgatgatgacgggtcgcgatgggaacgggagatcggcaccgaggcggaagagctcgtgcgatgtcacggcgagatcagcgcctgcaatggcgaggcgactcggtgcggagccggtcgcgagcacgaggtcgtggaagcggacgagcgtcgtggaaccgtcggcctcctcgatcgcgatccgttcggcatcgtcgatgcgggcggtcgccgtcatgaaccgaatcgtggaggctcgcagttcgtcggtgtgctgctcgtagcgcaagcgctggacacggtccttgtgtgcgagcacccccgaccagtccacgtcgagcgcggtgcccctcaggccaaaggtctcggcgcgcgtcgagcgcgcacggatgaggcttgcctcgcgaacggccttggatggaatgcagccctcagcaaggcagttgcctccgaggttgccgatcggatcgaccagcaccaccgagcggccggcccgatccagcgcgaacgccgcagggtagccaccacctccggctccgacgatgacgacatctgcggttgcttctcgtgccatggtgacctccaccgtcgatgacgaccgtagcgcagccttggcgtcctctcccgtcacgcccgtgggcgtcggcgagcggctggttgcgctcgtcacgagtctggagcgcctcggcgcggcgggggctgcgagggcacagaaagggacagaaaagggaagaaggtcccatattggaatggatccaaggttggaagtgtgctaggttggacgtcatggagaacgacggcgagcgccgtgcgacgcacgcgaccgagcagcttcgcgcggcaggtctgcgggtcaccgctgcgcggctcgccgttgtgcgggtcttggagcgccacccgcacgccgatgccgagtcgatcatcgccgaggtgcgaggcgaactcgggaccgtgtcgcaccagacggtctacggcgtcctccaggcgctcgtcgaggcaggactcgcccgccgcatcgagccggcagggagtccgggccgctacgagctgcgcgtcggcgacaatcatcaccacatcgtgtgccgaagctgcggtgcgacggtggacgtcgactgcgtggtcggcgagcggccctgcctcacgccctccgagacgcacggctacctcctcgacgaggcggaggtcacgttctgggggctgtgtccggcatgtcgcgatggcgagcgcgcaaggcactccgagagggtcgatgcggacatcgacactggcatccgtggaggtacgcaatggatgagatgacagacgcccagggctgtccggtgctgcacaccgtcgagctcgcgaatgcggccaagcagtggtggccgaatcaggtcaacctcaaggttctcgatggacctgctccgaatcgatcgccctatggtccgagcttcgagtaccgtgcggcactcgcatcgctcgacgtggaggcgctccggcgggacctcatcgagctcatgacgacgtcccagccgtggtggccggctgactttggccactacgggccgctgttcatccgcatggcgtggcactcggccggtacctatcgcatcgccgacggacgcggtggggcgagccgcggggcgcagcgttttgccccggtggggtcctggcccgacaacgccaacctcgacaaggcgcggcggttgctctggcctatcaagcagcgctacgggcgtgcgctgtcctgggccgatctcatcgtcttcgcgggcaacgtggcgctcgaggcgatgggtcttcggacgatcggcttcgccttcgggcgtgaggacgccttcgaaccaccgctcgacacgtactgggggcccgaacggacctggctgggcgacgagcgccatgacgaggagggcgagctcgagaacccgttcggtgcggtgcagatgggtctcatctacgtcaacccggagggtccgagcggtcaccccgatcctttggctgccgcgcgcgacatccgcgagacgtttcggcgcatggcgatgaacgacgccgagaccgtggcgctcatcgtgggcgggcacaccttcggcaagttccacggtgcggcaccggcgagcttcgtcggccccgagccggacggtgctcccctcgagcagcagggcctcgggtggcgcaacacctacggcacgggtatggggaacgacacctacacgggtggcccggagggcatctggaccccgacgccgacgcagtgggacaacacgttcctcgagcagctcttcgcctacgactgggaactggagcggagcccagccggcgcgtaccagtggaccccacgcaaccccgaagcgcaaggaacggtgcccgacgcgcacgatccgacggttcgtcacgcaccgaccatgctcacgacggatctcgctcttcgcgaggatcccatctatcgcgagatcgccctgcgcttccgcgaccatcccgacgagctggccgacgcgttcgcacgtgcctggttcaagctcatccatcgagatctcggtccggtgagccgctatcagggtcctctggtcccgagcgagacgttcgtgtggcaggatccggtgccaccggtgacccatggcctcgtgggcgaggcggagatcgcagagctcaaggatctcatccgcgccagtgggctcacgactgctgagctggtacgcaccgcctgggcctccgcctcgacgtttcggacaaccgatcggcgtggtggagcgaatggtgcccggatacgcctgttgccacagcgaacctgggcggtcaacgatccggccgagctcgctcgcgtgctcgcggtcctcgaggccatcaaggttggcttcgacgagcgccatgggcctgcggtcggtgtctcgctcgccgatctgatcgtcctcggcggcgtgacggccgtggaggacgctgctcgtgcggccggcgtcgaggtgtcggtgccgttcacgcccggccggaccgatgcgaccgaagccgacaccgacgcagagagcttcgcggtcctcgagccacgggccgacggctttcgcaactgggcccgaccgggagagaaggtgccgctcgagcatctgctcgtcgagcgggcgtgccgcatggggctgaacgccccacagatggtggtgctcgtgctcggcatgcgtgcgctgggcgcgaacgctggcggctcccctcacggtgtcctgacggagcgtccaggcgtcctcagcaccgacgtcgtgcgcaacctgctcgacatgggcatcgagtggcgtccggcgaccggcgaggatcagacctacgtcggtgtcgatcgtgtctcgggtgctcccagatggacggcaagcgccgtcgacctcgtcctcggcgccaatgccgagcttcgggccatctgcgaggcctacgcgagtgacgacggtcaggcgatgttcgtgcgcgacttcgtcgaggcgtgggacgccgtcatgatggcagaccggttcgacgtgcgctgaggtcgcgtccatacgagcgcgtcggcgggaggggtgaatgcccctcccgccacgaccatcggcaccggccggacggcgaaggatccaggccgcggccaggcttgccggcgtgcgcgggctgccgagctcaggtgtcagccgtccaggccgaggacgaacgtcggcttcggtgacgtgtcggggaggcggtgctcgtcagcgagccgacgtacggcggtcccgaccgcgaggaactcggtcgcatgttcaccccagacgtggttcgcgacctcgacggagaccccgacgatcccgttggcaccagctcgggtggcctctgcctgcatcctggtcagcgcaagttcgcgtgcctggtagatggcctcggtgaaggtgaccatctcctgattccacatcgactgacggagcgagccgaacacgctctggtgggcgacgtggtacacgcaggtgccgaggacgaacgcgaccgggacgatccctgtcgcgaggagccggtagaagtcctgggcggacaggtctgacgtgaagggcccgccgtcgggagcacggtgcgcgcctgcgcccgacagagaccgcaccgcggtgccggtggcgatgaactcgagcacatcttgtccccagacgtacatctgcatcgtgaggttgacgcccacgatgccatcagcaccaagctggtcagcctcggtgcgcatccgggtcatggcgagttcacgagcctcgtacatcgcctgggtcagaacctggagttcctggctctgtccccagcgtgcgacctgcaggccgacgtggtagatcgacgagccgacgacgaacccgaggggctcgaatccagcctcctccaggaggacgtattcggagaccgacaaatcggacgtgaagacgccgtgtggatcgcgtccgagggtgtgggcgagacgctcctcagcggcgcgtggttcgtaggcacccgaggcggcaggtgctgttcccggttgcgcgtttgacgggtcggggcggaacaagggcatggtggcctcctcgaagagcgacacgctgacgctatcacctggggcgcatcggcgctgagcgcctacgctggcagtggtgacacgtgcgcagatggcgggcggtcgtggtgagcgccgcggtttcgccgacgcgcgtgctgcgcttcgtgtgaggcgcttcagtgcatggtgggtggcccagctgctctcgggcatcggatcctgggctcaggcggtggccattccgtggtacgtcctcgagcgcaccggatcggcctcggccgtcggtatcgtcacgaccctgcaattcctgccggtgctcgtgctgagcctctttggcggggcgatcgccgaccgtgtgtcacgacgtggcctcttgctcgtcacgcagctgctcttggccttctgggcagcgatgctcggcttccttgtcgcgagccatgaggccccgatttgggtcgtcgacatccttgcgctcgccatcggggcgacgaacgcgatcaacaacccgacccagcaggcattcctgccggagctcgtaccgcgtgagctgcttgctccggccatcgcgttgaacagcgtgcagttcaacgcagcacgcatgatcggaggtgcggttggcggcgcgctcatcgccgcactgggagtcgccgcggcgctgtgggtgaacgccgtcagttttctgccggtcgtggccgtcttgatcctcatcgcctcccacagcgctcgggccgttcggcgcgagcgacccgccggcagcatgctgagcgagctcggttcgggacttcggttcgtgattggggcggcgccggttcgcagcgtggtcctcgtcttcggcttcgtcggcttgttcgggttcaactggcaggtcgccgtacccctggttgctcgctttgcactgcacgagcatgcgaacgggctcgggttgctcatgggagcgctcggcgcgggagccctcgtcgcgtcgttgctggcatcagcgttgggacaggcgacgcagcggcggctcgtcgttgcggggactgctctcggactctcgctgatcggtctcggcctcgcgcgctcgatgctggttgcagggttgctgctcgtcgcgggtggcttctttggcgtgctcgcttcggtgagcgccaacacgaggctgcagatgctcgctccgccgacgctgcgtgggcgagtcatggcgatctatgtgctgctcatgggcggtacgacaccggtgggcgccttcgtgctcggcgagcttgcgagctggctggggtccgcgtgggcggtgctcgtcttcggggtcgcaaccgcggccggcgtcgtcgctgcgagcctgtggggacgacaacgttcgggatcgagcggccagcgtgctgcgacggcccccatcgactagataatcgtgccgtaggaggcccaactcgaagcgacgctgctccgggcgtgccgtcatggtcgggttggttcgaactccgatgatccttcgtgcggggctcgtaccggttcggtgattcggtctcgtccgtgctagccggccggattcacgattgccgacagtccctgcgaggtgaattggccgtaggtctgcacgatgacgcccacggcggggtcgacggctgactcgacgagcccgtcgccgaggtagatgccgacgtgtccagggtcggccagggttccgtcgctaccagggacgagcaccaggtcaccaggggcgatctcgctcggggggacttgtacaccttcgttcatctgcgacacggtgtagtggtcgagtgccactccggcctgggcccaggcctccatcgtgagcccggagcagtcgaacacattgggtccggcaccgccccagacgtaggcgtctcccagcttcgagagggcgtagttcagcaccacctgctcttggggggtggtgcccgaagggatcgtatagccggccggaagcccatactcaccggcgggcaggttgccaccaagcccccctgtggctggaggcgcggccgcctgctgtgccgcctgctgtgccgcctgttgggcggctgcttgctgtgccgcctgctcagctgctgcttgctgggccgcctgctcagctgctgcttgctgtgccgcctgttgggcggctgcttgctcggcggcggcgcgcgcggctgcagcttgctgtgccgcctgcgcagctgctgcttgctgggccgcagcctgttgggcttcttgctgggcgacgagcgtttgaatctgggagttcacgcccgcgagctcgttggctgctgcttgctcagcgttcttggcggtggtctgctgggaggcgagctgggccaccagcgtgcgttgccgttgttgctgggcagcgagcgttgcctgctcttgctggagttgctgcttggcagcgacgtaggcgctgagtgcctgctcctggatggacgaagcgacgttgacatccgtctggacgagtgctgactgattcgggttcgccgagaggaccgacacgacggtcgagccagtgcctccgcgtgagaagatcgtgatcgcctcgtcgacgacctccgcatgcagctggtgcagccgcgtgagttggtgggcaatggcctggcggaccgtgctctcctcgcgcaccgtggctgcaaggcccgcttgcgcagccgtcatctgggacgtggcttggttgtactcgctctcgagtgcattgagcttctgagcgatggccgcggcttgggcgcgcatcgacgacaccgagtcgacgagacgtggaggtgggctgtcgacgtaggagaggccgatcaggccgacgagcgcaagtgttgcgacgaggtggcctggtcgggggcgacaggcgcgccagcgcgtcactgcgctcgtgcgggcggcctcgcgctgtcttgctccccaaggagcgtggagaccacctgatcgctgccgatgcgcgtccgtggcgccaacctcctcgtgacccgtcgcgtgttcttggtccttggatcggcacgcagcctatcactcctgaagggtgtcggagggtcgcgctagatctcgcctcggcggacgggctccgcggcgcccgccgtccgatgccagatggcgacttgctctcggcgcgtggagcctcgcgacatcgctcggagcgttgggtccggggatgtccaaccatacgaggagccacccatgcctgctgcgctcgatcgatcccgtctgctcgaggagctcaccgatggcgttctcgcgctcacgcagtcggagccctggcggcgctacctcgacgtgcagcgccgcttccatcgctacagtccacagaacgtcctgctcatcgaccgtcagcggccatcggcgacgctggtcgctggctttcgtcagtggcagcgccttggccggagcgttcgtcgtggtgagcacggaatctggatcgtcgccccgatgcgagtgcgacggacgacctcggacgatctcgacgaggaggtgctggctggctttcggtgggtctgcgtcttcgacgtggcgcagaccgaaggcgctgcgcttcccgaggtagcgacccgcctcgtcggagaggatccggctggggtcctcgccaagctcggcggcgtcgctcacgcactcggctttgccgtcgaggatcaccgcttcgagggggcgaccaacggcgactgttcgcacgagcagcgacgcatccgcctctccagcgaggtctcgccgcgccagcgcgtcaagacgctggcccacgagctcgcgcacgcgctcatgcacgagcgactcgagtcgcgtccgcaggcggagctcgaagccgagtcggtggcctacatcgtgtgtcgtgcgctcgggatcgacgcctcgaacttttcgttcgggtacgtcgcgagctgggctggaggaggcgcggcggctgtgcgtggcatcaaggcctcgtgtgtacgcatccagcgagcgtccgcgcagatcctcgagctcgctggcttcggcgtcccctcgggagcgggctcctagtcggtgcgtgagaactgccagatggctacgccgagcagactcaccgcagcgagtgcgacgagacccacctcgagcagggtcgggaggcgatagctaccccaggtgatcccagccccgaggatgcgagcgaggggtgccggtaccgacacgtactcgaagaccgcacggcgaagcggatcgaccgcgtacgacagcggatcgaaccgcgtgagcaccttcagccacgtcggcaagtcgcccgtggggaacaccgcccccgacaggaagaacatgggcagcacgatgaactgcgtcaccatctggaagctctccacctgagcgatccggctggcgacgaggacgccgaaggacgtcagcgcgaacgccgtcaggcccatctcaccaagcatcgtcaggaggaggagtggacgatagggcaccccgaccgcgccagcgagcaccaacatgatcgcgccctggatcgtcgcaacggtggccccgccgagtgccttgcccagcacgagcgaccatcgactgaccggtgcgaccagcatctcacgcaggaagccaaactcgcggtcccagacgatcgagatcgccgagaagatggaggtgaacaggatcgtcatcgcgatgacgccggggaacatgaacgtacggaagttgaagtgcgcggagctgacgacgatgccggagagtccggttccgagcacgaagaggaagagcaccggctgcacgagtgaggtgatgatgcgcaagcgattgcgcgcgaagcgaatcagttcacgcttccacacgatgcgcaccgctcgaagtgggcttccccccatttgcttgacagtctgaatttaggccacggccacctcccggcaggcccaggagagctcgtactcgacgggcggtaggtacccgaggcttgagtgcaggcggaccgtgttgtaacggtgaatccagctagcgatggcagagcgagcccctgagaggttcgcgaagcggtagcgagccaccagctcgcgcttcaagctcccgaagaaggactcggccacggcgttgtcgtagcaggtcgcgaccctccccaccgactggcgaatgccaagggtcgcgagcaggctccgtaccttccgggagaggtactggctgccgcgatcgctgtgaaagatcgccccagccaggctgccccgagtcccgagtgcttcgcggatcgcctcgaccaccaggtcatcgggcatgtgacgcccaagtgaccagcccacgatgcgcctcgagccaagatctgccaccgtggcgagatagcagaacccctcatcggtgcggacgtaggtgatgtcgctcacatacctgcgcttcggctcaccaggagcgaagtcctgacggacgaggtccgggagcgctgcgtcctctccccgcctcgtcgtgactacgaagcgccggcgtgggcccgctgccatctcgagctcgcgcatcaggcgttccacccgcttgtggttcacgcagaacccgcgccgtcgcagctcgtgggtgatgcgggggctgccgtaggtgccgtcgctctcgtgccagatggcgcgaagctcgctcgcgagcaccaggtgctcgggatcctcgcctcggtcccgacggtgtcgccaggcgtagtaggcctggcgagagaccccgatgactcgtgctgctgccgctacagagaagcccttggcctcctggcgggagatccagtggtagcggctcactgtcccccctccttcacccagaaggccatcgctcgcttgagcagctcgcgttccacggtgagctgcttgacctggcggcgcagccgtgtcagctcctcgcgctcggcgctcgtcaggccctctcgctcacctcggtcgatgcgttcctgacggacccagttaccaagggtctgctcgttgatgccaagctcacgggcgacgtcagcgatggtgcggcgctggtcgagaaccaacgctgccgcgtccttgcggaactggctcgggtagcggccgcgtcgtcgtccagcggggccgtcgcccggtggtgggttcggtgtctggctcatcccttcctcctatagcaggtgtcaacctggaggggggaaggccaaaggtcgtccgacacacgaccttctgcctgggcgtagccctcccgataggcgttgtcgaacacggctgcttcggtggtcatgatcgcatcctcgctcgcatgaagggattggcacggaggccctcgagactcgagcgttcggcgtcgcggatcgtgcgacccgtgtaggtcatgaagacgtcgtccagggtaggtcgtgcaacccggaccgacgtgatggcaacctgcagttcggcgaagagtctcggaacgaactcctccccgttggcgacctggaggaggattccgtcgtcgctgtggcgggcctcgatgccgaagtgctcgccgatggcttcgatcgcgcgctcgtcgtcggcggtgcgcaactcgatgcggtcggtgcccacgctcgccttcagggcctcgggtgtgccaccggccacgatctccccgtggtccatgatggcgatgcgatcgcagaactcggcctcgtccatgtagtgcgtcgtcatgaaaatggtgatctgctcgcgctgctggagctctcggatgtaggaccagatgcctgcgcgcgtctgcgggtcgaggccgaccgtgggttcgtcgaggaagagcacccgtggagcgtggagcagaccgcgtgcgatctcgagcctgcgcttcatgccgccggagaacgtcttgacgctgctgcgtcagcgatcgccgagccccaccatgtccaggacgaagtcgatgcgctcggccacccgctcgcggtccacgccgtagagctcggcgtgaaaccgcaagttctcctctgcggtgaggtagtcgtcgagtgtgctgtcttggaagacgaggccgatattgcgccgtactcgtgcgcgctcgcgcgcgacgtcatggccaccgaccgtcgcactgcccgccgtcggggtcaggagcgtgcagagcatcgagatggtcgtggacttgccggcgccattggggccgaggaagccgaagatctcgcctgcacccacgcggaagctcacgcctcgaaccgcttcgacctcaccgaagcgcttggcgaggcctcgcacctccagtgcatacggcggtggcggctccgcatcgacgaggctcggtgtcgtggtcgtggccggctccgtactcatcgatcacctccatgcgccgaaagcttggcgcatgcaaccaccctaagggctccgggtggacgccgctacgcgtggagaacgcgcgcctagcgcaggcgcattcccgagatcgctcgagcgatgatcaggcgctggatctcgcttgttccctcgaagatggtgtagatcttggcgtcgcgatgccagcgctcgaccgggttctctcgtacgtacccgtagcccccaaggatttggatggcctcctcggtgacgcgaacggcgacctcgccggcgtggagtttggccatggagccctcggcgtgctcgaaccgctgtccctgggccgccatccaggctgcgcggtgcacgagaagacgcgcggtgtcgacggcgagcgccatgtcggccagcttgaaggcgatgccctggttctcgatgatcggtcggccgaactggacgcgttccttggcgtagtcgagagcccattcgtaagcggcacgagcgataccgaccgcttgtgcgccgacgagcgggcgggaggcctcgaaggtcgccatcgcggcttgggattgggcgcgcttgccctctcgggcacgggccagccgctcgtcgagccgttccttgccgccgagcagcgccgacccgggcagtcgcacgtcctcgaggatgacctcggccgtgtgcgaggcgcggatacccatcttcttgaacttctgccccatgcgcaggccaggggtgttgggagcgatgacgaagctggcctggccacgggcgcccagttccggctcgacgctcgccacgacgacatggatgtcggcgatcccgccgttggtgatccaggtcttcgtgccgttcagggtccacgtatcggtggccgggtcgtagaccgcgcgagtgcgcagcgaggagacgtcgctgcctgcgtcgggctcgctcacgcagaacgcggcgaggttggggtggtcggcagtcccgaagcactgcggcacccactcggcgatctgctcgggggtgccgttggccacgatgcccgagacggcgagcgtcgagccgaagatcgcgagcgtgatacccgcgtcgccccagcagagctcctcgagcacgagcggcatcgtgagaccggtcttgtcggcgaacgcgttcagcatgaagtcgtaggagtacaggccgatgcgggccgcttcctcgatgatgggccgtggcgtctcttcacgttcatcccattcgtgagcggcgggacgaatggtctcagcggcaaaggtgtgagcccactcgcgcagctgttgctgttcgtcggtgagtgcgagggaaaagggttccacggggacctcctttcgcgcgaagcgcgaacgttaccgagtggtaaccatagcgctggcttcgaggccgcgcaaggcatcaagccggcaggatctcgggcccgttaggggtgtcacgtacctggtaaccgagggcggcgatctcggcgcggagcgcatcggcgcgcgcgaagtcgcgatcgcgcttggcgtggtcgcgttcggcgaccagcgcagtgacctccgatggaatcgaggcacgcgggggcacggggagcccgagcgtctccagcatcgcagcgagcgctgcgcgtcggcggttagcgagagcgctctcgcccgcgagcgccgccgagcgcgcagcacgggcggcttcggccatgacggcgagtgcggcgggcgtgtcgaggtcgtcggcgagggcagcgtcgaactcctcgagatccgctggttcggccgcacgggcgtcgcctgcgccggcttggctgtcgaggcgggcgagctgcgcggccgcttgctcaagtgtggtggtggtcagctctactgggctgcggtagtgggcgcgaagatacgccagtcggaccacccgtccgccggcgctcgcgatcgcatcgtggaggccgaaggtgttgcccagcgacttcgacatcttctcgccttcgagctccacgaaggcgttgtggacccagtgctgtgcgaaccccatgtcgaggagggaggcctgggcgcgctcgttctcgtggtgcgggaatacaaggtccatgccaccgccgtggaggtcgaacgtcgatccgaggagttcggtcgacatcgcgacgcactcggtgtgccagccggggcggccgtagccgaggctggtcgcgaagccgtaggcgtcgctctccacggtcttccagagcgcgaagtccagcggggagcgcttcgcgtcgtcgacctcgacgcgcgccccagcgcgtagctcctcgagggcttggtgcttcaggaggccatagtcggggacgtgatcgacgctcagatagacgccgttcttcgtcatgtaggcgtggccgcggtcgacgaggcgctcgatgagggcgaccatggcatcgagccattcgctcgcgtgcggtgcgaccgtcggtcgacggacgccgagcgcatcgatcgcgtcccaccagcgggactcgtagcgctcggcgatcgctggcggggtcaccccttcacgagctgcacgatcgacgatcttgtcgtcgatgtcggtgatgttcgagacgaagcgtaccggagccacgagccgctcgagggtccgccggagggtgtcgaacacgacggcgagccgtccgtggccgaggtgcgggtcgtcgtagacggtggggccgcagacgtagacggtgacctgctcaggggtcccaggggtaagctgaatgagctcgcggcgggcagtgtcgtagagcctgagcatccaccgaagtctaggcggggtcccctcgccccttcggaggcgataccgtcggttgcgacccgggacctgcgtccacgaggcacccatggctgatcgggtgacccgtgcggacgagggggtgaggccggggcgaagtccagatgaggaggcgtggtgcggatcccggacaaggtcgagctcgaggggctcgagcgcaagtggggcgcgttctgggaggagcacgggctatatcgcttcgacgacacagctcccgccgcgcaggtctacgccatcgacacaccgcctccgaccgtctccgggacgctgcacatcggtcatgtgttctcctacacccatgccgacatcatcgcccgctaccagcggatgcagggcaaggaggtgttctacccgatcggatgggacgacaacggcgtcccgaccgagcggcgagtgcagaactactatggcgtgcggtgcgacccgtcgttgccctatcgcgggaccgacgaagagctgcctcgggaaggggcacggcaggtcccggtgtcgaggcgacgcttcatcgagttgtgcaccgagctcacggcgaaggacgagcaggcgttcgagcagctgtggcgtgcgatcgggttgtcggtggactggtcgctcgtctacaccacggtcggtgagcgtgcccgtcgcgtgtcacaggcggacttcctcgatctcctcgagcgggaccaggcctacctcgccgaggccccgacgctgtgggacgtcgatttccagaccacggtctcccaagccgagctggaggatcgcaccgtcgagggtcgctaccaccgcatcgtcttcgaccttgagggtggtggcgaactcgagatcatgagttcacggcccgagctgatccccgcctgcgtcgcgatcgtcgtgcatcccgaagacgatcgttaccgcgaggtggtcgggcgccgcgccatcaccccgctgtttcgcgtgccagtaccggtgatcgcgcacccgctcgccgagccggagcgcgggaccggtgcggccatggtctgtacgttcggggacctcaccgacgtcgtgtggtggcgcgaggcatccctgccgacccgggtcgtgatcgaccgggccggccgactggtgccacgcgtggacttcgccgccttcggttccctcgatcccgatggcgcggctgacgcctacggacgcctcgcgggcttgcgtgcgagcgacgcacgtgccgaggtcgcggaggcgctcgcggccgcgggggtgcttcgtgggatcgagcaggtccgtcacgccgtgaagtactacgagaagggggagcatccgctcgaggtccttgcaacccgtcaatggttcatccgcgtcctcccgctgcgcgatcgtctgctcgagcgcgcggccgagctcgactggttgccaccacacatgcaggttcgcctcgaggactggatccgcggactcaaccaggattggaacgtctcgaggcagcgcttcttcggcatcccgattcctctgtggtatccggtgcgcgaggacggctcggtggactacgaccatcccctgcggcctgcgaaggaggacctgccggtcgatccgcagagcgaggctccccgcggctacgccgacgagcagcgaggtgtaccgggtggcttcgtcggcgaccccgacgtgctcgacacctgggccacgtcgtcgttgaccccacagctcgcggggggctggggtgagcgtccagacctctttgccaaggtcttcccgatggaactgcggccccagggccaagagatcatccgaacgtggctgttctacacggtcgtgcgagcggagctggccttcggtcggctcccgtggcggcgggcgttgatctcgggctgggtgctcgaccccgatcgcaagaagatgtcgaagtccaagggcaacgtcgtcacacccatgccgctcgtcgagcgcttcggcgcggacgccgtgcgccactgggcggcgaacggtcggcccgggaccgataccgcggccgacgaggcgcagatgcgcgtcggtcgtcgtctcgccatcaaggtcgccaacgccagtcgcttcgcgctcagccgtgtggcgagccgctccagccacaagcccgcgtgggtgccgatcgacgcagcggaactcgaggccctcgacgccacgatcgcacgggccaccgagttgctcgaggcgcacgactacacgagcgcgctcgcggccatcgaggagcacttctgggccttctgcgatgattacctggaactcgtgaaggtgcgcgcctacggcgacgactcgccggagcacgcctccgcgctggctgcgctcgagatcggcgtcgagctgttcatccgggcgttcgcaccgtacctccccttcgtcaccgaagaggtgtggtcctggttccgcgagggatcggtgcaccgaagtgcctggccgcagccgggcgaggccatgcgccgctacgtcgagctcgtcggtgaaggccatggcgtcgtcgacccggccgttcgggcggcggtgtcgtggtcgctcgcccaggtgcggcgggcgaagacgtcggagcagcgctcgctgcgtacgccggtcgaacgcctcgtcgtgtgggcgccccgggcgtggctggaggcactcgccgctgccgaggatgacctcagggcggccggcggcgtgctcgcgctcgagcgccacgaggccgacgagccccgtgccgtggtcgagctcgctccgccagagcagcactgaatgaggtctgcgacctgaggaccccgtggctcgggtcgcagacggtcgcgcggtccgtaggcttgacggtgtggacagcctcaccccagaggagcttcccggcgaactcgcggtgacacccgaggtcgcgggggggttcgtccgacgccgatggctgttgatggggctgctcgcggtgtgggggcccgggctcgtcgtgatgttggccgacaccgacgtcggcagtctcgtgaccgcagcgcagtcgggtgcgcagttcggctaccgcatggtgctcccgcaggtggtgctgatccccatcctctacatggtgcaagagatcacggttcgcctcgggatcgtgacgggcaagggccacggcgcgctcattcgcgagcgcttcggcccgtggtgggccggcgtctcggcactcaccttgttcgccacggcggtcggggcgttgctgaccgagttcgccggcgtggcaggagtcggtgagctcttcggcgtctcgccggacgtcacggtgccgctcgcaaccgggttcctcgtcgccgtcgccctcacgggcagctaccggcgagccgagcgcgtcggcatcctgctcggtctcgtcgagctcgcgttcgtgccggcgatgatccttgcgcaccccgatgtcggtgcgctcgcgcgcggcgctctcagcctgccactcgccgaccatggcttcgtgatcctgctcgctgcgaacgtgggggccgtgatcatgccgtggatgatcttctaccagcagggcgcggtcatcgacaaaggccttggcggcgccaacttgcgtgcggagcggcgtgacaccgtggtgggagccgtgctgacgcaggcgatcatgctcgtggtcgtgatcgcgttcgcggcaacgatcggcacccatcatcctggggtcgcgctcaacacggtgggccagttgagccgagccttggctccgttcctcggtccggtggcggccaaggtcctcctcgggctcaccatgctcggcgcgggtctggtcgccgcgctcgttgcgtccctcgccggggcgtggggcgtctccgaggtcttcggttggcgccacagtctcaacgatcgaccgtctcgggcgtcggcgcgcttctacgtgacctacaccttggcccacgtgctgggtgcggccatcgtgctcctcagcttcgatctcgtctcgctggtgatcgacgtcgaggtcatgaacgcgctgctgctgcccatcgtcctcggtttcctcctcgcgctggaggccaaggcgctcccggaggcctaccgcatgcgcggggcgtatcgagcggtcgtgacggcgacctcactgctcgtgatcggtttcggcttgctcatggtgccgacgaccctggggtggtggtaaccggcgtcggctgcgctacgacgcggcccagtggtcgggccagccatctggctgaggaatgatcgcgcctttgcgacgaagctcggctcggaagatctctcgcagcacggagagtgcgtcgaggatctccgggtagcgcaaccggtaccacacgttcgacccctcgcgctgggcctcgatgatgccacggtcacgaaggacggcaaggtgctgggacacgttggcttggggcgcgccgatcagactcacgagctcgctcaccgtatgcggagcctcgcccaagatcaacaagatcaggatgcgcttggggtcgttgagcgccttgcacatcatcgggacgaactcctcgagttcggtgatgctcaccccggtcgtggcagcctcggtctcccccatggccccgagcctagctgtcggttcggcgagcggtgtgtgcagctccgagtcggttggtcaggaactcgtcgaggagcacggtgccgagctctccgtcgccggggtagtaggccttgccgtggttgatggcgaccacctgctcgacgaagcgtcgtagcccgcgatcgcgagcgaggacgaagacgctgatctcgatgcgctcgcgggtggcacggactacctcggcgagggtgcgacggagggtctctggggtcgggggataggcaaagtgcaccgagccctcgtcgtcggcgtgggcggtgggttcgccgtcggtgacgaggagaacttggcggcgtccgcgaactcggcgcaggcgctggcgggccagggccagggcgtgctgaatgttggtcccgtagacgtagtcccactgcgcctcaggcagcgcggtgatcgggacctctcgcgcggtctccgagaagaccaccaccgagaagtcgtcggcagggaaccgtgcccgcaccagggaggcgagcgcgagggcgacgcgcttggccggcaagaaggtgtcgttgagcggcatcgagagcgacaggtccagcgcaaggacggtgccttggcgcgcctggtcgtcgacctgttcgatcatgaagtcgtcgggatcgagccggagcggtatccccggcccgttccgagcgagcgaacctcgaagggtgtcagcgagggcgaggcggaacggatcgccaaagcgccactcgcgcacttcgccgttgggctcggtgccgaccccagtgcgtcgcacggcgtgctgcccgaggggcccgagcacgccttgacgcgcgaggtcacgaaggagcaggtcaccgaggcgccacacggcgcgcggtgagagctcgacgcgacccccggtgcgattcatgaggccggctgcctcgagcgcttcggtcgtgcgcgagaggcgctccagcgctgcctgggcgtccgcgccgaggaggtcgcgcacctcgtcgagctcgatcgcaccgaggcgatcgggggtcgtggcttgacggagtgcggcttcgagcgtgtcgaggcgcccgagttcgcgcatcaccgggccgagctcgccgagaccgagcggttcggagcccctgaaccccatcgcgtcggcgtcgaaccccgcgatggtgccgagtgcctccccgaggcgccgcatggcttcggcgatcgcgggggatccagcgagtgcgtcctggaggcgctcgagggcacgtcgcgtgtcgtcgtccacggatgccaggaggcgttcgaggtccatgcgactcgccgcgaggcgggcgaggaagtcttcgaacgattcccccggggcgatgatccctgggtagcgttcctggaacgcctcaaggtcgtcgctgatgtcctcgccacgcgcaaagcgctcgatcagcgacgcgaggtcgctgagcatcgccgcgtacgcatcggcgtcgcccgcctcgatcgccgacgccagctgctcgaacgactgcgccagcagcgaggagcgaaggctcgcgagcaggtcgtcgaagcgctcgtgggctgcctcgtcgaagaagtcgtagtgctcgagcgccgtgaggcgttcggcgatgtcgtaggggagcgcatcgagctccatctgtgcgaggaggtgctcgggcgcttgggtgcgctcgtgtgcagcttcgcggctggctcgctccttcgacacgatggcgtcgagttcctcgcgcacgcgactgagcgtcgcgttggggtcgtagcgcgcgagcagctggtcgcgacgttcgcgtagccgtgtgaggagctcggcaagcccaggcatgtcgtccaagcctcgctgcagcaggtcggcgagtgcgctcgcaaggttgccgtggtaggccaggtcgtcgctgagggcggcgaggacgtcgtcggcctccgggccgaggggctcgggatcgacgcctccatagcgcacggtcgacatggctcagctcccgtagctcactcggttgccaaggacgcgcttgccgagtctgcgtgtcgccacgagtccctcgagacacagttcggcgagtaccaggcgctccgacggcggggcgtggtcgcccatggcagccagcgccggtcgatcggcgaggatctgctcccatgtggccgtggggccatcgagatcgacggcgagcgggcgatcgttggtctcggcgatgacgtccgacgggtcgagatggccgagccgctcggtgaagactcgagcggtcgcttgagcgagcaaggtggccacgatctcgcgctccgaggtgtcgtgggcatcgacctcgatcttgcccgcgaaggccgcgatggtcgcctcggtatcgccaaggcgtgcgcgaggcgggtgctcgccgaggcgaacggcccgaacgagtgccgcggcagcgatcgcctctcgggctgcgatcgaccctcgaacggagacgcctgagtagcgagagaccgcagggtgccgccgtgcgaggtgggccgtgtgggcgacgagttcgtcgaggacctccggtatctcgacggttgggtcgcacagctgagcctcttgtcgcatgatggcgacttcttctgcgatcgtcgacgggtagtgcgttcgtagctgcgtgccgaagcggtccttcagcggtgtgatgaggcgcccacgcgcggtgtagtcctccgggttggccgacgcgaggaacacgatgtccaaggggagccgaatggtgaagccgcggacctggacgtcacgctcctcaagcgcgttcagcagaccgacctggattcgttcgggcaggtcggggagttcgttgatggcgaagaggccgcggttcgcccgtggaacgaggccgaacgtgagtgcttcggggtcctcgagcgtgcgacccgccgcaaccttgatcgggtcgacctctccgatcagatcagcgatggtcgtgtcgggagtcgcgagtttctcgctgtagcgctcgtcgcgggcgatccagcggatgggcgtcgcatcgccttgggcggcgagtcgggccttggtcgaggcgaggacgggcgcgagcgggtcctcgttgagcgccgagccctcgacggcggggacgaaggggtccagcagcgcgacgagggaacgcaggatccgcgtcttgccctggccgcgctcgccaaggagaatcacgtcatgcccgctcaccaaggcgcgcgtcagttctgggagcacggtgtcgtcgtagccgaccatgccctcgacgacggggcggcctgcgcggatgcgctcgaggacgttggcgcgaatctcttcgcgaaccgggcgcgggtgccaaccgatgcgcgcgaggtcgccgagcgtggttgggtggtcgcctgaagcctgggtcacatcgtcgagcctaggtcgaatgtccgtcgtcgattcgtgacgacgccggcgagcgagtaagactatgggggtgaacgttcaccatcacagctacgacgtcgtcatcgtgggcgcaggcggagccggcctgcgcgcggcgatcgagacggccgggaccgtgcgcaccgcggtgatcacgaagctctatccgaccaggtcgcacaccggggcggcccaaggtggcatgtgcgcggcgcttgccaacgtcgaggaggactcgtgggagtggcacgccttcgacacggtgaaggggtctgactacctcggtgaccaagatgccatcgagatcatgtgccgagaggcgatcgacgcggtcatcgatctcgagcacttcgggctgccgttctcgcgcaccccggacggcaagatcgaccagcgccgctttggtggccatacgcgcaaccatggcgaggctccggtacgtcgcgcgtgctacgcggccgatcgcaccggtcacatgatcttgcagacgctgttccaacagtgcgtcgctcgtggtgtccaattcttcaacgagttccaggtgttcgacgtcctcttcgaaggcgaagggaacgatcggcgtgctgcgggcgtcgtggcctacgagctcgcgacgggagatctccacgtcttcgccgcgaaggcggtgatgttcgcgaccgggggattcggccgtgtctttcagatctcctcgaacgcacacacgctcactggagatggtcccgcagtgctcctgcggcgcggggtgccgctcgaggacatggagttctaccagttccacccaaccggcatctacgggatcggcatcttgctcaccgagggtgcccgtggcgagggtggcatcttgcgcaacggactcggcgagcgcttcatggagcgcgtcgcgccgacggtgaaggacctcgccccgcgcgacatggtcgcgcgagcgattcacgccgagatccgtgagggtcgcggggccgggcctgacaaggactatgtctatctcgacctcacgcatctaccgccggagcagatcgacgcgaagctccccgacatctcggggttcgtgcggacctatctcggcctcgagcccaagcgggatccgatccccattcagccgacggcacactacgccatgggcggtatcccgaccaacgtgcatgccgaggtcgtcgtcgacccggcggggacggtgctgccagggctctacgcggccggggagtgtgcctgcgtgtccgtccacggggccaaccggttggggaccaattccctgctcgacatcaacgtcttcgggcgtcgcggtgggcgagcgatggtcgagtacgtcgctggcgtcgatcaccccgacatcgcccgaggcgccgaggagcccgttcgtgagcacattgagcatcttcggagccacaaggggtccgagcgtgtcggcgcgttgcggacgacgctgcaggctgccatgatgcgcgatgcgtcggtcgtgcgcactggggagtcgctcgccgaggcccatcgtgtgatccgcgagctgaaggagcgctaccacgacgtcgccatcgacgacaagggatcggtcttcaacttcgatctcacggaggcgctcgaactcgggaacctgctcgacctcgccgaggtgctcgtgatcggtgcggaggctcgcaccgagagccgtggcgcccactggcgtgacgactaccccactcgtgacgacgtgaactggatgaagcacacgcttgcctaccgcgagccggacggatcgatccggctcgactacaagccagtggtgttgggcaagtacgaacctatggagcgcaagtactgatgacgacgactcagtcaccggcgtcgaccgacgccaccatgcaggaggtggacgttcacctcgtgatccgtcgcttcgatccggaggccgactcgcgcccgcggtgggagagctacacggtgcgacagaagccgacggacaccgttctcgcggcgctccacaccgtgaagtggacgctcgacggatcattgagctttcgtcgctcgtgtgcgcacggggtctgcgggtcggacgccatgctgatcaacggcgagaaccgcttgagctgtgtcaccctcatcaaggatgtcgggaccgagctgcgcatcgagccggtgcggggtctgcccgtcgtcaaggatctcgtcgtcgacatggagccgttcttcgcccagtatcgccaggtcatgccgtggctcgtcaacgacgacgaccctggctttcgagagcgtcgacaatcgcccgaggagcgtgcacgtttcgacgacaccacgaagtgcatcttgtgcggtgcctgctcgacgagttgcccggtgtactgggctgggggcgattacctggggcctgccgcgatcgttgccgcgcaccgcttcatcttcgactcccgcgaccgtgcggccgccgagcggctggacatcttgaaccagcgaggcggcgtttggcgctgccgaacctcgttcaactgtacgcaggcctgtccgcgaggcatcgccgtcacggaggccatcgaagaggtgaagcgtgccatcgtctccgaccgggcgtgacgttctgacgctcgtcgttcgcgagcgtgacggggtgcgacgccagggccttcgcctcgtcgacggggtgctcgagcctgctgcgatcaccgaggaggatgcccaggtcgtcgtcgaggtcgacgactggggtgctgagctcggagcggccctgcgtgcgggtggtgtgcgcatcgtgcgaggtgcgaccgacctcgcccggaacgctaaggtgctgaggggcgcgacgggggtccgctcgagggggtgagccgtgcttcgcagtcgtcgcccgactcgtccgccacagcgaccgggctggtatccagacggctcgggatggttgcgctacttcgacggccacggatggaccgagctcgttcgtgagcggctcgtcctcgctgagttccgaccgcagccgccggtcgcggagcgcccgccgcatcccgcgtcgacgagccgccccaggcagggcgtgcgcatcgccagcatcgtcctcgcgtgcgtgctgctcggaggtgttgtgcttcagctcgtggcgttgacgctgtcgccgcggtcgcagggctcatccgttatctccgaccgcgaagtgctggtgctcgcgagacatgcatgtgaagacagtcccgtcggccaggctgcgatcgtggcgagctccaaggcggctcgatcggcggcggcgtcgcgcgcggcccgcttgacgcagcttgcttccgaggcacacctcgaagccctcgacgacctcgcggccgcgtggtcgaacgtcgcggtcgcgttggtgcaggcggccccgcgatcggcctcgctgcgtgcggccatcgacgcggtgaacaccgcggcgagcggtgcgcacgtggcgtcctgtcgagcgtgagcgtgcgccggtttactcgccctggcgagcgccgtgtgctatcctccaggcatcctgcccaaggaggagtcatgagcgaaccgttcatcgacgatcatctgttggtgcgctatcgcgagctgctcgatgccgaggatcaggcgttctcggagatggagcacgacttcgaggagggcgatgcgcaacgcttcgcactcgaccgcgaggcctggcttgcggcgatccgccaccgcgtgagttttctcgacgcgtgtgggttggtacgcctcgatgtcgtcgtgagctaggtcgcccccggcgccgacccttgacgctggtgatcgttcaggtcgcggcgctacactaagcccagcactgccgggggagtagtgctcggcgcacacggggggaacgatgggcgcgagtcacacagctgtcggggcgtcggaccagtcgtcggcaggcgacgctcggcgtggtccgctgcgagcgtgggacggtcaaggaacggcgccatgtctcagaacgctccgcttcgacgcggacgatgctggactgaggagccgggcgctgtcgggcgaatggcagcgtgaagcgagatgtcgaggcgtcgatccacggacgttcttccccgagcgtggcggatcggcgacgtcggcccggcgcatctgcgctggatgcggcgtgcgcctcgagtgcttggagttcgcactcgtgaccgacgagcgctttggcatctggggtggcctgagcgaacttgaacgacggagtctgcgcgcccggcgcttcgtcgtgtgagcgagacgctgtgtgagcgagacgctgtgtgagccgaagcatcggcgagcgtggctcaggccacgggacggctcgactggagcgcgaaggacgcccttgctaggcttgcccgcgtgcttcgtccctacagagtggttgtcgccaagcccggactcgacggccacgaccgtggagcgaaggtcgtcgctcgagcgctgcgcgacgctggcttcgaggtcatctacaccggtctgcaccaaacggtcgagcagatcgtcgagaccgtgctccaagaggatgcggacgcgctcggcgtgtcgctgctgtccggcgcgcacctgaccctcgtcccacggctcgtcgacgcgctcgctgcgcagggccttggacacgtgctgatcgtcgtcggcggcatcattcccgagcacgatatcgatgccctgctcgggctcggcgtgggccgtgtgttcacgccagggtcgtcgctgaccgagatcacgtcgtggctcgaggcgcaactcgatgagcgggagcgcactggagccgggcagggaggataggcgtggatctgaaggagtaccaaggcaaggacctgttccgccgtttcggggtgccgacctcggagggacgggtctgcgtcacggtcgaggaggcggttgccgcggccgagacgctggggtatccggtcgtcgtgaaggcccaggtgttggtcggcgggcgcggcaaggctggtggcgtccgtgtggccgccaccgaggaggcgctccgcgaggcagcgggtgccatcttgggcatggacctgaagggccatcgggtgaaggaggtctggatcgagccggcttccgacattcgccgcgagtactacgccagcttcacgctcgatcggacggcgcgtcagtacctgctcatgctctcggcgatgggtggcgtggacatcgaggaggtggctcggacgcaccctgaggcgattgcgcgggtgcacatcgatcccatcgacggtctgaccccggccctcgccgaacaggccgttgcgaccgcagggatcgacgagggtcgcgaggagctgccggcgatgttgggtgcgctctatcgcgccttcgtcgaaggcgatgccgacctcgtcgaggtgaacccgttgatcgtccgatccgacggcaagctctgggcgctcgatgccaaggtgacgctcgacgacagtgccgcgttccgccatcccgagtgggaggcgtatcgggccgacgaggagctcgactcgcgcgaggcgatcgctcgtgctcggggcttgaactacatcggtctcgagggatccgtcggcatcatcgccaatggcgccggactcgccatgtccaccttggacgtggtccagcaggtcggtgggcgagcggcgaacttcctcgatctgggaggaggcgccggcgccgacacgatgacggcggcgctcgaggtgatcgcgacggatccgcaggtccgggcgctcctcgtgaacatcttcggcggcatcacccgctgcgacgaggttgctcgaggcatcgtcgccgcgctcgagcgcgtgcgccttccgttccccatggtcgtccggctcgacggcacgaacgccgccgagggcagggccattctctcgtcggttgtgtcggacagcatcatcgtcgagccgacgatgatcaaggcggccgagcgcgccgtcgcggaagcttcgaaggcggtcgcatgagcatctttgtcgacgagcacacgcgggtcatcgtccagggcctgaccggccgccagggcatgttccacggactgcgcaaccgggcctacggcacgcaggtcgtcgctggggtgacgcccggcaagggaggcacggacgtcgaagggatccctgtcttcgatacggtgaaggaggcggcagccgcgaccaacgcgaacgcgtcgttcatcgtcgtgccgccgcgcttcgctcccgaggccatcctcgaggcagctgcggccgggatcccgctcatcgtgtgcatcacggagttcatccccgccaaggatgaggccatggtggctgcggtgttgcgacgtgactaccccggcacgcgtctgatcggaccgaactgcccgggcatcatctcgccggggcgctgcaacatcgggatcaccgcgggggagattgcgcgtccgggtggaccggtcggcatcgtctcacgctcggggacgctcacctaccaggcgctctatgagctcagtcagcaaggtgtcggccagacgacctgcgtcgggatcggaggcgatccggttcccggcacgaccttcatcgactgtctggcggccttcgaggcagatcccgagacacgggcggtgctcatgatcggcgagatcggtggacaggacgaggaactcgccgcagcgttcatcgcagagcacatgaccaagccggtcgttgcctatatcgcgggcgttacggcgccgccggggcggcgcatgggtcatgccggcgcgatcgtgtctggctcgtcgggaaccgcacaggccaagatcgaggccctccgagcggcgggtgccatcgtggcgcagaatcccaccgaggctggcgagcgaatggtggaggtcgtctcgcgtctcgcctagccctgcggccctaggcttggcgggcgtgcgtgtcgcggtgctggcatctggcgtagggacgatcctcgagtcgctcgtcgatcacggggtcgtgccggcgctggtggtcgcggatcggccggcgttggccctcgagcgagcacgtgacgccggcctggtctcgacgctggtggatcgtcgttcgtatggatggcgagactcgttcgaccgcgaggcgttctccgacgccgtcgccgacgtgctcgaggcggccaaggtcgagctcgtggtgctggctggattcatgaccatcctcgccggttccatgctcgcgcgctttccggctcgcgtcgtcaatacgcatccgtcgctgctcccgagctttcctggtcacgacgccgtggcccaagcgctgtcggcgggggtgcgcgtcagcggcaccacggtgcacgtggtcgtggagcaggtcgacgccggcccgatcctcgagcaagagccggttcgggttcggcggggcgactcgatcgagaccttgcacgagcgcatcaagcacgcggagcgtgagctctatccgagggtcgtgcgagcgatcgttcgggcgggggtcggcggcgatcggtggtgggaggatgctcgtgtgcaacgagcgatcgacgaggaggttcgtccgtggcgcgagcgctgatctcgctgtatgacaaggccggtctcgagcgggtcgcgcgaccgctgcacgccgccggctggcggatcgtggcttcgggtggcaccggtgaggccctccgcggcctcggtgtccccttcgagcccgtagaggaactgacgggctttgcgtccatgctcgacgggcgtgtgaagacgctccatcctgcggtgttcggcccgatcctcgccgacctcgagcgtcctcaccatgcgacgacgctcgaagaggccggctgggagccgatcgacctcgtcgtcgtcgggctctacccgttcgcgtcggatccgtcggtcgatctcatcgacatcggtggtccctcgttggtgcgcgctgcagccaagagcgccgaccgcgtgaccgtgctcgtcgaccctgccgacttcgggctcgtcgacgaggtcatcgctggcaacgtcgaccggccgttgcgccggcgactggcggccaaggcctttgcgaccacgagcgcctacgacgctgcggtcgcgacctggctgggcggtggagagggctcgttgcccgatccgctggtcctccctctcgagcgcgtcgccgtgacccgctacggcgagaacccccaccagcgtggcgccctctatgcaccgatcggcacccgccgtggcttcgccgaggcccgttggcacggcggcctcgagcccagctggctcaacatcgctgatgccgacgccgcggcgcgtctcgtcgctcggctgggaccggagcctgctgcggtcgtggtcaagcacgccggaccgtgtggtgcggccgtcgcaccgacgcttgccgaggcctacgagctcgccttcgctggggaccccgtctcggcgttcgggggcgtcgtcgcgctcgggggggtgctcgatgtggcagtcgccgaggcgctcctcgcacaccccaaggcagacgtgatcgtcgccacggcgatcgacgacgatgctgcccaggcgctgctcgcccgccgtccgaagacgcgactcgtcgagctcgcgatcgatcgcgacgagccgtggtgggtgcgcagcgtcgcgggcggggtcctcgtgcaagagcccgatcagctcgaggagccgacggatctcgaactcgtcacgagtcgcgttcccaccgacgaggagcgccgtgacgcctggatcgcgcacgtcgtgtgcgcgtcgacccagtcgaacgccgtggtgatcgcgaggcagggggctgtggtcggtgtcggccagggccagccgtcgcgggtcgatgcggcccggctcgctgtcgggcgagccggtgcgcgcgcccagggtggtgccgccgcgtccgatgcgttcttcccgttcccggacgggctcgagaccctcatcgacgcgggcgtgacgtgcgtcgttgcgccggcgggatccgtgcgtgacgacgagattcgtgcagtggccgagggtcgtggcgtgagcctgctcgtcgctccgagacgccactttcgtcactaggaggtctggtgggagccaagctgctcgatggggagcgcgtcgccgccgaggtgcgcgccgaggtgcgcgatcgggtcgagcgcctgcgtgcggcgggcgtgcgcgtggggctcggggcgatcctcgtcggggacgatccggcgagtgcgcggtacgtcgagatgaaggcgcgcgactgcgcgagcgtggagatcgcgtctcgcgtggtgcgcctcggcccggatgcctcacaggcggacgtcctcgcggcggtcgagtcgttgaacgcggacccggaggtgagcgcgttcatcgtccaactcccgctccctcggcacctcgacccagatgccgtgctctgggcgatcgacccggccaaggacgccgacggattgcatccggtgaacctgggcgagctcgcgctcggacgcccgcgcgtcgtggcgtgcaccccggcgggcatcgtggagctgctccaccgtcacgggatcgtcctcgacggtgcgcatctcgtcgtggtgggccggggcctgacgatcgggcgtccgctctcgatcctcgcgtcgctgccccgagcgggtctcaacgcagccgtcaccgtcgttcactcgcgggtgcgcgacctcgccagcatcgttcgcagtgccgacatcgtcgtggcagccgctggcagccccggcctcgtgaccggcgccatggtgcgccctggcgccgtggtggtcggtgccggcaccagcttcgaaggacggcgcctgctctcggacctcgccgacgacgttgcggacgtcgctgcgtgggtgacgccacgcatcggtggggtcggaccgatgacgagggccatgctcctcgtcaacaccgtcgaggcggccgagcggcgagccggtcggagcgagccgtgagcgacgtgctcgatcgctacggcgagcgagtctgttcggtcgagctgtggccagcgcgcacgagcgatcaggagcaccgtctcacggccacgttggacgtgcttcgttccctgccgccagcattcgtgtcggtgacctacggcgctttcggctcgagccgccacgagagcctcgcgctcatcgaacgggtgctcgccgatggccatcgggtgctggcgcacctcgcggtggccggtcacagcccagaacaactcgtcgcgctcctcacgcacgtcgagcgtctcggcgctgacggcgtgctcgccctgcggggcgacccgccgctcgacgaccccgacgatcgtgcgcgcttcgtcggtcgtcacgcactcgagctggtcgaactcgctcggcagcacacccagctcagcgtcggcgtcgcgctgcacccctcgggccaccccgaggcgcgctccctcgaggacgacctcgatcaccaggctgccaagctcgcgcgtgccgacttcggcatcacgcagttctacttcgaggccgccgcgctcacccgactgcgaggcgcgcttcgcggtcggggggtgacccgaccggtgatccccgggctcctcgtgccacgctcgccccgccagctcctgcgcatgggggagatggccgcggttcgcgtcccgcgggagttggtcgaggcactcgagggtcccgacgggccggctcgagcgaggacggtcgtcggcgagctcgccagcgccgccctcgaggaggggagtcccggggtgcacctgttctcgatgaaccaacccgagacgacggcgtggctgctggagcgccttgatcggcgccatcgtcgcgtcagttgaggtgtttgccgaacgttcaccgtctggtcagcgtgaggcaaactcagcgcaaccgacccgtcgccgaactccgcaagactgaacccgtcagcgaatggcgctggtatcgcgagtcactcgaggaaggagtgatccatgagtgatcgatccgtcgacgcggccctcgacgaggcgccgctgagtcggttccacacgaggtcgatcttcgtcgcaggcatggggttcttcaccgatgcctacgacttgttcatcatcggcacggcgacgaccttgatcgcgaagcagtgggggctctcgtcgaccgagaccggcctcatcaattcgatcacgttgctctcggccttcttcggagcggtgatcctcgggcggctcgcggatgtcctcggccgcaagcgcacctacggtctcgaggccgggctcatggtgctcggagcggtcgcctcggcgttctccccgagcctcatttggctgctcgtcttccggttcatcctcggtctcggcgtcgggggcgactacccgatgtcggccgtgctcatgaccgagtacgccaacgtgcgctcgcgcggtcggctcgtcgggctcgtcttctcgatgcaggcactcggtaccgtcgctgggtacgtggtcgcgctcgcgctcttgtcggcgggcgtcaatcatgacctcgcttggcgcctgatgctcggcctcggtgcggttcccgcggcggcggtcatctacctgcgccgcaagatgcctgagtcgcctcgctaccgcgctcgcgtggagggcgacgctgcgaccgcagcgcgcgacctcaaggcgtactcgggcggtgtcgtggatgcggccgcggtcgccgagccgaccttgcgcctgcgcctcggtcagttcctctcgaaccgcacctacctcctgtatctgctgggtacggcgggcagctggttcgtgttcgactacgcctactacggcaactcggtctcggctcctctgatcgtcaagagcgtgctcggtaagcacggggcgcacgtgctcacggaggcgatcgcgctgcagctcatcgtcttcacggtggcggcggttccgggctactacctcgcctcgttcttcatggatcggatcggtcacaagcgcctgcagctgatcggcttcacgttcatgggcctcgcttttctcctcatcggggtgatccccggggtgacccacgacgtgctgccgttcctggtgctcttcggcgtgagctacttcttcgcggagttcggtccgaacctcacgacgttcgtgctcgctgctgaggtgtacccgacgagcgcccgctcgactggccacggtctctcggcggggatcgcgaagttcggtgcgttcctcggtgtcttcatcttcccgatcgtcaagagcgcgttcggcgtgggtggagccctggagttctccttcggcatggcggtcctcggcctcctcgtgaccctggtgcttcctgagcctgcgcagcgttccctcgacgacgtcaccggcgagctcaagctcgcagaggcggcccaggagtacctgcgccgggcttcgaaccagcagcggatggccggacaagactgagcgacctcctcatcggaggtgatcgacgaaccccgaccggaaggtcggggttcgtcggctttgctcgcgggtggtgccgtgcggctcgtgtgaacgtcgaggccgccgccgtgaccggagatccgcggtggtgccgtcaccgtcgtcggggagccgcaaagctcgcgtgggcgcggtcggcgccggcctgcgtcctgcgacggctccctctgggcgaggtggctcgagccgtgcgccgcgagacgccgacggtgtgtccgcgtggctgacgtgggtcggatgcgcgtgctactgtgcgaggaacggactcggtgcgatcgcagacggtccgatcgtggtgccgacgagcgtcgtgcgggttggctcaagtctcgggaggctcaggacgatgaggccagtgtgagcgagccgtccttctgggaaacgctggagcgtgtcgccgcgctcgtcgacgggccaccggttgttcgtccccagctcgtgaccctcgtcgggggtgatggtgccgtggacgatgtggcctcggcggcgtcgcgaggagggctcgtcccttcgcccgtagagcatggcgacgccaccgtgccgagcgatgacggcgcgccgaggggagctggcgaggcagacgtcgccgatgccgtggctgcatcggcggtggcgccgccgtcacctgccgaggatcaggctggcgcacggccaggcacaccggtcgctcgcgctgacgccgtcttccaggttctcgagcagacccagcgtgcagaggtcgtcgccgagttcggccgacgggacgctggggcggctccggccgagctcaccacggcgtctacgacgcccgccacctgggacgacgtcgacgagggcgtcgtcgccgcgccgagcggtttcctcgctggcctcgcggccaagcatcgcatcttcgccgagaccggtgagatcgacgtggatctcgaccgcgtggatcggcgcaagcgtcgtcgacgcggtcgatctgcctagcgcaccagagcggtgcgtgctggcagcggcgaggagccggcgccggtcggcgtgaccgtacgaccacgacggtgggctctgtgcgccgacgacatcgtggacgccgggtcgctccacgtgcagcgacggtcccgcacgagctgtgtcggcgatgccggtggctgggtcagcgactaaggagcttcgtcgccgaggtcccacgtgagggcgatgccctcacgttcggcgtcgcgttcgacccgcgcttggttgcggcggaactgtgggtcgtgcgctgggagcatgaggagccgcgcgttcgtcctctgcgcgaactcttcgcccactcggcgatcgccgctcgtcgtcacgatctcccagtgaggagcgaccgggcccaggtagcggatgcgtgcatgcgccctgatgggtaccggtgcttcgtcctcgggcatcgcccctcctctgctcggtgcgccagcctatcgtgactgaggctcgagagggtgcgtccgcttgcgcagaaagttactctatggtagcttctcgcatcgcagagccacgtgggccgtcacctgcagagggagggagcatggcgacagagcgaggttcagcgcccgaggcaggtgcgctcgtgagcgagccctggatggcgtttggatcgtgccgtggtatggatcccgagttcttcttcccgaccgacggtgctggtgtcgtccaggctcgccgggtgtgcgctcagtgcaacgtccgcgagcagtgcctgcagttcgccctcgatcatcggatcgatcacggcgtgtggggtggcgcctccgaacgtgcgcgtcgtcgcctcctctcacagcagctctcgtcggtgcgagcgcctcttcgcgacgtctagcctcgccgtgtgctcgagtgcgtgatcaatctcgccgaagggcgagagacacgtgcggttgaggcgatcgtccaggcagcagcccccgcgctcctcgacgtccacgtcgacgccgaccacaatcgcagcgtgttcaccctcgctggtcccatggtcgaggatgcggcgtggtcgatagcggaggccgccgctcacctcctcgacattcggcaccacgtcggtgtccacccctggctcggtgcgatcgacgtcgttccgttcgtcccgctcggtaccgcgtcgttggatgcggcgatcgaggctcgcaatcgaatgggtgcgcggcttgcgagcgaactctcggtaccggtcttcttctatggtccggagcgcggcctgccggaggtgcgccgtcgagcgtttcgcgatctcgcccccgatctccggccgactcggccgaatccgcgcctcggtgcctcctgcgtcggtgcccggggcccgctcgtcgcctacaacgtcgtggtcgatgcgagcctcgaggtggctcgcgaggtcgctcgggagcttcggggacctgcggtgcgtgcgctcgcgttccaggccggtcgtcgagtgcaggtgtcgatgaacctgatcgaccctcgggtcgtggggcctgcccaagtcgtggatcgcatcgcttcccgagtgtccgtgcgcgtgtgcgagctcgtcgggttggtgcctcgctgggtgctcgacgacatccctgccgagcgttgggcggagctcgatcttggaccagaccgaactatcgaggtgagactcctggctcggggcctgccgctcccagcgtgagcggtgccgacgactcggtggtggcgacatcgctgcgaccgaggtgtcgcaaccccgcccacgccagagcggcggtgcgctcggcgtagcgcgccgccagtgaggcctcgaacggccgattcggctcgtcgtcgtcgacgtcgtcgatgtaggcggcggccgcgccgttggcgaggccgatgagtgcccgtgcggtcagcagccgatcggactcgctgggtgctcctgtgatcgactcggcaacgagatcggcgatcgccagctcgataccaacgacgatcgactgaaactcgacgtcgcggtagacacctggcccgaagagcacgaggtaggccgcgcggtgcgcgtgcacgaaggcgaagaacgcgcggatgccagaccacagccgcacgcgggggctctcgacgccgcgcgtcgcctcggcgatcgcgcgcgccagctcggccccggcaccgtcgatgacctcacgaaagagggcgcgcttcgaggcaaagtgctggtagatgacgggcttcgtcacccgcgcatggcgtgctacctcgtccatcgacgccgactcgaacccacgctgcgcaaagaccgttcgcgccgcgtccaggatgagcgctcgccgacgctcggctgggagtcggtgagcccgtgtgtcggcctgcatgtgctcccctctgcgaacgcaacgcctcctcggtggccctcgacactagccaggttggcacgccgcgtctcgtcgtgcgcgtgcgctgtcgtccttctgccgcgccctgagcccagagtgcccggacctctgcgcgcctaggctcggggtccgtgaagacagcactcgtcaccgggatcactggacaggacggctcgtacctcgccgagctcttgctcgccgaaggctatcgcgtcgtcggtatgcaccggcgttcgtcgacgctgaacttcgagcgcatcgcgcacatccaagacgacgtcatcctcgagcccggggacttgctcgacgaggcgagcctgctcgccgtcttgcgtcgctacgagccagaggaggtctacaacctcgctgcgcagtcgttcgtgcagacgtcgttcggtcagcctgtgctgaccggcgagaccactgcccttggtgtcacgaggctgctcgacgcgatccgggtggtcaaccccgagatcaggttctaccaggcgtcgacgtcggagatgttcggcaaggtcgtcgagacgccccagcgcgagaccacgcccttctatccgcgcagtccgtacggtgtcgccaaggtctatggccactggatcaccgtcaactaccgcgagagctacggcatgcacgcgagctctgggatcttgttcaaccatgagtctccacgccgcggcctcgagttcgtgacgcgaaaggtgacgttcggggtcgcacggatcgcccatggcctggcccacgagctgcgactcggcaacctcgacgcgcagcgcgactggggttttgcgggcgactatgtccgtgcgatgtggttgatgctccagcagcccgagccagacgactacgtcatcgcgacgggatcgacccattcggttcgagaactctgcgagcgcgcgttcgccgtcgccgatctcgattgggagcgctacgtcacggtggacgagcggttcatgcgtccggccgaggtcgatctgttggtcggcgatgcgagccacgcgcgacgccggttgggttgggagcccaccgtgagtttcgacgcgctgatcgagatgatggtccgggcggacctcgagctcgtcggctcgacgctgaagtaggcgccatggcccgcagggtcgttcggctgcggggtgtgaccgtcctgctcggtcggttccctgcactggctcgtgccgacttcgacgccttcgaaggcgaagtcgtcgtgctcgaagggccgaacggatccggcaagacgacgctgctgcggctcctcgtggggctggttggcgcgtccgagggcgaggtggccgtgttcggcctcgaccctgccaaggacgtcgcgagcgtgcgtcgcgcggcgacctacctcgggcaccaggccatgctgtacgaggatctgagcgccgaggagaacatcgctttcctcggacggctcggcgtcatcgatgccgaacgcgcccggggcctctgcgaccagcttgcggtcggccgacgcgagcgagggcggcgcatgcgacagctctcggccggccagcggcgcaaggtcgcgctcgccgcgacgctggctcgacctgctgagttgctcctgctcgacgagccgcacgctgccctcgatcccgagggcaaggaactgctcgatgcgctcctcgcagacgctggcgcccaaggtcgcaccgtgatcctcgcgagccacgaggcggagcgggttcgttcggtcgcgacgcgtcgctaccgcttgagcgggggtcatcccaaggagctaccctcgtgctgaaggtcgcggtcgcggtgtggcgcaaggaccttgggatcgagtggcgaactcgcgtcctgctcaaccaggtggtgccggtcacgctggtcatcgtggtgctttttgggttcgggctcggcgccgacgacccgctccttcgagccgccctccccgggctgtactgggtcagcgtcttcttcggtatgaccctcgccgttgcgcgcggtgcggcgatcgaggcagaggcgggtgcgggcgagctgtggcgtctcatggatgtgccccgcgctggcgtgtacctcggcaaggtgcttgccgtcgcgacctggggcgtcgtgatcgaggtcgtcaccgccgccgcggccgccattctcttcagcgccccgctcggtcaccctctcctgcttgcggcggctgcgctgctcgccgatctcggggtcgcggcggtcggggtcgtgctcgcccagctcgcgaccggggagcgtgcagccgagagcctgctgccgctgctcacgctgccggtggtgagccccgtgctgctggctgctgcgaccgtgtggagcgagggactcgctcaccacgcttccctggcaactccctgggtcgaggtcctcgtcgcgttttcatgtatctacctgatcgttggcatgcttgtatacggtgtcgtcctggaggggtgagtcgtgagacaacgcgcatcgatggtgcgacgagtggtgggtcttggcgcgctggctggtgtggcgctcaccgcctggctcggcctcgtggccacgccgcccgcggagttcttcggcaacctggttcggttgctctacgtgcacccgtcgatggcgtgggtcgccttcttggcctttggcgtgacgacgctcgcgagtgcgctctatctgtggccgaggacccgtcggcctgagtgggacctgctcgccgctgcctcggccgaggccggcgtcgtcttcaccgggctcacgctcgtgaccggctccatctggggtcgaccgacctggggcgtgtggtggacgtgggatgccctgttgaccgcgaccgccgtgctgttcctgctgtatctcgggtatctcgcgctgcgtcgaattccgatggacgaagagcgtcgtgcgaagcgctcggcgatctgggcgttgatcgccttcatcgacgtgcccatcgtgaaccagtcggtgtactggtggcacacgctccatcagcgtcccaccttgaccgttggaccgacgaacgcagtcgaggtccacgggatcatggccgtggcgctggccgtaagtttcgtgtcgttcacgttggtatggatctggatggtgtgggcacggttcgacctcgcgcggcgccagcgcgtgctcgaggaggccgaggtcgagcaggccctcgccgagcgcctcgaggccgtggaggcgggctcgtgaacggctacgtggaggccgggtatctcgcggtcgcgctcggtctgggtggctacgcggtgtggatcgccgccttgacgacgcgcgtacggcgtcgtgaacgcgaactctccgtgacgaggcaacgccgtggctagtgcgccgagcacgctcgacggtcgcgacgagtggaagacggtcccgagcgctcgtcggacgcgtcggcggatgctccagtcgttggtcctgttcgcagcgatcctcgtcgcgctcgtggtcgtgctggccatgggcgccaagagcgcgctcgagtactacctcacggtcccgcaggcgctcgccaagcgcgccacgctggccggccagaccttccgcatggagggcatcgttgtgcccggctccatccagtcgacacccgagggggtcgattttgccctccgctacgaccgtgcggtcgctcgggtcgtcgagatcgggaacccgccccagctgttccagccctccatcccggtggtggtccaaggtcacttcgagggttcgacgttcgtctcgaacctgatcatggtcaagcacacctcgtcgtacgtggccgcgcaccccaaccgcatcgctgatgccggagggacctacaagccgtgacgcaggcggtccttggtacggcgggactcgtcgttgccttcgtgttcgaggtcgcagggacggttgcgctcgccgttgcactctggcggcggaggcgactctggcgcgacgtgggccttcggctgctcgtggtcggggtggcggctgtggtggcatcggtcgcggcgctcgaagatgccctggtcacacacgactttgcgctgagttacgtggtccagaacaactcgagggagacccccctcatcttctcgatctcggggatgtggtcggcgctccaaggttcgctgttgctctgggctctggtcgggggggtgtatctcctcgggctcgcctgggtgctccgtcatgaggacgactgggtggtcggcgcgaccgcgctggcgatcctgggtgtgatcgaagcgttcttcgtcggggtgatcctgttcgccgcgagtccgttcgcactcgtgagcggggtcattccggtcgatgggcagggcccgaacccactgttgcagcagtatccgctcgtgctcatccacccaccgatgctctacgcgggtctcgtgggcatgagcgtcccgttcgcgctcgcgacggcttcgctctggcatcgccacctggacgacgcgtggctccggcgcatccgcaactggtcgttgatctcctgggtcgcgctcggcatcggcattaccttgggggcgtggtggtcctaccaggtgctcgggtggggcgggtactgggcgtgggatcccgtcgagaacgctgcgctcttgccctggctgatcatggccgcctacctccacgtcgccgtcggcgaacggcgtcgtcgccgcttgagtgctgctgggtatggtctcgtcgccgccgccgccgcgatgacgatcttcaccacctacatcacgcgttcgggcgtcctcgagagtgtgcacgccttctcggactcgagcctcgggacggtactgctcgtgttctttggcctcgtggtcgtcggcgcggtggtggtcgcgctcgcgcgcgccgatgtgctcacgcagccaggagcgcgaccgaacggggcacgcgggacgctgctcggcatcaacgcggcgctccttgcgctggtcgcggtggtggtcctcgcgggcaccatcttcccgctcatcgactaccaggtgagccatgcgagcgtgaacgtcggtgcgcctttcttcgatcgcttcgtggtgcccttgtcgctcgtcgcgttggccctgatggcgctcgccccctggtcgaggtggcagggcgcccatctcgacgaactcggttcgcgcaccctcgccccggctgccctcgcggtggtggtgctggtcgtcgccgtcgcagccggggttcgatcgctcgcaacgcttggcgcgtggtcgctcgccgccttcgtgctcgtcagcaccgttgccgcagtggcacgacagttggcggcgcgcccccgcggtcgtcggcttcgcgcggtcgcgtctcggcaggtggccgggatgatcgtccacatcggcgtcgcgatcgtcgcggtcggcatggcatcggcgacgaccttcggccaccagggcgaggtgcgcatcgcacgcggccacaccgtgagcgtctacggccagcgtctgacctacgagggcgtgcgcacggtggtgaccccgcagaagacttcgttcgaggccgaggtcgtcgtcgacggccaggggcgctactacccggctatcacgcagttcgggacctacacgacaccggtgggaacgcccgccgtcgcggtctctccgctgcgcgacgtctatctgaccatcgacgcgcccccgagcacctcgtcctcaccgatcacgctcggcgtcgtggtccagccgctcatcttctggctgtggctcggggctgcgaccatcgcgttcggtggtgtgctcgcggtggtggggatccggctcgaaccgtccggacgacgtccttcggagcgcccggaggcgccggtgccgagtgtggtgggtgcggatgcgtaggcgtcggccagtggtcgcgttcgggatcggggccctcgcgctcgtcggcggcttcacctggctcgctgcccgcgcggctccggccagcgagatccaggcaccctccccgctgctctacaagccggctccccgattggcaggcccctcgctgtggggctcggggtcggtgtcgctcgctgcgatgcgcggtcgctacgtcctcgtgaactacttcgcgagctggtgctccacctgtgccaccgaagagcgccagctcgtcgacctcgctcggggctcgggagtacgtgtgctcggcgtggacttcgacgacacgaacggttcggcccgttcgttcctcgcgcacttcgacgcgcacttcccggtcatcgtggacgcgagcgggcagcgcgcactgcgatggggagtgtcggcgccaccggagagcttcctcgtctcaccgagtggcgaggtcatcgctcgcatcgtcgggccgctcaaggcgatcgaagtggaggcgctcgtgcgcctcgccgaggcgaaggggtacggggcgtgacgcggacccgtcgcatcgcggtggcctggttcctgctcgccgcggtggccctcggggccgtgctcgtcgcgctcgtcgagcagccgtcggcggcgtcgcctgctgctcggatcgcctccttggagcgggaggtccggtgcctgagctgcggagagctcgacgttgcccagtcgaagagcgccgaggcctactccatggcggcattcattcgccacgaggttgcggccggcgcatcgaaccagcagattctcgatcaactcgtcgcgacctacggtgacgcggtgctgatggcgccaccggccaacgggctcggcctctacttgtggttgctgcccgtggcggtcggggctggcatcgcatgggagctggtgcgcggggcgcgccgtcatcgcgatccggaggagctctctggcggccgtctcggcaccgacgcggacgagccggcaccgcagccatcgaggcgtaccggcggcggggtcgggttggcgctctcgccgacggccgtggccgcggctccgtccggtgaggatgagcgccgcgctcggccgcgtcggttggcggtgccgaagtgggcggccctcgtcgggggcggactcatgctggtcgcagccggggttggtgtcggggtcgccatcggcgggtcgggcggcacggctcacacgacagcgaccctcggtgaggatctgcgcctcggggagacgttggcggccgtgggggcatctgctcaggccgagcgagccttcgaggctgcgctcgagctcgcgccgacgaatccgacggcgctcgcctacgagggctggctgcgcttcaacacggcgcactcgagtagggcgcgtgcggcggcgctcgcgatgctcgatgaggcggcgcagctcgggccgcacgtcgccgtcgcgcagctgttcgatgggttcggactgttctacggccgtcacgagaccgccggagcccttgcgcgtcttcgtgcgtacctggcggatgcaccgagctcgaagctctcgctcgaggcctcgccgctcgcggtgccgatctactcggcggcgcacctcgccgtaccggcgccgttccgaagccgaggttgatcgccgcatctgcgtgcgggccgatgtggtggtcgggctggctcgccggggctccgcttcctccctgggaagcccggtggccgcctcgtggttgctacggtacggctgctgtcaggaggttcgagtggggttcttcgatcgcaagcgcaccgagctcatcgagcggggcatcgacccgagtcgtctgccgccagggcagtacatgaccgaccgcttcccggtcctgcacgcaggcgaggttccggtctatcacgaccttggtgcgtggaacctgcgagtgttcggccgcgttgggacccctgtgacgctgtcgtacgatgagctcctcgcgctcggtaccgaggacgtcacgaccgacatccactgcgtcacgaagtggtcgaagttcgacacgcggtggcgcggtgtgccgttctcgcgcatcgtcgagctcgtacgaccgagcgaggacgctgcctacctcatcgtgcacgcggagcacggcttcacgaccaatcttcccctggccgatctcctcggggatcacgttgccatgctcgcgacccactacgacggcgtgccactcgagccggagcacggcttcccggtgcgcttcctcgtcccgcacctctacttctggaagtctgcgaagtgggttcgcggactcgagttcaccgagtccgaccgacccggcttctgggagcgcaacggctaccacaactatggtgacccgtggcgcgaacagcgctactgggacgagtagttcggaccatcgcacagagccgagcgctcgcatcgcgccgtgaggccggcacacgagggtcgaggccgcgtgattcctcaccgctctctggcgcgtgcgccccgcgagatcgtgccgtgaccgcgtactagggtgctgccatggcgggtgcggcgtcgtcgcctggtccgctggacgaccccggcgacgaggtgggtttgacgactcttgctccgggcgtcgcggtgcatccggatcatgcgagcctcctgcgcgaactcgatacggcaccgctcggtctcgagcacgtcgtctcgtggtggatcgcctcgggcgggacgctcgccgatggcttgtccgtggccatcatcggcatggcgctgccactcgccgaacatcagctgcacctcggtaccgtagaggtcgcgctgctcggagctggcctggtcgctggcgctgcggtgggggcgagcgtcggtggacatctcgccgatcgtgtggggcgaaccgcggtgatgctcgccgacatgctgctcctcatcgtggcggccgtggcgagctcggtcgcgtggagcgcgccgttgctggtcgtcgctcagtgtggggtcggtatcgccgtgggtatcgattttcccgccgggtcgagctacgtcgcagagacgatgcctcaggcttcgcgtgcgcacttcctggtggcgacgatcgcgaaccaggcggtcgggatggtgctcggtgctgcactcgtcctcggactcgtccacgaggtgcagaccccgagcgtgtggcgcttcttcttcggcgtcgaggcgctcgtggcagccttctttctgctcgcgcgcctgcacctcgtcgagagcccacgctggctgatggcccgcggtcgcaaccgggaggcgttgcgcgcgatggaggtcttcgtgccgagtcgagcacgcgcgttcgaggggatcgctgcgcggctcggcgatcggccgctgcacgtcgcacggatcccgcacgatgacaaggcggcgcggtttcgctccatcttcgcccccgcctatcgtcgtcgtacgctcctgacgaccgtgccgtggctcttgatggacatcgcgacctacggtgtcggactcttcacgccggtcctcctcgatacgctgggggtgcgatcccactcgtcgaacctgccagcgcgcacggcgagcctcgccctcgggacgggcttcgtcgacctcttcctcctcgcgggctttgccgtgggcgtcgtcgtcgtcgcccgcttcgggcgtcttcgcatgcagatcctcggcttcgtcgggatggcgatcggcatgggtgtgcttctggcgagcacgcaggtgacgatctcggttctccgggtcgcgttcgtgctcgtcggtttcgtggctttcaacttcctcatgaatgtggggccgaacagcacgacctacgtcctgcccgcggaactgttcccgacgcagctgcgcagcaccgggtcgggcttcgccgcgtcgatggccaaggtcggagcgacgatcggcgtgttcctcgtccccgtcgtgtcggctcattgggggaccgccgcggtcgtcggtgcgatggtcgtcgtcagccttctcggtgcgaccaccacggtgctctggcgagtcgacgatcgtgagcagacgctcgaggagcatcaggcgtcagagcccgtcgatacgctgtgacctcgtgggcggcgagatcgacacatcgggcgggacgctgcgcgggcgtgtgctgatgcgcgtctcgaatcagacgtcgccgagtcacgtgcgtcgtggacggcgtctggccggctgcggtggctgcgagagcaccgtcgtccctcgccagtgcttcgccgcgcgcgtgaccatcactcgatccagccacgctcgcgtgcgaccgcgacggcttcgtggcgattggcgacgccgagcgtgtggatgatcccagacaggatgttgcgcgtggtgccgggggcaaagtggacgcggagggctacctggccgatcggagcaccgtcgctcgcggcgcggagcacgcggagttcccgttcgctgagcgggccgtggccccgccgcaaatcgggggcgatgtggggatcgatgacgcagctgcctgcccacgctgcggcgagtgaggctgcgagcgcgtcgatcggcatgctcttcgagaggactccgcggacgccagcggcaaggagctcgagggtcagtgtgctcgttgcaaaggcgctcagcacgaccacgcgagagccggcttgggtgagttcgcgaatggcctcgactcctccgccgggaacgtcgaggtcaaccacccagagcgctgcggtcgtcaccgtgtcgtcgtgagggccaggcatggtgaccgaggtcgtgacaatggtgaactggccagtgccctcgaggagcgacgcgagtgcgctggtgagcagttcgtggtcgtcgatgaggatcagagggatcgtgggactatctcctcgctcgactgcgtccgctccaggcgaagccatgtaccgggcggttctgaaccgaggctccagcgtgctccgatggcggctgcgtgcgcctcgacggcgcgcaggcccgcaccaggcgcaccgtgcagccccacgccgtcgtcgtgcacggagagggtgagtcgagtgctctcggggtcgtagcggatcgagatcgccgcggtcgtggcgccggagtggcggatcacgttggcaaccgcctctcggaggatccatgcgagatgctcgtcggtggccgggtcgagggcatggatgccgtgggtgtcgaaggtcgtcgcgatcgacgccgtcgcgagccgctcgcgggctcgtgcaagctcgtcgaggaggcggctgggaggtggcggttcgtcgatccgtcgcagcgattcgagcgcatcggcgagttctcggtggacggaggtgagctggtgctgtgggtcggagtactcgagggaccgaagagcgatggcgacgtgctgtgcggcggtctcgtgcagctcgcgggcgaggcgcagccgctcgtcggctctcgcccgggcgacatcggcgtcgcggagacgctcgacggtgtgcagtgctccgaccaggtccgtcatggccgttgcgcccacaccggcgagcaggacgttcacggccaggttgatgccaaggccaggactgtgcgtccagccgatcgcgagcgtcacggcggcgagcaagccagcggcgagatagctgcgccatcggcctcggagcgtgatcgccgtggcgatcacgacgatcatcagggacgtctgtgctgcggggtcggacgcgacgcccatgagcgaagccgcactcgccacggtgagagttgtccacacgagcgtcgggcgagcggcccgaagcgtcgcgacgagcagcccgatcagggccgcgacgaggatccacgcgacggccgatgctcgtgtgcggttcagcatcgccatcgcaaaggcgaggttcgcgccctcgagaaggagccaggtgagggtgaggttccgcgttgcccgtggtgctggactggtcatcctgctcgttctcctcgagcgcgatggtagccgatgaaggtcgcgatcgcgaaggcgagctcccacgcgccaaggacgacgacagcatggccgatggccttcgcgccgtagaacggggtgagagccatcgagacgatggcggcggcaggggtgtcgacgccgatctggcgtaccagctccggcaatgtggaaagcgggacgaacactccacctgcgaactcgaggacgaaagccgcgacgctcgccagctgcgacgccgtggtcgggctcccgatcgcaccgatcgcgagcgcgccctgggcaaacacggcaccgccgagcagggcgaccccatccacgcagagccagtccgcgagcgggagctgagctccgagccagagcgcgatgccgtcgaggacgagcaggccagcggcgccaagcacgagagcgccgagggcgcgagcgagaaagtaccagcgactcggcgcgacgccaaccgtgctgagggtccggagccatccacggtggcgatcctccgcgaccgcgatcccggcgccggtcatcgcggtgatgccgacgtaggctgcgaggtgagccgtgacgagggcgacgatgttgcccgagccgacgacggtgtggcggtatgcagcgtggtcggcgaagaccacgagcagcaccacggggaccacggcgatgagcagagcactccgccgcgccagcgtctggtgccgaacgacgagttcgatggtggctcgcgcccgagcgagactcgggcgaggggagcggtggccgattgcggtcatgggtgttcctccgtcgtcggatcgcgctgtaggttcagcagtcggcggatcgcctcgtcgagtccgacgggggcgatctcgagcgcagtcgcgccgaggtggagcagttcgtgcgccagcccatcggcatccgtagctgtgaaggtggttcggtcgcgctcgatctcgagcacggcggctccgtagcgatcgagggtgtcggcatcgggttgctcccggagcgtggcgctgacccgcgcgaacccggagcgccctcggatctcgcgaggcgtggcgtcggcgatgagacgtccgtgcgagagcacgatcactcgatcggcgagtgtgctcgcctcggcaaggtcgtgcgtcgcgaggaggagcgcgccgccacggctgcgatgatcctcgaggacggtcgccagggtcgcgcgggcctcgaggtcgagtgccgtcgatggctcgtcggcgatgatcagctcgggcgtgcccgcgagcgcgatcgcgaggcgtacgcgctggcgctgtccgagtgacagcgtctcgaagcgagtgcgagcgagctgcgtgaggccgaatcgtcgtgccatcggggcggtgtcgacgccgcgcatacgtccgagcgcgtcgaggagtgcaccgaccggtgcagatggggggaaacctgcatcggcgaggaggacgccgacggcgtgcgcttggcgagtgagtcgagggggctcgccgaagaggcgcaccgatcccgcttgtggcgtggcaaggccgagcaggcactcgatcgtcgtcgtcttgcctgcgccgttcgggccgacgagcgcgaccgactcctccgactcgatgctgaaggtcacgccgtcgagtgcggtgaagctgccgtatcggcggacgacgttgtggagctcgaccgcggccgttcgggacgtcatgctgggcaacgtaggtcctgggggccgagtgtcggtgacgacggacgtcacgagatcgcgtgacaccggtcacgcgccgcgacccgctcgacctcactgatggccgacgatccgcactctctgagctcggtcgatgcgtcgtcgatcgagcggcgcctcgctggttgggtgggcctccgcctccgcgcagtcgcgcaggccacacgtcctctcacggaccaggttcgaggagtggcccggcgtcgttcgatctcgcgggagccgtgccctctggcgagagctcgaagcgcctcacagagaacgacaaccgaccgtgctccatcgagcgagccttcgttgacccactgaggacaacccaccccgggtgggtgggtcgccgtcgttgcgctgctcggcgatccatgcaagctcgctcccgccacgcggtcgtcacggtgcgagtggtctcggtgtcaggggctagccagcctgggctcgtaccgagggagcacgtggtaagaggtcgatccattgcaagaaggcgctcgcggcaggcagaggggcgctctcggcccgaggctcacttggaccgacggtccgtcgcgaggccctcaggcggtctgggcgcgctcgccgtcggccgtcacggtgcccctgctcgcgcgatggggaggggccatcatccgtacctcgcacgagcccgccgtgccgcggatcgggcgggcgtcgagtgtgccatcacccagcccatcgaggaggccgtcgaggatgcctcgctcggtcgcacagagggcggggtagtgctcggtgaggaggccgaacgggcagccgtgctggcggatcgtctccgtgccgtcggcttcggcggcgaaaccacttcggcgaagcgcggtcgcgacggcccgcatgaccccagaggcgctctcactgacggccgtcgacgcgagcgccgcgccgtgggcgcgtcccacctcgtaggcgatcctcgccgctcggtcggctgggacctcggcaagcaggcctccgacgagagcggcgaggagttcgacctggctctcgaggccctcgaacggtgctcgcgatccctccgcccgatagcgcttggatggtcgaccaacctggtggcgagcaccctggctgacgacggcgaggtagccggcctcgacgagacgatcgaggtggtgtcgtgcgacgttcggatggaggttgaagtgtgccgccactgacgacgcggtcacgtcgtgctgctcgcgcgcccagaggtagatcgcgcgtcgcgtgccgtcaccgagggctcgcgtgaggtcatcgagcgtctgggtgagccacacgcccgttccgcgctccacgacgcctcctcgcactcgctggccgagacggctgttctcgtaccgagggccaacggcgactagtttatcgctgagcgacgtggtgggagggactgtggcacgtgtgacgaccgaggaggtgctcgagcgactcggggagctcgccgacccggacctcgaccagccactcgtcgaccttggactcgtcgatgtcgacatcatcgcacgaaccccgcgcgtcaccgtgcgctacgtgccgggctcggagcaggtgacggaccagctgcgcagcagtgcaaggcagcgtctcgaaccgctcggcgtccagctgatgctcgaacctctcgatgaggagggcctgagctccctcgcggctcgtctcgagtcgacgagtgctcgcgaagcacgtgaggcgcgcaaggcgccgttcgcgagtcccgagagccccacgcgcgtgctcggcatctcgtcgggcaagggtggcgtcggcaagtcgtcggtgtcggtcaatctcgccctggcgctcagtgccttgggccaccgcactgcgatcttggacgcggacgtctacggcttctcggtgccgaagatgctcggcgaagagcgtccgccgcgggtggtggggcagctgatcgtgccgccgaggatccgtggcgtgcgagtcatctcgctcggtttcttcgtcgacgatgcgacgcccgtgatctggcgtggtccgatgctgcactcgacgttgcagcagttcctcgtcgatgtgtactggggcgagctcgactatctcgtggtggacatgccgccagggaccggcgatgtagcgctgagcctgcaggagttcttgccgagggccgagatctacgtggtgacgactccccagcccgccgcccagcgcgtggcacagcgctcggcgatcgccgcccgcaagctgaagctccccgtgcgcggcgtcgtcgagaacatgacggacttcgtggccgacgacggcacgcactacccgatcttcgggtccggcggtggtgacgcgctggcggcggccctcgaggtccccgtccttggacggatcccgttgacgatgggtctgcgtgccggtggcgacgaggggatgccggtggtcgcggtgcgtcctgatgaccccgcggcggcagccattaccgagcttgcggcgcgtatcgtgtcgctcggtgctgctcggcgctaccgcgccgatctgcgcgtgcagacgcgctgaggaagagtggccggtcggccacgatgcgaggaggatacgtgcaggtacggatcgggatcgctcagagtccgcgtgagctcgagctggagttggccgaggagagcgaccaggctgcggtggcccaggccgtcgatgccgccatcgaggccggaacgggagttctctggctcgaggatcggcggggtcgacgtatcggagtgcctgtagaacggatcgccttcgtcgagctcggaccggatcggaaccagcggtcggttggattccgggcctagccgatcatccgcatgggctttgacctgctccgccgccggctgctgatcatcgccggcaaggggggagtgggcaagacgacgctggccgcctcgctcggcctgcttgcggcgtcgcgtggtcagcgcacgctgctcgtcgaggtggatgcgaagggagatctcgcggcccaggtcggcgtcgcgaacgcggggttcgagcccgtcgaggcccggcgcaacctgttcgtcatggagatggacacgcaggctgctctcgaggagtacctgcgtatctgggtgaagctcccgttcatgggtcgactccctggactcgggcgcatcttcgacttcgtcgccacggcggcaccgggtgttcgcgagctgctcgtcgtcgggaagatctgctacgagattcgtgaggaccactacgacctcgtcatcgtcgatcctccggccagcgggcatgtggtgtcgcagctcggggtgacgaccggggtcggcgagctgatcgggcggggactggtgcaggggcagacgtcctggatgctcgagatcctctcggacccggcgcgctcgctggcggtcctcgtggccacgcccgaggagacgccggtcgaggaggccctcgagctcgccgatcgcctgcgcgacgagacgccggtgcacctcggcggagccttcctcaaccgcgtcgtgccggtgacgctcagcgaggaggagctcgaggcgctcgagcgcaccgcgggccgcggtccttcggcactcggcgcggtgctcggtgccgctcgtctctcccagggcattgctcggcagcatgctcgcaaccgcgcagtgttcgccgatgcgctcggccccgacgttccgcttcgggagctcccagagctttttgcgacggtgccaccatcgcgcctcgccgacgaactcgctgaggcgctcgaggtgctcacgtggtgagcgaggccgttcgtgcggtgacggcgttcgagcgcttgttcgtcgtcggggctggtggcgtgggcaagaccacggttggcgcgggccttgcgatcgcgaccgctgtcgagctcgacgtgagcgtcctcgtcatcaccgtggatccggccaagcgtcttcagagcgcactcggtctcgaccatctcgatttgcgtcccgtgcgggtgccgctcgagggactcggcgccaaggggcggctcgaagcggcgagcatcgacatgaagcggacgtgggatgggatcatccggcgctgggccccgactgacgaagtgcgcgatcgcctgctcgcgagccccatctacgaacacctgtcgtcgcgcttcatcgggtcctacgattacgcggcggtcgaggtcctcgccgaggtcctggagggcggttcctgggatctcgtcatcgtcgacaccccgccgtcgcgcaacgcgctcgacatcctcgatgcgcctcgccggctgatcgagttctttcgctcggcgctcctgaagctcctgacgttgccgcggcgtgcgcgagcgttctcgctcgcggcacgcccgttcttcgtggtcgccgaggcggtgctcggctcggccttcctcgaggacgtgacggagttcttcgccgattttgcgacccttgccgagccgctcaccgagcgctctcggcgactcgaacaggtcctcgtcgctcccgagaccggcttcgctatcgtgtcgacgccgctcggtccctccacgagagaggcagaccggctcgaggccgccctgctcgatcgcggactgcgtgtcgccgttcggatcgtgaatcggtgctggccgcccgaggacttctccccggcggccgagcaagccctcgggtggttgcgcagccccgagggcatcgaggtgctgggccgcgaactcggagacgacggggcggccgcacgcgtcgctgccgagctcgccggcctctatgcggagctcgagggtgcctgggctgcccgggctcccgagggagcgggcagcctcgagttgccgctgaccgatgcagcgttgacctctccagaggccctgtggtcgctcatcgcaaccgcgaggatccgaggggtcacctccgagcacgagtagcatgggcggcggtgatcgactaccacctgcacctgtggccccatggtgagcgcgatcgcgacgtcgtcatcgaggagcttgctgcgttctgtgaacgcgcacagggtcgcggtgtcgacgagatcgcgatcacggagcacttctaccgatttcgccaggctggctcggcggtcggtggcttcttccggcgctacccggattcgccggtgcgcgccgagatggagcgctactgggaggagaactcccgggcggatctcgacgcctacgtcgagacggtgcttgcggccaagcgcgagggcttgccggtcgtccttggtctggaggtcgactactacgagggcgccatggaccgtgtcgcggcgctccttgccggctaccccttcgacgtgctgctggggtcggtgcactgggtcggtgcctgggccttcgaccacctctccgaccccatcatgatggccgagtgggagcgcgtcggcgtcgagcccgcctgggcggcctacacccgaagcctcgaggagctggctgcgagcggcgcggtcgacgtgctcgctcacccggacctcatcaaggtcgccggtcaccgaccggaggtgcccgacgagtacgaggcgcgtatggccgaggcggcgcgtgcgtccggcatggttgccgaggtgtcctcggccggtgcgcgcaagcccgtcggcgagatctacccgtcgccgtcgctcctcgctcggttcgtggcggcgggcgtgccattgacgacggcgtcggatgcccatgggctcggagacgtggccgatcgatcgagccagctgcgagccacgctcgaggcggcaggcgtgagcgagctcgcagccttccgggcgcggcggcgtcagtcggcactcctctaggctcgatgaccgaactcaccgccgtgggtcggctcgaccaggccgagcggacggcgctgcgtgagatcttgcggttctggggattcctggccgacctcgcgttctcggacctgttcatcgccctgcccgacggggacgacttcgtcgtcgtggcccaggtccgtccggcgaccacccagaccattcacccgggcgacctgatcgagactcgcctcggtcccgacgaggcgcgacacctcgccgaggcgatggaggcgagggtcatggcgaccgtggatcgctccgacgggactcgcctcatccgctccgccgcgttgccgctcgccatcgaggggcatctgccctacggggtgctggtgcgagagcgcctcgtcgagcactatcgcaccaccggcgaactcgaggcaacctacaaggcgctctacgagcgcttcagccggatgatggtccagggccgttttccgtatccccagagcgacgtcgaagaggcgccgcgcgtcggcgacggtgtgctcgtgctcgatcgcgctggccgcatcacgttcttgtcgccgaacgcgacgagtgcgctccatcgcctcggcgccacggaggtgacctcgggggcggcgctcgccgacgtcggcatcgacgtgctcgcaccggcccgggctgcggcgctcggcgcgcccgtgctcgaggaggtggagcatgcgggcggtgccacggtgaccttctactgcctgccgctttacgacgcgggcgagctcaccgggcacctcgtgctcgtgcgcgacgtcaccgacattcgccagcgcgagcgggtcatcgcctcgaaggacgccacgatccgcgaggtgcaccaccgggtcaagaacaacctccagaccatctcgtcgctgctgcggctccaggcgaggcgcctcgccgaccaggaggcggtcgcggcgctcgccgaggcggagcgacgcatccgctcgatcgcactcgtccacgagttcctctcgcgggacgtgtcggaacaggtggaggtggatgaggtgctggcggccatcggtcgcttggccgaggagtccaagctgccaggacgcacgctcgagctggcgatcgagggctcggcgggcaaggtcgaggcgacctgcgtgacgccgcttgccatcgccctcgcagagctgatccagaactccctcgagcacggctacggcactgagagaacgcacctgcgcgtcgaggtggctctcgagcgacacggtcccgagctctgggtggtcgtggcggacgacggcgtcgggtacccgagcgacctggatgcgcggagcgctcgctccctggggcttgcgatcgttcgagatctcgtggcctcgcagctcggcggcactattcagcttgcgcgaacgcccggcggcggcgcgctcacgcggcttcgagtccccgtcgagcgtcacgagcgctgacgtggacggccccgagggctctggtacgctgggcccgaagcccgctgacggtggcggcatgcggaggaggcgtctcgcgtgaagatcgcggtgtgcacgaagcagatccccgaccctcaaggtcctcagcgtctcggcgacgacctgcggctcgatcgctccggcaaggtgcttctcgacgacgcggactcctacggcgtcgagctcggactccagctcgccgaggcgagcggtggcgaggtggtggtcgtgtcgatggtgcccgaccacgagaccgctggggtccgccaggcgctcgcgatgggcgcggccagcgcggtcgtcgtctctgacgatgcgctccgtggggcagatgccctcaccacggcgacggtgctcgcctcggtggctcgacgggtcggggccgacatggtgctcacagcgacggagtccacggacggctacacgggcaccgtggccgcccagatcgcgggtcttctgggatggcccgccgtgaccttcgccaagggcgtcacgctcgagggaacgcacgttcgggccaaccgtcaggccgaagacggcgtgtgggtcgtcgagtcggagcttccgtgcgtggtgagcgtgaccgcaggtgtcgtcgagccacgctacccctcgttcaagggcatcatgagcgcgaagtcgaagccggtcgagcagctttcgctcgccgatctcgggctcgaggcgcgcgcgacgcagcgcgtcgtcgcggtccaggaggcggcccagcgtgaagcgggaaccgtcatcgaggacgacggatccgccgaagcggctgtcgtcgcgttcctcgagtcgatcaaggtcttgtgaaggaggcgacgtggcaactgcttgggtgatcgcagagcagcgtgatggtgcgctggcgccggtgacggctgagctggtgaccgtcgcgcgcgacgtcgccgatgaggtgcgcgtggtggtcgcgggtgacggtgccggagcggcgtcgtcgctggctgcctacggcgtctcggagatcatcgatctcgggcccctcgacagcgtgctccctgggccggtgcttggggcaagcgttgcacggctggtgggggaggagccctcggtcgtcatcggcgcgcagacctacaccgggcgcgacgcactcgggcgtgcatcggccctgctcggcgctccggtcctgaccaacgccgtcgccgtgcggcgcgagggagaccaggtcctcacggagcaccagatcttcggcggcaccatggtggcgaccgccgcagcggagctgcgcggacacgtgctggtgggcgtgcgacccaagagcgtcgccgccgtggccgcggctgcgccgacggctccctccgtgcgggttgtcgagccggcactcgatgtgcctggggtcgtcgtcacggtggtcgatcgccagcgcgaggagcgcgaggggccgagtctcgacgaggcggccatcgtggtctccggcgggcgcgggcttggcaagcctgaggcctaccagatgatcgaggagctcgccgcactgctcggcggtgcaccgggtgcatcgcgggccatcgtggatgcgggatgggtgccctacgcctaccaggtcggccagaccggtacgacggtcaagccggacctctacatcgccgtcggcatctcgggggcgacgcagcacctcgtgggcatgaagggtgccaagcacatcgtggccatcaacaaggacaaggatgcgccgatcttccaggtcgccgatcttgggatcgtcgcggatgccagctcactgctgccgcgagtcatcgaggctgttcgcgcccgacaagccgcctcctgaccggtcatcgccggccaggtgcgaggcgcgccagtagccgcaccgggccgtgcctgtgctctgtgcgaccacgcacgatgaaagccgccaccaggaggtggcggctttcgcagcggacagtggaggactacgccttcttggtctcccagaagatgtcggcgatctcgttgatcttcgccagcagctggtcggcgatcgccacgtcgttggcacgcttggcctggctggtcagcttcttcgtcgaccagaagagctcgtggagctgcgggtacttctcgaggtgcgctggctggaagtactgataccagagcacatcgaggtgatggttgcactcctcggcgcgctgctccttgatgagcgtcgcgcgatcgcggaaataggggtcgtcggaggcgttgaacttctccatgatggccttgatcgattcggcttcaacgcgggcctgcgcgggatcgtacacaccacacggcaggtcacagtgtgccgagaccgggcgcggtgcgcggaggcgatcgagggcgttgaacatgcgtgcaagcagcatggccttcctttctcctgttggcgacggtgccaaggcacacgccgtagtgcagtccatggccgccgagcccatgatgggacgagaacgcgtgccacgctcagcttagcgagagccatgctcgtgtgtccgtcgaggcctcgggcgtgcacgatgttgggtcctcatcgagccgaggcgggcggggcgtgcgtgttgacgcgtcgtccgcccatcggcgacccaagggcatcgcacagggagtgaggccgagcaccgcgctcccaagctcctgctcgcgggtgggccagtcgggatcgcgggtcaagggaatgctgctctctgactgatgcaccacgacgaggctcatgctccggccgtggcaccgtcgcccggtcgaggtcgagcgcgatacgctgctcgccgagcagccgactgcgcgaccagcgacttcaatgcggagtactggcaatcaccgcacgctcgactgtcggtgaggagacctgcgcctgcggttggacgtactgggtcgtccgaggccagagtcgcgccagcggcggcgttcgatagctccttcaccacttgaagagaggtacacgagcgctagaggtggtgacctgtcgccgcgaggtcgacgaggatgccgacgatggcgccggccaggacgagggccacgaccacctcgacgatgcagccgagcgttcgaagaggatggaggaccacgtgggcaaccaggatcaccgccagcacgatcacgacgatctccacggcgcctcccttcggcagcgacgctagccgttcgacgtcggcaacgagccgagttctcgagcgcgagctgcggtgcgcgacagtgcttcggcgatggcgctccgtaccttcgcgtcctcgagtgcacggatgccctgggctgtcgtgcctccaggagaggtgaccgcgagacgcaacgaccgaggctccgtgccgcgcgcctccgcgagcgcgatcgtgccggcgacggtcttgagggcgaggtcgagcgcgagctgcgcggggatgccgagggcgatcgccgcctcctggagagcctcgacgacgagcaggacgaacgccggtccggagcccgacagcgccgtgcccgcatcgaggagggactcgtcgaggcgataggccgctccgagtctgctgaacagcgcgaccgcttcctccgcgagggcggcgtccgcctgtggcgacgtggcgacgagtgtcacgccgcggcgcaccgcgagcggtaggttgggcatcactctcacgacagctgcggcacgagggaggagctcgcgtaggcgagcggtcggcacgccggctgcgatggagatgaccctcgatccgggagcgaggctctcggcgacgcccgcgatggccccgggcttgacggcgaggatcgtggtcgttgcctccgccgaggcagatgcggcctcgatgcgcccgtcggagcttgtgagggcggcgatgcggtcgcggtcgacgtcggcgacgccgatgcgtgggggctcgccacgcatcgtggcctcggtgccgtcatcgaaggaggcgagcaagccctggacgatggacgaacccatcgctccagcgccaacgacgaggatatcgagcacggctggagcttaggcgcagctcgcgcaggcgtcgagaggtgtggccgacagatcggcgagcgaggtgaggaagtcgttcgcggtgtgggcccaggtgcgtccgcgcgcgcgtcgcgcgccacgctcgcccatgcgcctcgccacgaccgggtcacggagcacgagggccatgcgatcggcgaaggcgcgaggcgtacgttcgtcgaccaaggctccggtacgaccgtcatcgacgatctcggcaagtccgccggtccgcgtcgcgacgaccggcgtcgcgcacgcaagcgactcgagcgcgacgagcccgaacgtctcgctctcggaagggacgagcgtgaggttggcggcgcggtagtaggtgcccagctcgatctgggggcgtggtccgacgaggtgaagccggtcagacgcacccgcgtcctcggcgagcctacgaacctccgcgaactcgcggtctccgtcgtccccggatgggccgccaacgacgacgaggtggctccgcgggtcgtcgagttcgagccacgacgcgaccgcaagggctgtgcccttgagcgactggatgcgcccgacccacaagatgaccgatgcatcgggggggaccccgatggcacgcctcgcaggccctcgtgagagggtcggggagaagacggcaggatcgatccccggttccacgacgacgagctggccgcgaggcggaccatagagcgttcgcagccacgtcgcctcggcccggctcgaactcacgatgagatcggcgcagccgagcacgcgttgctcttgatagacgcgggcctcggtgaggtgactcggaggttggccgagacggagcttggcacgctcgagggtgtggaacgtgacggcaagcgggagcccgagctcgtgcttggcgctgtgggccacgacggctgagagccaatagttcgcgtgcaccgcgtcgatgctcgtactgcggtcgagcgcctcgagcacacgttcggcgaagtggtcgacacggcgggtgaggtcgcgctcgcggtcatcgtcgctgagtgcatgcagccagagccctggttcgatgcgatgccgaccgggcacgtcgtgtgcgccggtgaagatgtccacctcgtggccggagcgagcgagctgggtcgcgaggttgcgaacgtacacgctcatgccgccgttcgctcccgctcccggtgtggcaaacggggaggcgtgataggcgatcatggcgatgtgcaccagatggctccctcctgcggccagcgtaccgagccaacccgccgatgcggcgtcctattcctcctcgctgcctggcggcggcggaagctcgaccccttcgatgctgccaactgcgatcggttcgccgtcggcgacgattcggtcgatgagtgcggcgctcaccgcatcgagggcgctgtggaggcgccggcgaagctcggagagggtctgctctgcctggcgctgacgagcttcccaggcagggcgctcggtggcactcacttcggtcgcgacgcgtgggccggcgaggtcgttgatggcctcctcggcgagcgcgatgtcctcttctgacagcgagagctcgacgtgacgacgggcgagtggcggcgagggcaggttggagagcgcgagctgacgggcgaactcctctccgcgggctgggccgagcgcaagcgcatcgagtcgcgtctgaagctcgcgtcgcgcgaacgagacgacgttctcgagacgcaaaccacgaccacggagcgcgacgagggacgctcgatcgcgtccgtcaaggtgtgcggacgcctcgatgacctcctcgaccgcgcgttcaagctcggtcactgccaccccccttcgatgggcagcgtcagcctagctcgggcccgccggcgcggcgcgggttgtgcggggaggtgcatgtggctcgctcgcgaactcgaccacgagaccggaagagcccgtcgcctcgatcgtggtctcgcccctgcgacgctccaccgtcacggtcgtcgtgtggtcgccgatctgaagattggtgagcgtgatcctgtccagccaggcgggcagcgctgggcgaacggtgagggtgcctgccgccgcgttcggtgcgagcccgagcagcgcagcaacgatcagcgcgaaagctccggcggcccatgcctggggggcgttggcgagtcgatagggacgagggtaggcgccagcgtcgcggtcgacgccggtgaacagctcggggaggcgaccgcccgcaaagagggtgccggcatcgagcagtgccgtcgcgagcgcgtgggcatggtcggcgagcccgtaggccgcgagtcctgcgatggcgatggcgttgtcgtggggccacaccgagccgcgctggtagctcagggggttgtaggcaggatggtttgaggagagcgtcctcagcccccagcccgagaagaggtcgggtgcgaggaggcgatccgccacggcgcgagcccgctccgggctcggcacctgcgcccagaggaggtgcgaggggttcgacgccaccgagtcgatgggtcgcttggcgccgtcgagtccgagatagtaggtcgactcctcgggccaccagaagcgttcctcgatggcctcgaccagtcgactcgcctcctcgcgcaacgtcgcggcgcgctcgaggtcgccgaatgcctcctcgagtacgttggcccaggctcgcttggcggcaacgacgtaaccctgcagctcgaccagggcgatcggtccatcgacgacgctgccgtccccctggaggatgccgtcttcggcgtctcgccatccctggtgccgatacccagtcgccgagcggggcgcatactcctgcaggccatcgccatcgcgatcgccatagcggtcgatccacgcgatcgcagcctcgacgctcgggccgagccgcgcgaggagcgctcgatcgcccgtccagcgccagagctcgccggccgcgatgacgaacagcgaggtggcgtcgtgcgtcccgtagtacggagtgtgcgggatgagctggagttcggcgagttcgccttggcgcagctcgtgcgggatcttgcctggttcggcgtcgcgtgtcgggtcgtccgtggtcgcctgaacgctggcgagggcaaagagcgctgcctggaggaactgcgtcccgagcatgacggtctcgagtcccgtccagatcgagtcgcgtccgaacagcgcgacgaaccatggcaccccggccgcagggatccagggcaagatgtccgggtgcgcgccgaggccagcgccctcggcactcatgcggagcgcgagcaggtcgtcgaccgagcggcgcatgatccgctcgagcctggtgttggaggtcgtgacggtggtgaggagccgacggtcctggtggagcttctcgagcggcgcgaccagctgctcgcacgcgtaggtcgggctcctcagcgtcgtgaggcgcgcgtgcaggcgcaggcagatggacgtctcggctcgcggctcgagggcgatgcgtacgatcagccgaccgttcgcgtactcgggctgtgcgggagcctcggcgacctcgacgacgagcgcacgtgcgaacgcgccgttgcgataggtcgtctcgaggcggcgggtcccaggatcccacgtggtctggacggagccacggcgcgcacgccgaccgctgcgcacgtcgaagatgtccgcgaagtcgctctcgatgccgagctcgaggtcgacgctgatcggcgagagcgaaaagttctcgatgagcaggtcgtcgtggatgcccggaccgatgacacggtcgaggcgaatgcggagatctccttcgtcgagccggtggttcaccagggtgagggttgggttcgtgaactcgaggcgagctgcgcgaggtccgagcgctgcgccctcgacgaggatgagcggtgcggtgccgagcgtcagactccaaccggagagcaggcgggtgtccttgacgaagtagccgcgctcgcgttcacgatcgatggatccattgcgtgcggtgaccaggatctcgtcgtcgtcggcgagcgtgatggtttccgagccgagccagtcgacggtgggaaggagctctctcacgcgccggctcccgtgacgcgcacaggtgcgatcgggcgctcggcgatgatcgatcgatagagccggaggtgggcctgcaccattgcctcggccgagaagtgttcggcgacccagcgtcgaacggccctgcgatccaaggtggcggcgcgctggagccggtccgcaaggtcctcgacgcccgtcgccagaaagccggcgacgccgtccgcgacgacttccggagccgacccgatggccgttgcgacgaccggcgttcccgcagccatcgcctcgatcatgaccatgccgaacggctcgggccaggcgatcggattgaccagcgcgatcgctccgcccagcaacgccagcttgtcgctgccgccgacctcgccgacgtattcgacgtcagcaccgaggagcggtcgaacggcggtctcgaagtaggcatgctcatcgggttcgcgcatcttggctgcgatgcgcagggggatcccggcacgtcgtgcgatctcgactgctgcgacgacgcccttgtcgggactcatgcgaccgaggaacagggcgtagccaccgtcaccgcgtcccatcggtaccgcatcgatctcgatgccgtggtggatgacggcggcgatccgcacgccgagggcgagttgggcctgtgcatgggaaatggcgatgacggggacggtggcgctcacgtgccggtagtaggtcgccatggcaccgaggaacggtgcgtggttggtggtgacgatgggagcgctcgcaaggcgcggcccgacgaggggaccgacgagcgtgtggtcgtggatgatgtcgacctcgcccagctgggagtaggcctcgaggacgtggaccgactcgttgatcggcgttgcctggtcggtcccgagcgcccatggcgtggcgcgtaccgtcggcacggggcaggtggcatccccggtcgtcgcaagcacgacgtcgtgtcccgctgcgtggaggccgcgcgcgagcacgtcgagcaccgcctcggtgccgccgtagcgcggtggtgggaccggcacccaacatggggcgacgatcgcgatgcgaaggcgtctcgggacgtcgtcaggtgccggccgagcggcgagggcgctcgcgtcgtcgggcgacacggtcacgcggtgcccggcgtgactctcaggagtgatccccacgggactcgcgttcctcctcggttcatgctgcacgcacgtggaccgacggacgactacgtcggcacagcgctgtgaccgactctgtggtgtccagcctactggcgcgcggaagctgacacgagcgacggcgtgctggtcgagcggccgagggcggtgcggacgcggctgccgaggtcgccggcgcgccgcaggctcgtctcgaccgagggtgggagcagattggccatgaccgagacgaccggggccatagtggcccggttgcgcatcgcgagccagacgcccggtgccatgacgcgagggtcgctgatgaggcggacgaaccgtcggccgagggcgtagtaggtgccgtagtggccaccgagcagcgccgggtagcgcgtgagtggatggtcactgtcggtgcggcgagcctcggcgatgagggttgcggcgaggcgcccggtctcgagagcgtaggagatgccttcgccgttgaaggggttgatcgtcgcggcagtatcaccgacgaggaggtagttcgacccctggactggcttgatcgtggtgcccatcgggagcttgccgccgacgggcttggcaaggagcgggtgctcgacgtcgagcccccaacgatcgcgcacgcgatcgacgaagcgtgcgagctccgtcgtggtgttgacgtggcgccacgcaccttggttggtgagcagtccgaagccgatgttgacgctgccatctcccatggggaacacccacccatagccgggcatcacgcgaccgctctcgtcgcgcacgtcgagcgctgactcgatccacggttcgtcggatcgcgacgaggggagataggtgcggatcgcgagcccgaggggctggctggtgtcgcggatcgcgccgagcgaccgagcgaggcgcgcattggacccttcggcgagcaccacccagcgcgcacgcacgcggacgacggcgccatcgttcgtccgacgtgcgaggaccgcgctgatgccgttgccacgtcgttcgagttcgatgccctcgtggccgaagagcacggtcgcgccccgatcggccgcggcgccgacgacaagcgcatcgagctcgcgccgacgcgcgacgaagccgtaggacggcaggagcgggtggttcggccacgggatgtcgagcgttcggccgaacgcgacggctcggagcccctcgtatcgatggaagcgggcttcgagctccgctccgaggcccagcgcttcgagctgcacgaccgagcgaggggtcaggccgtcgccacagaccttgtcgcgggggaactgcttgcgctcgaggacgacgacgtcgatgccgcgcatcgcgagccaatgggcacagctcgcaccggaaggtccgccgccgacgacgacgacggtggtggagacctcttcgtcaactgcctggaccacgatctcaccctagtggcggcccaacgggttctccggggtgacgccgatcaccctgacgctcccccacgtgcgcatgggtcggggccgtatactgcccacgaagaggccggatttgcagcatgcgtcctccgtgtccatcatggaggcgcagctgcgtgagcgatatcgagttggagcgaggtgcgatggcccagtacctgccgatcgggatcttgctgatcatcggcgtgctctttggagcaggatcgtttctcgcctccgggttgcttggaccacggcgtccgcaccgagccaaggcagcgccgtacgagtgcgggatcgtgccccgtgtcgaccctcccgaacgcttcccggtgcggttctacctggttgcgatgatcttcatcatcttcgacatcgagatcgtcttcctctatccgtatgcggcagcagcgggctcgctcggcaccttcggcgtgatcgaggttgccggcttcgcggtcgtggtgttcgtcgcctttgcctacctggtctccaacggcgcgctcgactgggtgcctcggcgtcgggtgcgggcccatccgccagaagtccagcgatcgctggaggcaccggctcgcgcggggagtcggtgagatggcgctcgacgacctgagctacaacttcctgacggcgcgcctcgaggacctcgtcaactgggctcgcaagtcgagcgtgtggccggccaccttcgggcttgcctgctgcgctatcgagatgatggcggcaggggctgccgacttcgacctggctcgattcggaatggaggtctttcgtgcctcgccgcgccaggcagacctcatgatcgtcgcggggagggtgtcgcagaagatggccccagtgctccgccaggtctatgaccagatgcccgagccgaaatgggtgatctccatgggcgtgtgtgcctcctcgggtgggatgttcaacaactacgcgatcgtccagggcgtcgatgagatcgtccccgtggatgtctacgcgccgggttgtccgcctggccccgagacgctgatccgtgcgatcttgaccctgcacgagaagatccgccacacccccatcctgcggcggcgtggccaggacgagcccgtcgcggagttgctcgcccggccccgtttcggcacgggggaggcgttcgcgtgagcggcgtcgtccggcacgtcgcacgtgaggactggctcgagacggcggaaggcttgcgtgcggacgggttcgtgatgctcgccgatctgacgtgcgtcgactatctcgagggggttcgagaggacctccccgaggaggtcgtgcgggagcgtttcgaagtcgtcgccgtgctgcggcggatggacccacctgccatggtgcgccttcgggcacaggttcccgacgacgatcccgtgatcgactcgctgtggtcggtctatcccggggtcgaggcgttcgagcgcgaggtcttcgacttgttcgggatccactttcgcgggcatcccgacctgagtcggatcctgatgcccgaggactgggaaggtcatcccctgcgcaaggactatggcgtcggccgcgtggcggtgcagttcaaggaggtgcgtcgacaccgatgacgtcgtccatctacaccgtggtgcggcccgacgaggaggcagaggccctcggcttggtcgcggagacgtacgaaggctcccaggagctgacccttcgcggtgccacgtcggccgcggagctcgagcgagagcagggcgcggtgctccgggttcccgagagcgaggtcgatctcgaggggtttcgaagccgacgaccggatgatcatcaacatgggcccccagcacccgtcgacccatggggtgctgcgcatcatgctcgagatcgagggcgagacggtgctgcgttcgaagcctgtcatcggctatctccacaccgggatggagaagacggcagagacgctgacctacctccagggcacgaccaacgtgacccgtatggactatctgtcaccgctcaacaacgagctggtgtactgcctcgcggtggaggacctgctcggtctcgagctgccggagcgggcgatctggatccgcatgctaatgtccgagctcaatcgcatcgcctcgcacgtcatgtggatggcgaccaacggcatggacctcgggtcgacgtcgatgatgatcttcgggttccgtgaccgcgagatggtgctcgccttcttcgagaaggtgaccggcctgcggatgaacaacaactacatgcgacccggtggggtcgcggccgaccttcccgacgggtgggaagacgacgtctcggcgatcgttgacaccatcgagcggcgcgtggaggagtaccacgagctgttgaccggtcagccgatctttcgcaagcgcgtggtcggggtcgggatcatcaagcccgaggaggcgatcgcgctctcggctaccggtccgatcctgcgctcgactggagtcgcgtgggatctgcgtcggtcgatgccgtatctcgcctacgaccaggtggacttcgacgtggtcgtcggcacggtgggcgacacctgggatcgctacatggtgcgcatcaacgagatcttgcagtcgatccggatcgtgcgccaagtcgtcgagcgcatgccatcgggaccgtatcgagcgcaagatccgaaggtcacgccgccgccgcgtgcgcgtatcgatgagtcgatggaggcgttgatccaccacttcaagctctacacggagggcattcgggtccccgcaggcgagacgtacgcggcgatcgagtctcctcgtggagagatcggttgctatctcgtctcggacgggtcggcgcgtccctatcggatgcacatccgagggccgtcgttcgcgaacctccagagtcttccggtcatgctgcgtggcgcactgatcgccgacgcgatcgcgatcacgagttctgtcgacccggtcatgggggaggtagaccgctaagtgggacggttcgagggcgagttcgcggcacgtgccgaggaactcgtcgggttgtatcctgagcgtcgctccgcggtgctgccgctgtgtcatctggcgcaagagcaggacggttggttgacgcccgaggcgattcgtcacatcgccgagctggtcgggcagaccccggccgaagtgcaaggtgcggcgtcgttctacgacatgttgcacctcgagccggtcggtcgttacgtggtcgggatctgcaccaacatcgcgtgtctgctgcgcgatggggaccgcctgctcgaggccgccgaggagctgctcggcgtgggcgtgggcggcacaacacccgacgggctgatcacgctcgaagaggtcgagtgcgtcgcgcactgcgacaaggcgccggccgtgcaggtgaactaccgctacttcggtccggtgacgccgacgagcttcgaggagctcgtcgggcagctgcgccgtggtgaactcgatggggaggtgcccccgcacggggtcctctcgcgagtgcgccgtgcggccccgccgccgatcccactggatgagatcgacgccgagcgggcccgccaagacgcggagcgcgccgaacgcgctcggcaggcggagagcggatcatgagcgcgccgtcgatcgtgggcgcgaggctcggctacgaggactcgtacaccctcgagcgctttctggcaaccgacggcgacgccgggttgcgcagggcgctgctcgagctgactccggagcaggtgcacgccgaggtcctcgaggccaacctgctcggccgagggggcgctggattcgaagcgggccgcaagtggtccatgctgcgaaaggccccgcgtcgctacctcgtggtcaacggtgatgaatccgagccggcaaccttcaaggatcacctgctggtcgagcgtgatccacaccagctcgtcgagggggcgaccatcgccgcctatgccatcggggcctcggtcgccttcatctatctccgaggggagttcgcactcggtctcgagcgggttcagcaggccatcaacgatgcctacgcacgcggagcgctcgggcgcaacatcttcgggtcggggttctcgctcgacattgtgctccagcctggtgcgggcgcctacatctgcggcgaggagacggcgctcctcgagtcgctcgagggcaagcgaggattcccgcgcatcaagccgccgtacttcccggcggtgatcgggctctacggagcgccgaccatcgtgaacaacgtcgagacggtgtcgaacctcccgtggatcgtgcggcacggaggagccgccttccgcgccctcggtgcgggccgctcgacggggaccaggatctttgcgttgtcgggaagcgtgcgccgtccgggtgccttcgaggtcgagatgacgagcgtcacgtttcgagaactcatctacggtgacgcctacggacagggtctcgagccggatcgcgagcttcgagccttcatccctggtggggtgtcgtcgccatggctcttccccgaacacctggacctgccgctcggtcaggacgaggtggccaaggccggctcgatgctcgggtcggggtcgatcatcgtcatggacgacggcgattgcccggtgagggcggcgtggcgaatcgcacgcttcttcgcacgcgagtcctgcggtcagtgcactccctgtcgcgagggtggcacctggatcgagcaggtgctgcgtcgcctcgagctgggctacggacgcgaggaagatctcgacctgctgctggatgcgtgcgacaacatctcccctggcgttacctggccgccggcccagacgaccatctgcgtgctcggcccctccatccctccgtccgtggtcgcggcgatccgtcggttccgcgacgtcttcttgacgcatatcaaggaggagcgctgcccctatgactgagcaggccagcaccgtcaccataaccctcgacgggaagtccgtcaccgttccagctggcgtcaagctcatcgaggcactcgaggccgtcggtacctacgtgccgcggttctgctaccaccctcggatgcgtcccgtgggcgtgtgccggatgtgtctcgtcgaggtgtcgggccctcgcgggttctcgctgcaacccagctgcttcatcgacgtcgccgaccagatggaggtgcgcaccacgagcgagccggtgcgcaaggcccagcatggcgtcctcgagtttctgctcctcaaccatccactggactgcccggtctgcgacaaaggtggcgagtgccccctccaggaccaggcctttgcgcatggttcgggtgagactcgtttcatcgaggagaagcgccactatcccaaaccgataccggtgtcgccgctcatcctcctcgaccgtgaacgatgcatccagtgcgatcgctgcacccgctttgccgacgaggtggccggtgacgcgaggttggatttcgccggacggggcaacggattgcgcgtcgcgacgttcgagggcgagggcttcgagtcggtgtttgccggcaacgtcgtgcagatctgtccggtcggggcgctcacggccacgccatatcggttcaaggctcgtccgtgggacctcgccgaggcagcctcgacgtgcacgtcctgctcgatggggtgccaggtcgtgctgcagtcgtcacagaacgagttgacccgggtcctcggggtggacgcggaggcgatcaaccagggttggctctgtgatcgtggtcgcttccaggttgcggcggtgaacaatcgcgaggagcgtctgcttgctccgcgcatcggggccgatcgcgcgagttgggctgcagcgctcgatgcggtcgcaagcgcgatccaagaggccgtcagccggcagggcccggccgccgtcggcgtgatcggtggcgatcgactcagcctcgaaggccagttcgcctgggctcgcctggcccgcagttcgatcgccacgccgcgtgtggacggggtcgccggttcgttggtcgaccccaatctgtggctggatcgcctggccaccgtggacgcgatcgacgacgccgaggtcgtggtgaccattggtgtcgatcttcgcgaagagcttccggttgcctggctccgccttcgacagcgggcgctcgccggtggtgcggtcgtcgacgtggcccctggaccgacgagtcagggcgagatcgccacggcgcggatcgtcctggatcctcgtgatcccgaggcggccatccgggaggttgcacaggtcgtcggcgatcgccgtgcgctggtcatcgtcgggcagtccaatccgctgctcgactcgcggacgcgcgtggggctgtatgccgcactcctaggccggctccccgcgtcgacggtgctgccggtccatcggtccggcaacgcggccggggcactcgtggcggggctgtcgcctggctggtggcctggtctcgtggccgggccggtcgctgggtgggctgagagcgcgggccacgacgtcaccgatatcctccaggcggcgcgtgtcggcgctctgggcgtgctcatcgtgctcgaccgagacctcggcgaactcggcctctcggacgcagagatcgagacgctcgctcgcagcgtgaccctcgtcgtggcctcgagcttcgagacggcgacgacgaggcgcgctgcggtcgccctcccgatcgccgcctggggcgaggagcgaggcgtgaccatctcggccgagctgcgccttggtcgcctcgcggctcaagtggagccgatggaacaggcgtggcccgcctggtcggtggcggaggagctgcgcgcacggctcgaggtgggtccggtcgccgttgccgtcggtgaggtgttgtcggcgctgtgccatgtcggtggcgtggtgacgactcacgacgtgcatctgctcggccagcgcgccgacggtccgctgttgccgtcggcagagcgtggcgacggatcgccgccgcggctgctcgaccccatggggacgcccggcatcgcctcggtgcgtcgtcaggccccagacgtccggttgggcaacgccctcgacccggcgctcccggcaccctcagccggggtgcggcgcgcgtcgctcgccaccgctgccgccctttcgaacgacctggttggcgcgacaggctcggggttcgtgccttggatcgcgagtgcgctctatggggacacccccgacgtcgtcgcaaacccgttcctcgctccgctccggcgccaggcgcgcgcgcggctggcgccatcggatgcgtcgcgtctcgggctcgagctcgacggtgcgacggtgcagatcggcggccgcgtgagcctaccggtcgcactcgacgacgacgtcgccgaaggggtggtcgtgatcgagggcatgccgagcggttggggtgagctcgctggccccggttggagtctcgtagaggtggaggcgctgcatgggagctgacccgctcctcgtcggccacatcgggtggatcgacgtcctcatcgtcgtcatcaaggtcgtcgtggccttcgcggccatgatggtgtcggtcttgctcgcgatctgggtcgagcgcaaggtgatctccgacatgcagaaccggataggtccgaatcgtgcgggaccgttcggcctgctgcagagtctcgccgatggcatcaagctcttcttcaaggaggatctgatccccgagcggtcggatcgtttcatcttcaagcttgcgccgtacctgtcgttggtgccggccttcttgacgttcacgatcgtgccgatcggtggcgtggtcgatctgttcggtcaccggaccgaactccaggtcgccgatccgccgatcgggatcttgctccttctcgcgatgtcgtcgatctcggtctacggcgtgatgctcgcgggttggtcgtccggctcgaagtatcccctgatcggttcggtgcgtgcctcggcgcagatgatctcgtacgaggcggcgatggggctctccatcgccgcggtggtcctcgtgacgggctcgctctccacgcgcgacatggtgacgggccagctcggcacctacctcggcttcatcccgcactggaatctgatacggctcggggtgatcccgttcgtcatcttcatcgtggcgatcactgcggaggtgaaccggccaccgttcgacctcgtcgaggccgaacaggagctcgtgggtggattccacaccgagtactcctccatccgcttcgcgctcttctacttggccgagtacttgaacaccatcaccatgagtgccatcatggtgaccctgttcttcggaggcccagacggccccgatccgcacgtgttgcactggctctggccgatcgtgtggttcctcgtcaaaacgtcgatcttcttcgtgatctacgtgtggttccgtgccgcgctcccgcgcctccgctacgaccagctgatggatcttgggtggaaggtcctgatccccgtctcactgctgtggctgctcgtcgtggcgggtatgcgggcctcgcgggtgctcggtttcgtgctgctcgtgctcgggctgatcgctgcgggagtcttgctccgcgcgatcgatgtcggccgacgccgccgtggccagagcgcgcccgtgcttcccgatctcatggacgcatcgatgctggggccgagcccgatcccggccatggtcgaggaagggtcgaccacagcggaggaaggggatgacgatgggcgtgcttgacgcactcgggggcttccgcctcaccctccgacaagtgttcgagccgcgggtcaccttgcagtacccagaggagaagcgcccgaagccgccgcggttccacggacggcacgtgttgaaccggtatccggacgggatggagaagtgcatcgggtgcgagctctgtgcgggcgcctgcccggcgcgctgcatctacgtgcgcggcgccaacaacgacccggagaggccgacctcgccaggggagcgcttcggcttcgtctacgagatcaactacctgcgctgcatccactgcgacctgtgcgtcgaggcctgtccgaccgaggcgatcacagagtcgaagatgttcgagttcgccttcaccaaccgtgaggacgcgatctacaccaaggcggagctcgtcgtcgacgacgagggtcatccaaggcgccagccatgggaggactggcgcgacgaggatgaacgctggacttcggcctgggttcgggcgacggctccgggaggcgatccggccttcgagggcgtcgtcggttggtcgccagaactcggtgtcgggacgcgaccgccggagcgtggccagtccgaccttccggaagacgaggcgacgcccgtgttctcgttgcgagcgattctggcgtcgcggatcttccgtcaacacggggggagggcttggtgatcctcggtgtcgtcggggtggtgaacctcgttgtgttcgtggtcgcggtggccgtggtggccatcggtggcgttgggctggtgagcgcacgccagcccgtgcacgcggccttgttcctcgtgttgacgctcttcggcgttgcaatcctgttcattcaggagggagcgcagttcctcgcggccgtgcaggtggtcgtctatgccggcgcggtcgtcgtgctgtttctcttcgtcatcatgctgctcggtgtcgaccgtgtcgaggtgagcagcatcgtcggcagcggttggcgggtctgggcagccggcatcggcgtcgcagccgtcctcgtcgagctgggtctgctcgccatcggccatgaggtcaccggcgcctccagcctggcgggcaagctctcggcgggatcgaacctcggtgtcctcgctcggagtgtctttacgacctacgtgctgccctttgaactcacgagcgtgctgctcgtgatcgcggtgatcggcgccgtggtgctggcgcgaaggctccgccagcgatcggacgcgacgacggtgagccgaagcgaggaggtgcacccgtgattccggtgagctggtacctcatcgtcggggcgctcctgttcgggctcggggccttcggcgtcttgattcgacgcaacgtcctcgtgatgttcatgtcgatcgagctcatgttgaacgccgtcaacctcacgttcgtgtcgtatgccagggcactcaacgacgtcggcggcgaagtcgcggtgttcttcgtcctggtcgtcgccgcagccgaggtggtcgtcggcctcggcatcatcgtggcattgttccggcgacgtgcctcggtcaccatcgacgacatcgcgcggttgaagggttaggtcggcatggatctcatcaccgctgtcatcgggtttccgctccttggcttcctcgtgctccttgcgttcggcaagcgcatcggcgagccgcgcgctggttgggtcggtaccatcgcgaccacgctgtcgttcgtcgccgcgctcgcgctctggggcgtcgtgctggcacgaccggccgacgagcgggtcgcggtcgtccgcctgttcacgtggtttcgcgctggccccttggtggcgcacatctccttccgcgtcgatgaactcaccgtgttcatggtgctcttcgtgaccggtgtctcgtcactgatccacctctactcgatcggctacatgcatcgagaccccaggttccaccagttcttcgtctatctgaacctgttcgtcttctccatgaccgtgctggtgagctcgaacaacttgccactgaccttcctcgggtgggagggcgtcggcgcgtgctcctactggttgatcagcttctggttcgagcgcccctcggctgcgagcgccggcaagaaggcgttcatcgtcaatcggatcggcgatgcaggcttcatcctcggcacggcgctcatcgtggaccatctgcactcggtgagctactcggtgatcctgcccgaagcccatcggctctcgagcggcacgctcgaggcggtcgcgctgctgttcttcctggcagcggtcggcaagtctgcccagctgccgctgttcgtgtggctactggacgccatggagggcccgacaccggtgtcggcactgatccatgcggcgaccatggtgaccgcaggtgtcttcttgatggcgcgtctgtcggcgttcgtgactcccgcccatgacgccgccacggtcatcgcgtggatcggcgcgatcacggccttcgtcgcggcgatggccgcgacctcgcagcacgacatcaagaagatcgtcgcgtactcgaccgtctcgcagctcggctacatgatgctcggcatcgggaccggtgcctacgtcgcggcgctgtttctgatggtgacgcacgcgttctacaaggcgttgatcttccttgcctccggttcggtcatccactcgctcgatggcgagcaggacgtgcgtcgtatgggtgcgctccgtcgcttcatgccgatcacggccgtcaccatgatcctcgcgtggctctcgatcgcgggggtacctccgttctccggcttcttctcgaaggggtcggtcctcgaggcagcctttgcccaccagccggtgctgtgggcgatcggtgtcgtgaccgccgtgctcaccgcgtactacatgggtcgactcgtctacgtcgtgttctacaacgagccgcgctaccaggaggtcctcggcgagcggagcccacacgagtcgccccgagtcatgacggtgccactggtggtcctggcggtggccgcagtgctcggagggctcatcaacctgcccttcgggagcttggacttcctcgatcgattcctggcgccggtcttcggcccttcgctcgttgccgtgcatctgtcgggcgtcgctcgggcggcgctgcttgcgaccgatgcggtcgccggcctcctcggcgtcgggttggcgtggcagctctggggccatcggtggcgtcggcccgagctcgagccgatggtgctccagcgcggttggtacgtggatgcaacctacgaccgcgtcatcgcgcgtccgatgaccgagctcgcgctcgaggcggacgaggtcgtcgatccgaaggtgatcgatggcgcggtgatgagcgtcgcgtgggcagctcggcgaatcggtggcctgggccgacgggtacagaccgggctcgtgcgcagctacctgttgctgatggtggccgggatcgtcgtggtgatgggctacgtgctcgcagtggcgacacgttagagaggcggaagaggcatgacgctgctcgactggttggtcgctgtccccgtgatcggggcgctgatcgtaccgatgatggcgttgccgcgggagcaggcctggttggtccgtgccttcgggatcgccatgtcgatcgtggagctcggcatcgccgtcctgctcgcggtgcggttccacatcggtgctccaggcttccaagacacccaggacctgcgctggatgggtgcgctcggcgtgcactggtatctcggcgctgacggcatctcgttggtgctcgtcatcatgacggcggtgctcttcgtcatcgcgatggcggcgatcaagggcgtcaccgacgttcgggcctacgtcgggtggatgctcctgctcgaggcggcgtgcatgggctcgttcgtctcgctcgacctcctgctcttcttcgtgttcttcgaactgtcgttggtaccggcctacttcctcatcgcggacttcggcttcctcgggtcggggcgtgcggccatcaagttcttcgtctacacgttcgcggggagcgcgctgctgctcgtcgggatcattgcgctcgtcgtcatccatgaccaccagacggggaacctgacgttcgcgttgcccgccctcgagcacacgcggctggctgcgagcacgtcgctgctcctcttcttggccttcacggcagcctttgccgtgaagaccccgatctttccgttccatacctggtcaccggacacctacgcgaaggctccgatccctgccgtggtgatcgtcgctggcgtcatggccaagctcggcagctacggcatcgtgcgtttcgacctcgggttgttccccggcacgtcgagacagctcgcgtggctcatgctcaccctggcggtcgcgggcatcctctggggcgcgatcgtggcggcgggcgagcgacacctgggtcggctggtggggtactcgtcgctctcgcacatggggttcatcgtcctcgggatctttgcgttctcgaccgagggtctcgcaggttcggtcctgcagatggtcaaccacgggatctacaccgcggcgatgttcctcctactcggcatgatctacgaccgctccggcacgctcgatgcctcgcggctcggcggactccagcggcacgcgccggtgctcgcgggagccttcaccgtggtggtcatggcgcaagccggcttgcctggcctgaacggcttcgtcggcgagttcctcatcttggtcggtacgttcgtgacccatcgctggtgggcggtggtggcggtggccggcgtcgtcggttcggcggcctatctcctctgggcctaccagcgggtcttccaccgcgcaccgtccgaggaccgggtcgtacacgacctgcagtggcgcgaggtcgccctcatcgcgccgctcctggcgatcatcgtgttcctcggggtctacccgaggccggtgctgtcggccattgacccagcgacctcggcgatcgtggcacgcgcgaatcgggcgccactgccggtggcatcctccacgccgaccgctgtggtttcgacgctcaccccgggggtgcggccatgaacgtcctgttggcgagcatcgtgtcccagacgccgatcgtgctgcctcgcatcagctacctcaccatcggtccagcgctcgtgctctttggcggagctctcgtggtcctgctggtgtcggcgctcctggtgcgcgcacggcggcccgagctctatcgttggctggcgctcgtcgcggtcgcgggcgagatcgtggtggccacggcaggcctgctccacgtcgacgcacacggcgcctccctcgcggtggcgggtgcgttggcctccgatggcttcgggttcgtcgtcgccatcatcgtcggtgcagcgaccctggtcgcgctgctcatcgggccgagtttcgtgcagcgcgagcacggcggcccggagtacgctgcactcagcctgatcgcggcgagcggtgccgtggtgatgggacaggcgaacgatctgctcgtcgtcttcctcgggctcgagatcctctcgatctcgctgtacgttctcgtcggcttccgtgtgggtgacggggtggcgcgcgaggcggcgctcaagtacttcctcatgggcggctttgcctccgcggtgctgctctacggcatcgccttgatctatggtgcgacgggatcgacgaatctcgtccgcatcgaagggttcttggccgccgaccacctgatccacaacggcgtgctgctggggggcatcgcactcgtgctcgtcgggctgggcttcaaggtggccgctgcgccgttccacgcctggagccctgacgtctatcaaggggcgccgacctcggtgaccgggttcatggcagcactggccaagatcggcgcgttcgccgcgttggtgcgcgtgttcgatggcgcgctggcctcccaggcctcgctctggggcccactcgtggcggcgttggcagtggcctcactggcggtcggcgccttcttcgccctgcgccagcgcgacgtcaagcggatgttggcgtactcgtcgatcaaccatgccggcttcatcctcctcggtgtctatgccgcgagcgcggtggggattcgcgcggcgctcctctacgtgggcacctatggcatcctcgtcgtcgggagcttcggcgcgctctcgttggcgcagtgggttcgaggcctcgacgaggggctgtgctcgctcgatgatctccgtggccttgcgcgtgagcatcctgcgatcgcggtgacgctcgccatcacgctcgtggcgcaagccggagcgcccttcacgaccggcttcttggcgaagttcgccgtcgtggaggcggtgatcgctgccggggagacctggatcgcgatcgtcgccatgttgagtgccgcggtcgctgcagcgttctacctgcgtgtcgtcctcgccctctacggcagggacagggagtcgagcgtcgtaccggcgatcgccggggcgcaggtcgaggacgggcgatctgccgtgacgcagcgcccgagcccgagcgagcgcgtcgccgtggcgacggcctggggcggtgtggtgctctcggtgggcgccaccatcgtgcttggcgtggtgccgaccctcgtcctcagcctcgtcgggagagcacacatcctgtgagactcagtcggtgaggttcagtcgggttggggccagcgtcggtcctccatcacgctgttcgcaccatcgacgacgatgaccgaacccgagacgtagctcgctgctggtaggcagaggaaggcgacgacgtcggcaacctctgtcggaaggccggatcgcccgagcgggctggcgagaccggcagctcgttcgtcgggcgtctgtgaccccgtggcgatccagcctggcgcgacgacgttgatggtggctggggcgaggtcgagcgcgagtgagcgcgcgagaccgacgaggccggccttggcggcagcgtacagggcgctgtgcacggtggcgttgacgtggccagtcgtagagccgacgaggaccacccgtccgcgcgcgccgtgggtgagcagtgtcggtgcgaaggctcggacggtgagcacggcgctgaggaggttgcgatcgagttcgtgcgtgatggtgtcctctggcaggctccacagggcgccttggcgctccgggtccccgacggcggtcatgccggcgttggcgacgacgatcgcgggaggaccgaggcgcgcggtgatggagtgggcagcctctgcgacctcggccgcgacggtgaggtcggcggtggatgcgaccgcgtcgatccctcgttcgatgagttcgtcgcgtcgagtgaagatcctcggtgagcgactgatcaggccgaggcgagcaccgagctcgccgagcgtggtggcgatcgcaaacccgatgcccgttggagacccggccccggtcacgaccgcgaccgatccgtcgagtcgccagcgctcatgcatgggggtccgccaggaagcgtccgacgagcggcaggtcccagagtgactcggcgcgtgctgcggcgatcgcgatcgcggcgaggtgctcgtaggcgtcgacgacgaggtagcggggttcccagcggggctcgaacttcgcgttgaagcgccagagcgactcgatctgcatgctcgacgagagccgatcgagcacccagcgctcgactcgggcgctcaggagttcgccgccgcgttcaccggcgagcacgccccgcattgcagcgaagttgaggctgatcgccttgacgtggcgggcttggagctgcgtcatggtctcgacgatgagcaggtcgaacatgccgttcggatggttgccgaggtcgcgacgcatcaggtcgagcgagtagccctcgatgctcggcgcggggacccactgcacgaacccgacgatccggccgtcgggtcctgtgcacacgctcatgaggacgtcggtgtcgcgggggtcgaagacgcgccccagcgtcatcgagaacccgcgttctcggccgccgcggcgtgactcgctcatgacgcgaagcacgtcgcgccgctcctcttcggtgagctcgagcggagcgacgacccgcacgcggtagccgtaacggcgcatccgattgactgcctggcgcagactcttgtggcgcttgccggcaaggtcgagttgaccgagcgtgacgatcgcctcgtcaccgaggtagaggggatgcaagccgacctcgcggtaccactcgctccaggtctcgctcgccccgaggacgcacagtgccttcccggcgcgagacgtggcctcgaagagctcgaggaaggcgaggcgtgccgaggcggtcgctccgatggggtctggggagacgatgacgacggagccgaactcgccgtaggccacgaggccgccatgacgcacgaggtgctccttgtcggagcgcagcgcgaagtagtccagtgtgctctgtgggtgggctcgcaggatctgtgcgggattgcggggcgctctgagggaggcgagctgcgcgctgaggcgatcgcgcacgggtgccacgaggcgccacacgatgaggacgaggagtgcgacgccgaccagcgtgagtgcgtcttgcaactcaccgaccgcgaatggcggcggtgcttgaaccggaagaccgagcacggtgccgatgatccctccgagggccgcgaggggacggagaggtgcatggtgtacgagggcatcgccgatcgcgacgacttcggcgacgaggacgaccaagacgccggcgcccacgaccgagagtgccctccacactcgtcggcccctgggggcgggttgtcgaaaggcgcttcgccagatggccagcgcgacgagcgcgaggctgaggaggccggtcgtgatgaggtcgctgcggcggaccaggttggaggcgaccgctgctgcgaggaccaccatggcgatccgccacgcccgtcgttgaccggctcggagcccttgggcgatgccgagcagcagcgtgccggcggccgccgagatcgcgtcggcgtagcgagggatcggtccgagggtagggaagagtgtggtgacgatcgacaggtgtcgtgccaatgggggtgcgaacgccgagatcacctccacgagaccggcgacgctgaccgcaagtcccccgacacggcgcaccgtgagcgaggtctcggaggcgagcctgggcgcggggggccacgaaccgccgtcaggggcgcccgcgagcgtcacctgatgatcgaggagggcctgatcgggccagagcaggcgcgagagcgcgttcggcgggcgaacgcgacggcgcgtccggcgcaggtaggcgcgcacgaccgcgccgacctcgagctcgatccacgtcgtgtggtacatgggctcgtagcgggtggggagcagacctctgccggcaacgggcgtgagcacggccgtggtcggtcctggcgaggcgaggaaggcgtcgtcgtcgtgttggagttcggcgagctcggcctgggcggcgatgagcgaggtgtgcggtgggaggctctcgaacagatcacgcgcggcttggttggtggccagtgcgctcaccatcgactccatcggctcctcgatgaggtgggtcaccgaccgcgaagcgaggacgctggcaaggagcacgatgagggcatcgaggacgaggaaactcgcgacgagggcgatgtggcgcgatgcctggtggtggaggtgtgcgacgagcggtgcggccctgagcacgaacggcagccgggccagctcgagcaggacgagcgggacgaagacccacaacgcgagcatgcgtgcacgccgtgcgaacgaacgcgccacgacgaagtgggtcacggaggcggccggatcgagccaggcagcgccacggaagcctgggagtcgttcgagcgcttcgagcgtgcgccgtcgtgcgagatccgtgccgaccggcttcatgcggacgcgatggccgcggggccctggcccgaggaggatcagctcggcggtgtgttctacctcggcccccattgccagaggctcgtcgcgcacggaggtgatgcgtacggtgcgtgcgcgggcgctcgtgagcaggtcgacgacgtcgtggtggtgcccgagtgcggagcgtgggtcgagactcggctcgggtgcggtgacgcgcccagcgaggacgagcaggtcatcgggctcgagctccccgatgatgcgtgcgagctcgtcacgatcggggcctgggcgccgatcgtggaggtcgagattgccgaggacgacgacgcgcgcgccgggcgcgaggcgcacctcgaggggcgccgactccacctcagtctcggaagttcgtgaactgtaccgggaagtccgtgatgtgctcgcggaggtgggcgatcacgctctggaggtcgtcacgcttcttcgaggtgactcggacttgctcgccctgtatctgcgcctggacgcccttgatcccagcggccttgatcgcggccgtgacggctcgtgctcgatcttgattcaggcctgcgacgaggcggatcacctggcgctgcgtacctcgcgcggcctcttcgatcgggcctcgatcgagcgccttgagcgagacaccgcgcttgacgagccgctcctcgaggacggtcgcgagtgcccgcagccggtcgggggtctccgagttcagcgtgatggtgagctctcgatcgttgaggttgatcgacgagccggtgttcttgaagtcgaagcgagtcgtcacctcgcgcgacgcctgatcgaccgcattgcgcacctcttgcaggtcgatctccgagacgacgtcaaaggacggcatgtgctcagactactcttgtgaccgtccagggtcggtgcccgagcggccaaagggagcagactgtaaatctgccggcgtacgcctacgggggttcgaatccctcccggcccactggagtccagcgcgcctggttcgatggtgcgcggcgacgtcgtgtcgcttccgaccgctcacgaggcggctaagctggcgccagcgcgaccaacgtggaggaagctgctgtcgtgaagtcctcgctcactcgtcgggctcagctctcggctcctggtgcggtgcgtcaggcacggatcctcggggcgcggatctccgagttcgtcgactcagtggagccagtcgagaccggcttgctcggctccatcttggtcttcctcgggtcgctgcagccgaattcgccgttcacctcgaaggtcccggggtcatggtttctcggtgtctcgtcggtgccgcaccccggttcggtcctcgtcgaggtgctcgcgaaggcagcggtttacctcggcctgatcctgagcggtgtggcctgggtgcggttggtgaggcttgcccgcgccgggtcgctgccgcgcgcctggtgggtcatcttcgcgctgtgggtcgttcccctcatgatcgctggccccttgttctcacgagacgtctactcgtacgctgcccagggccagatggtcacccaagggatcagcccgtaccatggtggccccaatctgctcgggacgagccccttcctcgcgaccgtggacccgctctggggcaacgctccggcgccgtatgggccactgtttctcgcggtcgatgccggtctcgtgaccatcgccgggcattcaccgctcatctcggtggtgctgttgcggctcttggcgctggcatcggtcgcggtgtccggggtcgccgtcagccgtatcgcacgtcggctcggtgcgaacgaggcgctcgccctcgcgctgacggcgctcaatccggtctttctctacacgctggcctccgcgggccacaacgacgcgttcatggtcgcgctcatgctgctcggtattgaccagttcctcgctggccggcgcttcgtgggcatcgtgatcgtcgcgctcggggcggcggtgaagatcccggcgatcatcgccgtgggtttcctcggctatcactggagcagcgaacgtacgtcgatcggggagcgcattcgcacgacgatcgtcgcgctcgtgatcgcggcggcgctgttgtgggcactcggcgtcgtgaccgggctcggcatggggtggctcccggcactgagcacgccgggttccgtctacagcttcgaggatccgatcgtcgccgttggctacggcgtcggttggttggcgcacgccgtcgggctcggcatcggtccttcgggtgtgatcagcgtgttgcgcgatctcggcgacgccgtgttgctggcggtcgctgcgatcgtgttgctcggttcgcgtcgcgagaccctgctgcggggtctggggatcgtgctcctcgcgaccgtcgcgctcggtccggtgatctggccgtggtatctcacgtgggccatcgtcgtgctcgcgatcggtgcgggagagctgacctcgggctttctggtgctcgtcacggtctcggcgctgccgatcgatctgctcggcctaccgaccgtgctggcgtgggtcggctacatcggcctcggggtggtcgtgcgtcgacactggggccatgtgatgggcttctggagcgagaccctggatggcgccaaggctcgggtcgaggagctcgtcgggcggacgccgctggctcgtctgctcccgtggagctgacgagcctcgtcgacgcggcccaccgcctgagcgaacgcgacccgctgatggcgcgcttcctcgaggcctacggcgtaccggtcgtggggcgccggggcttcgatccggggcgtctcgaggcgccgggtgaggttggcctcttcgggttcgtcgtcgaggtcgtgacctatcagcagatcagcgccgctgcggcgaggcgcctcgtggctcggctggaggcgatgggggcgctcgatgccgatgtgatggtcgcgctgaccgatgccgaggtggccgcgaccgggttgtcgggatcgaagcggcggtggctccgagcgctcgcgcgcgacgtggtgacgggcaccatcgacctcgagggactccgggcactctcgccggacgaggcacatcgtgcgctacgcgcgatccgcgggatcggcccgtggagcgccgacatggtggcgatcttcgcgctcggtcacctggatgtgtggccgatcggcgaccttgcgttgcgccgggcgctcgcgcgacgtcatcccggtgccgaggatcggggcgtcgccgagcggctcgccgagccctgggcgccgtggcgctcggtcgctgcgctgtggtggtggcaggatgacgcgtgcggggccgcgtcggtactagagcagccgctgcatgaccgcgaggtcaatccagcgagagaacttgcggccgatctcgcgttggatgccgacgagctcgaaccccgctctcgcatgcaacgaccgtgagacgtggtgatcggccacgatatgggcgatgcaggcgtggaagccgaggtcggcggccgtgtcgacgagtgaggtgaggagccgtgtgccgatgccacgcccctgggccgtggggtcgaggtagatcgagtcctcgaccgtcgaggcgtagcctgcgcgcggtcggtagggcgagatcgaggcgaagccgaccacgtccccgttgagctcggcgaccaagcagacgtagatgccgaggtggtcgtcgacccagcgctcgtgttcgctgggtgtgcgcggctcgatgtcgagggtggcggtcgtggtcaggacggcatggttgtagatgcgacgagtcgcctcggcgtcacttggaacgagaggacgaaggatcagcgcatcgtcgggcacgggtctacggtagaggctgtccggccccgaggctcgctcgctatcatggttggaactcgcccccttagctcagtcggcagagcacagccatggtaaggctggtgtcgtcggttcgattccgacagggggctccgtggcggcgtagctcagttggttagagcacacggctcataatcgtggggtcgtcggttcgagtccgaccgccgctactacggaccgtccagcgctggtaggaggatcgatggcgaagaacgaacggcgggtgcaggtgacgctggcgtgcgaggagtgcaagcgtcgcaactacatcacgtcgaagaacaagcagaacgaccgcgaccggatcgagatgcgcaagtactgccggtgggatcgccgccacacgctccatcgcgagaccaggtaggtcccgcgctgactcgggttcgtgctcgggccgctgagctccgtccgggcctcgaagagtccctcgccaaggtccgtgcgcgggctggggacctacgcccgtcgttcgacgaggtcgtgcatcgcacccttgcgatgagcacccgtgtcgcgtcccgcatcgtcggcgatgccgaggcggtgtcggacgtgctccaggacgcgtacctgaacgtgtaccggtcgctcgagcgctttcgcggcgcctcgcgctacgagacgtgggtctaccggatcgtcgtcaacgcggccaggtcgcacctgcgtcggatgcgacggatgcgggcgcgcgagacggtgctggacgaagcggagatcgtcccggctcgttcgggcgaggttctcgaggccgccgatctcgtggcacagcacatcgacgtcgtggcgctccttgcccgactcggggaggccgatcgcgagttgctcacgttgcgctacctcgctggcctgagtgtggcgcaggtggccgccgagctcggtgcgagcgagaatgcgatcaaggtccgcctccaccgagcacggcgtcgcctgttggcccttctggctgccgatgaggagttcgacgacgagggagccgtcagagcctcggtggggtctcccaagcgcggggactggtaagctcgttcggcggcgaagggtagtagctcaattggtagagcaccggtctccaaaaccggcggttgggggttcgagtccctcctgccctgcacgtgctgggtggtggttcacgcggcgcgagacggatcgttgagggtggagctgtgaatcgggagacgaggcgcctcatggcgcgccagcagggcgccacgcgcgaccgccaggagctggctcgacggatggcgcagggctccggggagccacgcaagggccgtatccggcggtacctgcagggggtgcggacggagcttcgtgccgtcgagtggcccactcggcgccaactgcggagctatgcaaccgtggtcttcgtgaccctcgtcctcgtggtagcgctcatcttcttgctgaacgtcgtgttcgccaagggtgtgtcgctgctctacggctagcgcaggtcgcgatcccgtgacgatcgacaacgatggaggcaaggtgagccccgaggagatggaatcgacgcaccagcccgcgctggtccacgatgacgaccgagctgcggagagccgcgaggtcgcatccgctgacgcgccagctgtgcagagccgcgacgatggtgaggcgacggaccccaagggcagcggtgatgacgacgtgagcgctgccgaggattctccgtacgatcgtccgggcgagtggtacgtcgtccactgctactccggctacgagaaccgggttcgccagaacctcgcgacgaggatccgctcgctcggcctcgaggatcgcatcttcgaggtggagatcccgatggaggacgtcaccgagctcaagaacgggcgacgagtgaaggtgcagcgcaaggtctttcctgggtatgtgctcgtacgggccgagatggacgacgaggtctggtccgccatacgcaacacccccggcatcacctcgttcgtcggatcgggatcgaagccggtgccgctgagccgcaaggaagtcgaggcgatgttctcgttcgccacgccggaggagctgcgcccgcagccacaacggcgctcgacgcaagagttcgagatcggcgaaacggtgcgcgtcaaggagggcccgctcgcggacttcgtcggcgaggtggccgaggtgaacgccgatcagctcaagctgaaggtgctcttcaacatcttcggtcgagagacgccggtggaactcgacttcacgcaggtgtcgaaggcctaggcccggtcgagtggcaggggccgactggtagagttgtcggttcgtgtcccgtgtggggcgtcatgggttcgtgacgccaggtgcgcggcggttgtgacgaaacggtagtgacgaaggagtcgttcggtggcgagaaagcgcgtaaccgcggtggtgaagatcaacctgccggccggtgctgcgacgccagcgccgcctgtgggtacggcgctcggcccgcacgggatccagacgatggagttcgtcaagcagtacaacgctgccacggaggcccagcggggacaggtgatcccggtcgaggtgaccatctacgaggatcgctcgttcagcttcgtgctcaagacacccccgaccaccgagctgctcaagcaggctgccggcgtcgacaagggatcaccccagaatcgccgtcaaggtgtcggtacggtgacgcgtgctcaggtcgccgagatcgcgcaggtcaagatgccagacctgaacgcctacgacctcgaggccgcgatgcgccaggtcgagggcacagcgcgatccatggggatcgccgtggtcgagggctagcgagagaagaggacgaggtcgcgagatgaagcactcgaagacgtaccgtgagcaggcagcactgctcgatcgcaatcggctgtactcgcccgtcgaggcgctcgcgctcgtgcgccagctggctcgcgctcgtttcgacgagaccgtcgagctcgccgttcgcctcggcgtcgatccgcgcagggcggaccagatcgtcaggggcaccgtcgccctgccccacggcactgggcgtcgcgtccgcgtcgccgtgttcgcggcgggcgaggccgcccaggaggcgcgtgaggccggagccgacatcgtcggcgccgacgatctcgtcgagcgggttcaaggcggcgcgttggacttcgacgtggccatcgcgacgccggatctcatgggacaggtcggccgtctcggccggatcctcggtccacggggtctgatgccgaacccgaggaccggaaccgtgacccacgacgtggggcgcgcggttcgcgagttcaaggcgggtcgcgtggagttccgcaccgaccgcgtgggcaacgtgcacgtcccgatcggcaaggtgagcttctccaccgtcgcgctgctcgagaacttccgagcggtgatcgacgagctccagcgcgccaagccggcagcggccaaggggcgctacttccgctctgtgcacgtgtcgacgacgatgtcgccgtcggtagcgatcgatccgaatcgactgcgcatcgccgacgaggaactcgaggaactcggagccgcgtaggcggctgcgccaggtaggattgtcccgccatcacctcggtccgctgtagaggtccggtgcccgcaagggctcaaatcccacggtgcgtgggagcctgatgaggcggtctctccggatcgagcaggcactgccaaggagagtgagatcgatggagcatcccaggccgagcaaggtcgccctcgtcgaggcgattcgcgagcggctcgcgacggcagacgcggtgttcgtaaccgagtaccgcggcctgaaggtcgctgagctcgcgtcgctccgacaggagcttcgcgccgtggacgcggagttcaaggttgcgaagaacacgctcgcacgcatcgcggcgcgcgaggcttcgctcgaggcactcgaggcgttcctcgagggccccagcgggctggtgttcgcccgtggtgacgctgcggcgacggccaagcgactgcgcgacttcggccgagcgaatccggcactcatcatcaagggtgggctgctcggtcgcgccgcgatcgacgcagcatcggtgctgcggcttgcggatctcccaagtcgtgaggtgctccttgcgcagttggcaggggcgttcaccgcacccatggcgaacctcgccggggtgctgtcggcgctgcctcgcaacctcgcctacggcctcaaggcactcgccgaccagcgagcggcgtaggcgcgagtcgaccacggagaacaggaggagacagtggcggacatccaggggattttggaccagatctcggagctgacggtcgtcgagctctcggagctggtgaaggcgttcgaggagcgcttcggtgtcacggccgcggcgccggtcgcggtggcggcggtcgccggtgccgctggtggcggcgaggctgcccccgccgaggaggagcagcaggagttcgacgttgtgctcgtctccgcgggtgacaagaagatccaggtcatcaaggaggtgcgcgcactgacgaacctcggcctcaaggaggcgaaggatctcgtcgacgcggcgccgaagccggtgctcgagaaggtctcgaaggaagacgccgagaaggcgaaggctcagctcgagggcgccggcgcgacggtcgagctcaagtagcgagccgtcgacgcaggcggtcgtgcggtctccctgtatgcttaggggagccgtgcgtcgtcccgcaaccacttcgtcttgacgctcacgggcctttgcgcgcccgtgagcgtcttcgtgtctgccgccaccgtgcacgctcggacacgagtggtgcgagcgtcggtcgggcacctgctgtgggtgtgtgcagtccgtcgagtgcaagtcaaccgagtgcatagtcaactgagtgcaaggagtctcccttgatcacgaggcaccgtccgcctgagcgcttcagcttcgcgtccgcgcgcaatgttctgccgctgcccgatctgatcgctgtgcagcgcgactcgttccgctggttcttgaatgaggggctcgcggaggcctttcgagacatctccccgatcgaggactactccggccagctcgcactcgaactcgagtacgaccccagcgatcctgatctcgcgccggtcccgaagttctcggcggaggagtgtcgcgagaaggacatgacctatgccggcccgatcttcgtgcgggctcggttcttgaaccgccagacctacgagatcaagcagcagatcgtgttcatgggcgacttcccgctcatgaccgaccgaggtacgttcatcatcaacgggaccgagcgtgtcgtggtgagccagctcgtccgctcgcccggcgtcttgttccagcccggtcgcgatcagcacaccgtcgtgacggccaccatcaacccctaccgaggggagtggctcgagttcgacgtcgaggcccggccgggtcgcgatatcaatgcggggggccgcgtcgcgcgtaagcgccggctgagcctgttcacggtcctgcgggcggctgggcttgacgaccctgccgatcttgagcgcctggtcgcacacttcgacttcctcgaacctcagtgggccaaggaggaccactcccagacccgcgacgacgccctgatggaggtgttccgtcgggtacgcccgggcgagccgatcaacgtcgaggcggcccgcctctacttcgagaccgcgttcttccagagccggcgctatgacctcacccgcgtgggtcgctacaagatcgacaagcgactcagcgcggagatcgagcgcgtcgaggagatcctcggtcacccgctggatcgaacctcggagtcgccgctcgtgctcagccgtgcggacatcatcgcgaccgcgagctacatgctgcacctggtcgctggcgagcccgggtatcgcttcgacgatcaggaccacttctccaaccggcgggtccgcagcgtcggcgagctgatccagaaccagctcaagatcgggctctcccgcctcgagcgcctcgtccgtgagcgcatgacgacccaggacgtcgaggcgatcacgccgcagagcctcatcaacatccgtccggtggtcgctgcgatcaaggaattcttctccaccagccagctgagccagttcatggaccagaacaacccgctctctggccttgcccacaagcgccgcctgtcggcacttggtccaggtggtctgtcgagggagcgagcgggtttcgaagtacgcgacgtccactcgtcgcactacggacgcatgtgcccgatcgagacaccggaggggccgaacatcggtctcatcggggcgctcgcgagctatgcccgcctgaatcgatacgggttcatcgagaccccatatcggcgtgtggtggacggcaaggtcaccgatgaggtggtctacctgaccgccgacgaggaagaagactacgtcatcgcgcaggcgaacgcgaagctcgacgccgagggtcgcttcgtcgagccgaaggtcctggtgaggcgcggcccgcagggcgcggtcgtgcgggtcggtgccatggcggtctcctacggcgccaccagtgaggtcgagctcgccaccccggacgaggtggacctcatggacgtgagtccggcgcaggtggtctcggtgtcgacgtcgctcatcccgttcgtggagcacgacgacgccaatcgtgcgctcatgggtgccaacatgcagaagcaggcggtgccgctgctcgtccctgaagcgcccttcgtcggtaccggtgtggaagcccgagccggactggacgctggcgacgttcttgtcgccgagggcccaggtgtcgtgtcagaggtgaccggcgcctcgatcgcggtgacctacgacgattccgtgaccgacgatgccggtcggccactcggaacacgtcgctactggctgacgaagttccagcgatccaaccagaacacctgctggaaccagcgtccgacggtggccaccggggaccgggtcgagctcggtgacgtgctcgccgacggtcccgccaccatgcacggtgagctcgcgctggggaagaacctcctcgtggccttcatgccgtgggagggctacaacttcgaggacgccatcatcatctcggagcgcctcgtgcgagacgacgtgctgtcctcgctgcacatcgaggagttcgagaccgatgcgcgcgacaccaagctcggtgccgaggagatcacccgcgacatcccgaacctgtcggaggaggccctcgccgatctcgacgagcgcggcatcgtccgtatcggagccgaggtcggccccggtgacatcctcgtcggcaaggtgacgccgaagggcgagaccgagctcacgccggaggagcgactgctgcgtgcgatcttcggcgagaagtcccgcgaggtccgcgacacctcgctgcgcgtgccccacggtgagtacggcaaggtgatcgacgtcaaggtgtttacccgcgaggacgcgaccgagctgccgcccggcgtgaacgagctggttcgggtgtacgttgcgcagcaccgcaagattcaggtcggtgacaagctcgccggtcggcacgggaacaagggtgtgatctcgcggatcctccccatcgaggacatgcctcgactggaggacggtacgccggtcgacatcatcttgaacccgctcggcgttccgagccgcatgaacatcggccaggtgctcgaggcgcacctcggctatgccgcccggtgggggtgggagcccatcggcgagggcgcacgggagcatcgcaagacgcgtccggtgacggtcccggcccggtgggtggcgagtcccgccttcgacggcgcgcactgggacgagtcggaagaggccggggacctgccgaccatcaaggaactgctcgagcggctgaacccgcagagccgcgacggcgagcgcctcgtccagcccgacggcaaggcggtgctctacaacgggcgcaccggcgagcgctacgacaaccccgtcatggtgggctacgtctacatgctcaagctggcgcacatggtcgatgacaagatccatgctcgctcgacgggcccgtactcgatgatcacgcagcagcccctcggcggcaaggcccagttcggtgggcagcgcttcggtgagatggaggtgtgggccctcgaggcctacggcgccgcgtacgcgctgcaggagctgttgaccatcaagtccgacgacgtcgtaggccgtgtgaaggtctacgaggccatcgtcaagggtgacaacatcccagaaccggggattccggagagcttcaaggtgctcatcaaggagatgcagtcgctgtgtctgaacgtggaggtgctcgctccgaacggagagcgggtgcagctgcgcgagttcgaggatgaggcgtactcggcggcggaggagctcggtatcaacctgagccgccctgagcgcaacacggactacggcgacgacgagcgacgcgaggagaggggtcagtagtgctcgacctgggtcgattcgaccagatccgcatcgggcttgccacgacggaagccatccgcgcctggtcacacggcgaggtgaagaagccggagacgatcaattaccgtacgttgcgtccggaacgcgatgggctcttctgcgagcgcatcttcggccctacgcgcgactgggagtgccagtgcggcaagtacaagcgcgtgcgctttcgcgggatcgtctgcgagcgctgtggcgtcgaggtcacccgctccaaggtccgacgggagcggatgggccacatcgagctcgcagcaccggtggtgcacatttggtacctgcgcgggacgcgttcgtggctggcctacctgctcatggggacctcccccaaggaggagctcaaggccaagcagctggagaaggtgatctacttcgccgccaacttggtgacctgggtcgacgaggagcgtcggcaccaggacctgccgaacctcgaggtcgaggtgctcgaggaggttcgggcgatcgagtcggagcgtgacgtcgagctcgagcgccggtaccaggcgatggaggcggagctcgccgagctcgaggagcagggtgctcgcgaagccgaggtgcgccagcgccagcgcgcgctcgagcgggagatcacgcagctccgcgagcgctacgcggcgcgcatcgacctcgcgcgtaggaccttcgacgagttccgcgagctctacccgcgccagatcatcgaggacgagctgctgtggcgcgagctgcggtcgcggtatggctcctacttcgacggcggcatgggggccgaggcgatcgccgacctcatccgtcgtatcgacttcgatgccgagctggccaagctccgcgagctcatcgaccccgccgagggtcgccgcccgttgtcggcacagcgtcgccagaaagccatccgacgcctgcgcatcctcgccgcgttcaaccagcgcgacgaggagggtcgtcgtatcaacgacccgatggcgatgatcctcgaggtcgtcccggtgatccccccggacctgcgtccgatggtgcagctcgacggcgggcggttcgcgacgtcggacctcaacgatctgtatcggcgcgtgatcaatcgcaacaaccggctcaagcgtttgttggatctcggcgcgccggagatcatcgtcaacaacgagaagcgcatgctccaggaggcggtcgacgccctcttcgacaacggtcgccgtgggcggccggtggtcggcccgggcaaccgtcctctgaagagcctctccgacatgctcaagggcaagcagggtcgcttccgccagaacctgctcggcaagcgcgtggactactccggccggtccgtcatcgtcggcggcccgacgctgcagctccatcagtgtgggctcccgaagatcatggcgctcgagctgttcaagccgttcgtcatgcgtcgcctggtggagttgggctatgcccagaacatcaagtcggccaagcgcatggtcgagcgtcggcgtccccaagtgtgggaagtgctcgagacggtgatcaaggagcatccggtgctcctgaaccgtgcaccgaccctgcaccgactcggcatccaggcgttcgagccggtgctggtcgagggtaaggcgatccagatccatcctctggtgacgaccgcgttcaacgccgacttcgacggcgaccagatggcggtgcatctgcctctgtcgcctgaggcgcaggccgaagcccgcgtgctcatgctctcggcgaacaacacggtgtcgccagcgaccggacggccgatcacggtccccgggctcgacatggtgttcggtctcttctatctcaccatcgtgcgcgaagaggagccaggtgccggcaaggtgttccgccacgactatgaagtggtccgggcctgggaaaccggcaatctcggcttgcacgcgccgatcaccctccgtcgtcgcgatggcgatggcaacgtcgaagagctgcggacgacagccgggcgtgtgatgttcaaccaggcgctgccggccgacttccccttcgtcaacgaggtcgtcgggaagaaggcgcttcccatcggctcgatcgtcgagcgggtggtgacccagtacccccgcaacgtcatcgaggagacgctcgatcgcatcaagtcggttgggttcaccttcgcgacgcgcgctgggctcaccatctcgaccgacgacgtcacaaccccggccgccaaggccgagatcctcgatcgctacgagcgcgaggcggacaaggccgaggcgcagtaccggcgaggcatcatcaccgacgacgagcgcaagcagaaggagatcgagatctggacggcggcgaccgcggagatcggtcgggccatcgacgagatgctcgcctccaacccgctcaatccgctcgcgatgatggtcgagtcgggagcgcgaggcaaccctcagcagatccgccagatctccggcctcaagggcctcgtcgccaatccgcgcggtgagatgattccgcgcccgatcaagtcgtcgttccgtgagggcctcgaggtgctcgagtacttcttgtcgacgcacggtgcgcgcaagggcctcgccgacacggcgctgcgcaccgccgactctgggtatctcacccgtcgcctcgtcgacgtcgcccaggagctgatcgtgcgcgaagaagattgtggcacgtcgcgggggatttggatcgacgacgtcgccgaggactcggcccagcgtcgcagctacctcgagacgcgggcgttcggacgggtcctcgcagaggcggtcgatcttggcgacgggtcgcagctcccggccgggacgttgctcaccgacgagctcgtcaagcagctggcagccgatccggcagtcgagcggatccgtgtgcgcaccccgctcacctgcgagacgccccacggcgtgtgtgcgacctgttacggccaaggttttggggggagggggctcatcgagctcggcgaggccgtcggcgtcgtcgcggcccagtccatcggcgagcctgggacgcagctcaccatgcgaaccttccaccagggcggcgtcgcgggcgccgacatcacgcacggcttgccgcgcgtggtggagctgttcgaggcgcgttcgcctcgtggagccgcggtgctggcgcatgcgtccggtgtcgtgcacatcgaggaggaagagaacggtcggcgggtcaccatcacccacgacgacggctccgacgaggtctacgtgctcccgctcagggcccatctcgaggtggccgagggcgaagtgatcgaggccggcgaggccatcgtgagcggtccgaaggaccccaagcagctcctcgagatcaagggcattcgcgagacccagcgttacctggtcgaggaggtccagaaggtctatcgcgaccagggtgtgtccatccacgacaagcacatcgagctcatcgtccgtcagatgctgcgccgagtgctcgtggccgagcctggcgattcccccttcttgccgggagaacgcgtggacacccagcgctttgccgaggtgaaccgcgaactgttcgccgaggggaagcgccctgccgagggtcggccggagctcatgggtatcaccaaggcgtcgctcgcgacggagtcgtggctctcggcggcctccttccaagagaccactcgggtgctcaccgaggccgcgatcgaggggcgttcggatcacctgctcggcctcaaggagaacatcatcctcggcaagctgatcccggcaggtacgggtgcgccgcgttaccggtcggtcgcggtcaaggctccccactatcgccgactcgcgtactggtcgagcgaggaagacctcggtgggttcgacggggggcctggctatgaggcgcatggcggccctgtagactgagccatacgcgggtggtgcgtgtcgcgtgccaccactgcgaatcgggccggacgcggaggttctcggcgagccggcagaggaaccaggaatgttggagaccggcccgccccgtgtgggcgggccggtccaccgagagcggcgcgcctgcgtcgcaagaaggagtgcaaaccgtgccgacgatcgcgcagctcgtgcgcaagggccgcgaggccaagcgcacgaagaccaagaccccggcgctcaagggatcgccgcagcgccgcggggtgtgcacccgcgtgtacaccaccacaccgaagaagccgaactccgcgttgcgcaaggtcgcgcgcgtccggctcacgagtggcgtcgaggtcactgcctacatccccggtatcggtcacaacctccaggagcactcgatcgtgctcgtgcgtggcggccgcgtcaaggacctccctggtgttcgttacaagatcgtgcgcgggacgctcgatgcggcgggcgtgaagaaccgcaagcaggcgcgcagccgctacggcgcgaagagggagaagtagccgatgccacgcaagggtccagcccaggttcgtccgatcgctcctgaccaggtctaccactcggtgctggtgtcgcagctgaccaacaaggtcctgcgtaacggcaagaaggcgctcgccgagcgtaccgtctacggcgcgctcgaccagatcgctgccaaggtgaacggtgacccggtcgccgtcttggagcgtgcgatctcgaacgtacgccccatgaccgaggtgcggtcacggcgcgtcggcggtgcgacctatcaggtacccgtcgtcgtccgtgatcggcggtcgtactcgctcgccatccgctgggtcgtgaattcggcgcgcgcgcgccgtgagaagaccatggccgagcggctcgccaacgagctgctggatgcgtccaacgggctcggcacgtcggtcaagcggcgggacgacacccacaagatggccgaatccaaccgcgcgttcatgcactatcgctggtaagcaaggagctttccacatgccccccacccgtcaggtcccgctcgagcgcttgcgcaacatcggcatcatggcccacatcgatgccggcaagaccaccacgaccgagcgcattctctactacaccggcaagaactacaagatcggcgaggtccacgagggcgcggcgacgatggactggatgccgcaggagcaagagcgcggcatcaccatcacctcggctgcgacgacggcgttctggcgggatcaccgcatcaacatcatcgacacgcccggtcacgtggacttcacggtcgaggtcgagcggagcctgcgggtgctcgacggggcggtggcggtgttcgacgccgtcgctggtgtcgagccgcagaccgagacggtgtggcgccaagggaacaagtacggcgtgccgcggatctgcttcgtcaacaagatggaccgtgtcggggccaacttcgatcgctgcgtccagatgatccgggatcgcctcgacgccgtcccggcggtgatccagctcccgctcggtgtcgagagctccttccgtggtgtcatcgacgtcgtcggcaagcgcgcgatcgtgtgggacgagggcctcggggagacgttccacgacgagcccatccctgccgagctcgtcgacgctgcagagcaggcgcaccacgatctcatcgacgtgctcgccaatcacgacgaagagctgatggaacgctacctctccgacgaggagatctcggaggagatgctgcgggcctccatccgcgaggcgaccatcaacaatcacgtcgtcccggtgctctgtggctcggcgttcaagaacaagggcgtccagccgctgctcgatgcggtggtggactacctcccgagcccgttggacatcccggccgcgaccgggacgtcgccgaacggcatggacatcatcacacgcgagccgtccgacgatgcgccgtttgcggccctcgcgttcaagatcatgaccgacccttacgtcggcaagctgacgtacttccggatctactcgggcgtcttggagaagggatcgacggtcctcaactccaccaaggacaagcgcgagcggatcggtcgactgctgctcatgcacgccaaccatcgcgaggacatcgaggtcgcccacgctggtgacatcgtcgcggccgtcggcctcaagtcgacgagcaccggcgacacgctgtgcgatccccaggcgcccgtcgtcctcgagagcctcgagttccccgatccggtcattcacgtggcggtggagcccaagaccaagtcggatcaggagaagatgagtcgggcgctctacgcgctcgccgaggaagatccgacgttccgcgttcgctccgaccaggagaccggtcagacggtcatctcggggatgggcgagctgcatctcgaggtcatcgtcgatcggctgctgcgcgagttcaaggtcgaggcgaacgtcggcaagccgcaggtcgcctatcgggaggcgatccgcaagccggtgtcgaaggtcgaggagcgctacgtgcgccagaccggcggccgtggccagtacggtcacgtcgtcatcgacgtcgagccgctcgggcgcggcgaggggtacgagttcgtcgacaagatcaccggtggcgtcatccccaaggagtacatcccagcggtggacgccgggatccaagacgcgctctcgtcggggatcctcgcgggcttcccggtcgtggatctgcgcgtcacgctggtcttcgggtcgtaccacgaggtcgactcctcggagatggcgttccgtatcgccggctcactcgccatcaagaaggcggtgcgcatggcgagtccgtgcctcctcgaaccgatcatggcggtggaggtcgtcacgcccgaggagtacctcggtgacgtgatcggcgatctctcggccaggcgaggcaaggtcgagggcatggagcaggtcggcgtgaaccaggtggtgcgtgcgctcgtgccactcgcggagatgttcggctacgctactgacctgcgttcgcgtacgcaggggcgtgcgagctactcgatggtgttccgggcctaccaagaggttccggattccatcgcgcaggagatcgtcaagcggatcaagggcgagtagacttcagcactcggttatccgtcggcgggttgcgtcatccgggcgcagagggacaacaacggagcaggacaggccatgggcaagcaaaagttcgagcggacgaagccccacatcaacattgggacgatggggcacatcgaccacgggaagaccacgctcaccgcagcgatcacgaaggtcctctcggagaagaaccccaacgtcaagttcaagcccttcgatcagatcgacaatgcgccggaggagaaggctcgcggcatcaccatctcgatctcgcacgtcgagtacgagacggagaagcggcactatgcgcacgtcgacatgccggggcacgctgactacatcaagaacatgatcacgggcgctgcccaggtcgatggtgcgatcctggtggtcgccgcgaccgacggtccgatgccccagacgcgcgagcacgtgctgctcgcccggcaggtgggggtgccctacatcgtggtggcgctcaacaaggcggacatggtcgacgacgaggagctcctcgatctcgtcgagctcgaggtccgagagctgctgaaccagtacgagttcccgggtgacgacaccccgatcgtgcgggtctcggcgctcaaggcgctcgagggcgatccggtctgggaggagaagatcgtcgagctgatgaacgcggtcgacgagtacatcccagagccacagcgtccggtggatcgtccgttcctcatgccgatcgaggacgtgttcacgatctccggccggggtacggtcgtcacgggcaaggtcgagacgggcaaggtccacgtcggcgacgaggtcgagatcgtcggcctgcggcccacgcagaagacggtcgccacgggcgtcgagatgttcaacaagctgctcgacgagggccaggcaggcgacaacatcggtgtcctgctgcgcggcacgaagaagaccgacgtcgagcgcggccaggtgctctgcaagccgggctcgatcaccccgcacacgaccttcgaggccaatgtgtacgtcctgacgaaggacgaaggcggccggcacaagccgttcttcaacaactatcggccgcagttctacttccgtacgaccgacgtcacggggaccatcaccctgccggaaggtacggagatggtgatgcccggcgacaacatcgtcatgaccgtcgagctgctcaagccggtggccatggacgagggtcttcgcttcgccattcgcgagggcggccgtacggtcggcgcgggtcgcgtcgtcaagatcatcaagtagcacgtcagtgcgtcgacgagggccccggcacgtccggggcccttcggcgtcgacggacgaccggagcaccaaggagagccatgagcgacagcagtaagcagcgcatcagggtgcgtttgaagggtttcgaccacgagatcctcgaggcgtcgacccggcgcatcgtcgatacggtgacgaggacccaaggcaaggtggtcgggccggtgcccttgccgaccgacatccaccgctacaccgtcattcgctcgccccataagtacaaggattcgcgcgagcacttcgagatgcgcgtccacaagcggctgctcgacatcgtcgatcactcggccaagaccgtcgacgcgttgaagcggttggagctgccggccggcgtcgatatcgaaatcaagatccagaacgcatagcgagagatcgcagcatgatcggcccgcgcccgagtgcgcgggcagtatgctgcaagagttgtcttgcgtccggtcgtgcctcctctggagggaccttccggcggtttgagcggcgctacccgctcgtacgaggtcagctgcggcgtcgggtggacgctgcgtgaggcgaaggaaccatggcgaggaagacgtttgtcggtgagaaggtcggtatgacccaggtctggaccgagggtgaccgtgccgtcccggtgacggtgatcaaggtcgtcccgacgtgggtcgtgcggacgaagacgccggagcgagatgggtacgaagcggtgcaggtcgcggtgggtcgcgtcaagccgcagcggctgagtcgtccggttgcgggtcagttcgaggcccgaggtgtcgaggccggcgcccgcatcatggagctgcggctcgatggggcgtcgtcgttcgagcccggcgatcagatcgggatcgaggggatcgagccggggatgcgtctcgacgtcgtcggcgtgtcgaagggccacgggttctccggcggtatgaagcgccacaacttccgtgggcagggagcggcccacggtaaccacaagaagcatcgtgctccgggctcgatcggggcgtgcgccacgcccgcacgcgtgttcaaggggacgcgtatggcgggtcagtacggtaccgagcgggtcaccatccataacctcgaggtcgtgcgggctgagcccgagcgccagctcgtgctggtgaagggctcgatccctggtccgcggggcgccatcgtcgtggttcgtgattcggtgaaggggcggaagtagatggcgagcgccaaggtcatcgacgccacgggtcgtacgctgcgcgaagaggaactgccgggcgaggtcttcgcgcacgctcccaacatcgcgctgttgcatcaggttgtcgttgcggagcaggccggtgcgcgccggggaacgcattcgacgaagacgcgggcagaggtcgccggaggcggcgcgaagccctatcgccagaaggggaccggcaacgctcgccagggttcgatccgggcccctcagtacaagggtggcggtatcgttcacggccccaagccgcgcgactactcccagcgcaccccccgcaagatgctgcgcgcggcgctggcacaggcgttgtccgatcgggccagcgccggcgtgatctacgtgctcgaggacgacgtcatcacggcgccgtcgaccaaggcggcgcttgcctgtctgcgcggggctggtctcgaggatcgcaaggtgctcgcgctggtggccggtgcaaccgacgaggccgtcttcaagagcgtgcgcaacctccccacggttcgtgtccatcgggcgggcttggtgctggtaagtgcggttctcgcttccgacgccgtgctgttcacgcgcgcagcgctggcagagctcctcgggcgcgtgggagtggaggttgccaagtgagcggtcgggatccctacgcaaccgtcgtggcccccatcatttcggagaagagctacgggctccgcgaggagggcgtctacgtcttcgaggtggcgcctcgagcgaccaaggtggacgtgcgcgccgcggtcgagcggctcttcggggtgcacgtggtcaaggtcaacacgctcaaccgcaagggcaaggcccgtcggagccgccgaaccggtcgagtcagcgtggagcccacccgcaagctggcctacgtcaccttgcgcgagggcgagcgcatcgagctgttggagagctgagccatggggattcgtaagcgcaagcccacgagtgcgggtcgacggttccagtcgagttcggacttcgcggagatcacgaagcagcgtcccgagcgatcgctggttcgaccgctgtcgggctcgggaggacgcaacgccgacggtcacaagaccgcgcgccatcggggtggcggacacaagcggcagtatcgggtcgtcgacttccgtcgcaagaaggacggtgtgccggcgacggtcgcagcgatcgagtacgaccccaaccgcaatgcgcgcatcgcgctcttgcactatcacgacggcgagaagcgctacatcctcgcgcccaaggggctcacggtggggatgaaggtgagttccgggccggacgccgacatcacggtggggtcggccctcccgctgcgcaacatccccgtcggcaccaccgtccacaacgtggagctccgtcccgggcaaggcggcaagctcgccaggagcgccggtatgggcatccagctcgtcggcaaggacgaggtctacgcgacgctccggctgccctcgaccgagatgcgccgcgtcccgatcgattgtcgtgcgaccgtcggcgaggtcgggaacgccgaggccgagctgatctcgatcggcaaggcgggtcggaaccgctggcgtggcgttcggccgcagacgcgaggcgtcgcgatgaacccggtcgaccacccgctcggtggtggcgaaggcaagacgtcgggtggtcgccatccggtgtctccgtggggcaagccggagggccgcaccaggcggcgtcacctcccgagcgacaagctcatcatccgccgtcgtcgagcccgtggggcgaggaggtagtacgtgccacgcagcgtcagcaagggtccgttcgtcgatgcgcatctgttgaagaaggtcgacgagctcaacgcgtcgggtgacaagcgcgtgatcaagacctggtcgcgtcgttccaccatcattcctgacatggtgggccacaccatcgccgtgcacgacgggcgcaagcacgtgccgatctacgtcacggagtccatggtcggccacaagctcggggagttcgcgccgacgcggacgttccggttccatgccgggcaagagaagacggcgaggaggcggtagtggcagtcacagtgaccgagcgcccgcgctcgcgagcggtgctccggaactacggcgcgtctgcgtcgaaggtgcgagaggttcttggcatcattcgaggcaagccggtcgagcaggccattcgcgaactgtcgctcgtgagccgtggtccggctgaggcggtcggcaagctcctcgcgagtgccgtggccaacgcgacggtccagcacgggctgggcgtgtccgacatggtggtgcggctggcctatgcggacgaagggacgacgctgaagcggtttcggccgcgtgcgcgcggtcgtgcgacgcgcatccgcaagcggacgtgtcacatcacggttgtggtcgaggagatgacgctcgaggagcgccagcgcgccgtggcgcagaccggccgtcgtgccgtgagccgccagcggcgcgtgcagtcctctcgtcgcggacgccagcaggcgcaggcgacctcggcagaggcgacctcggcagaggtggccacttcgcagcccgagatcacgagcgaggcggcagcgtcggagcagacggtcgaggtcacggctgccgaggagcaggttgcagctctcgttgccaccggcgaggagaccggggccgagacgccgagcgccgcctcggaagaggccgccgagggcggggaggagtaggtcgtgggccagaaggtgcatccgtacggcttccgtctcggagtcacgacggactggaagtccaggtggtacgccgataaggactaccagcgttggctgatcgaggacgagcagattcgccagtggctccagcgcgagctgcgcacggcgtcggtgtctcgggtcgacatcgagcgcacccgtgaccgggtgcgcgtggacatccacacggcacgtccgggcatcgtgatcggcaagaagggtgtcgaggtcgagcggttgcggcgggagctggagcggcgctgcgcgccggctcgtgtgcagctgaacgtcgaggagatccgccaaccggatctcgacgcgaccatcgtcgcccagagcatcgccgaccagatcagccggcgcgtgagctttcgccgagcgatgaagcgtgcgatccaggtggcgatgaaggaaggcgcgcgtggcatcactgcccagtgctctggtcggctcggtggcgcggagatggctcgccgagagacccatcgcgagggtcgggtgccgcgtcacacgttgcgtgccgacatcgattttggcctgcgtgaggcgcgaacgacctacgggcagatcggcgtgaaggtctggatctacaagggtgacgtcgtcccctaccagacgctgacctcccagccgcagcggccgccggtcgcgggtggtcgtccgaccggaccgatccgcgcccagactggatcgcggcgtcggcccgtggccgaggcaccgaagccggccgcggtgggtgcggagagtcaggacgagttcgagcgcttgctcgccgaagaggaggagatcgagcgacgtacccgtgaggagggtcgcgaggctccacacttcaagaaggaggtggactagcgatgctcatgccacgcaaggtgaagcaccgcaaagtccagcggggacggctcggcggagaggccaagggtggtaccgagatcaccttcggtcgctacggtatccaggccctcgagccagcgtgggtgacggctcgccagatcgaggccgcgcgtatcgcgatgacgcggcacgtgcgtcgcggtggcaaggtctggattcgcatcttcccggacaagcccatcaccaagaagccggctgagactcggatgggttcgggcaagggcaacccggagttctgggtcgcggtggtcaagcctgggcgcattctcttcgagctcgacggcgtgggcgaggagctcgcccgtgccgccatggagcgcgcgatccagaagctgccgatgaaggcacgcttcgtggtgcgcgaggacgtggaagcgttggcgggaggcgccagatgacgagggcacgagagctgcgcgacctgagcccggaggcgctcgaggagcgactcggttcgctcaagcgagagctgctcgagttgcggttcgcgatcgcgaccggccagggaacccagacggcgcggttggggcagctccgcagagagattgcccgtgtggagacggtgcgacgcgaggcggcgtcggcgaccgagacgacccgagtgacgcgggcgaggagcaggagacggtgagcgaggagcagcagcaagagcgaccccggcgcaaggtccgcgaagggatcgtggcaagcgccaagatggacaagaccatcgtggtggagatccatcagcgggttcgtcacccgcgctaccagcgcacgatcgcgcgtcggcgtcggctgtacgcgcacgacccggcgaacgaggctcgcgagggcgaccgtgtcgagatcgccgagacgcggccgctgtcgcggctgaagcgctggcgtctcgttcgaatcgtggagcgtgcacggtgatccagcaggagactcgactgaaggtggcggacaactcgggcgcgcgcgaagtgctctgcatccgcgtgctcggtggttcgcgtcgtcgctacgcgagcattggtgacgtgttcgtcgcgacggtcaaggacgcactccccggcgcggccgtcaagaagggcgacgtggtcaagtgcgtcgtcgtgcgtactcgcaaggaggtacgtcggccggatgggtcctacatccgcttcgacgacaacgctgcagtgctgatcaacgaccagctgcagccccgtgggacgcgcatcttcgggccggtcgggcgcgagctgcgtgacaagcggttcatgcgcatcgtgtcgttggcaccggaggtgatctgagtgcgcattcgtaagggagatcgggtccgcgtgatcgcggggaagtggcgcggggccgagggcgaggtgcttcgggcgcttccggcgcgccatcgcgtggtcgtcgacggggtggcggtcgccaagcgccacaccaaggcgcgcgatgcgtcgagcccgagcgggatcctcgagaagaccctgccgatcgacgtctcgaacgtgatgatcatctgccgcgcatgtgggccgacgcgcatcgcgatgaaggtcgacgacgccggccgtcgccagcgggtctgtcgacgctgtggaggagcgctgtgatggttcagaccgatacggcccccaggccgcggctacgggtgcgcttcgacgaggaagtgcgccccgcattgttccgagatctcggtctcgagaacgtcaaccaggtgcccaggctcgccaagatcgtggtcaacatgggcgtagggcgggccagcgcacagccgagtctgctcgagggagcggtccgcgacctggagacgatcacgggccagcgcccgtcgatccgcagggctcgcaagtccatcgcgggcttcaagctgcgcgagggcatggcgatcggggcgacggtgaccctgcgcggcgaccgcatgtgggagttctacgatcggctggtcgcggtcgcgattccccgcatccgtgacttccgcgggctcaatccccggtcgttcgacgggcacggcaactacacctttggcgtcacggagcagctgatctttccggagatcgactacgactcggtcgacaccacgcgtggtatggacatcaccatcgtcacgaccgcaacgacggacgcgcatgggcgtgctctgctcgaagcgctcggttttccgtttcggagggaagggtaatggcgacgaaggcgctgatcgcgaaggcgaaccgcgtgccaaagttccgtgtgcgggcctacacccgctgcaagcggtgcgggcggccgcacgcggtctaccgcaagttcgggctgtgccgtatctgcctgcgcgagatggcgcacctcggcgaggtgcccggcgtgaccaaggccagctggtaagggggtaggcgaatggcaatgaccgaccctatcgccgacatgctcacgcggatccgcaatgcgtcccgcgcgcgccacgcctcggtgacgatgccgagctccaagctcaaggtggagatcgcgcgcatcctcaagcgcgagggtttcatccaggactatgcggagcgcgagagcgccgtggggccgcgcaaggatctcgtgatcgagctgcgctacgtcggtgatcgacgtgcgtcgtcggcgatccacggcatcgagcgcatctcgaagcccgggctgcgcgtctatcgacaggccgggtcgctcgagcgggtgctcggaggcatggggatcgcggtggtgtccacctcgcacgggctcatgacggaccgtgaggcccgagcccgacgcgttggtggcgaagtgatctgtcacgtctggtaggaggaacgatgtcgcggattgggaggcaacccatcgcggtgcctggcggcgtcgaggtggcggtggatggccagcacgtgtcggtgcgcgggccgaggggttcgctcgctcgcgacctgccgccggaggtcacggtgagcgtggtcgacagcgtggtgcacgtcgaacggagcgatgactcgaggcgcgctcgggccatgcacgggctctcacggacgctggtcgcgaacatggtgcgcggtgtggccgagggctacgagaagacactggagatcatcggaacgggctatcgcgcccaggcgcgtggcaccggcgaactcgagctcgcgctcggcttctcgcacccagtcgtggtcgaggcgcccgatggcatcgcgtttgcgacgccgacgccccagcgcgtcgtggtctcgggcatcgacaaggaactcgttggacaggtggcggccaatatccgccgcatccgcaagccagagccctacaagggcaagggtgtgcgctacctcggcgagcgggttgtccgtaaggccggcaaggccgggaagtaggtaggagacgatggcaacgctgtcacgggaggatcgtcggcgccgtcggcacgcgcgtgtgcgccgcagggtcgtcggtacgagcgaacggccccggctggcggtcttccgatcgaatcggcatatcttcgctcagatcatcgacgacacggctgggcgtacggtggccgctgcctcgacggtcgagccagagctgcgcgatgggcgcaccggctcgacggagggtgcggcgtcggtcgggcggctcgtcgcgagtcgtgcgttggcgctcggggttcgccgcgtcgtgttcgatcgaggtgggttccagtaccacggtcggatcgcggcgttggccgacgcggctcgcgaagcgggattggagttctaggtggcgacaaacgagttcgaagaccgcaccatcaaggtcaatcgggtatcgaaggtcgtcaagggcggtcgtcgattctccttcacggcgctcatggtcgtcggtgatcacgcgggccaggtggggctcggctacggcaaggccaaggaggcgagcctcgccgtgcagaagggggtcgacgaggccaagcgcaagctggtgcgcgtgccgctcgtccacgggaccatcccgcacgcggtggtcggcgtcgcgggagcggggagggtcttgctcaagcctgccgcacccggtacgggtgtgatcgccggcggtgctgcgcgcgcgatcttggagcttgccggcgtcaccgacgtgctggcgaagtccctcggttcctcgaacggcattaacgtggcctatgccacactcgcaggactcgaggcgttgctctcgccgcagcgcatcgccgaggctcgtggtcgttacgtggatcaagtcgctcctcgatggctcatcgaggagagtccggcgcgtgtcgatggagaagtcgtggaggttggggccgatggctaggcagctgcgcatcgtgcaggtccgctcggcgatcggtgccaagcccgagcaccggggcacgctgcgcgcgctcgggctcggacgcatcgggcgggagcgtgcgctcccggatcgtcccgagatccgcgggatgctggctcgcgtcgcccatctcgtcgtcgtccgtgaggaggaacaggcatgatttacctccatgatctcaagcccgccgagggttcgcaccatcgcaagcggcgcgtcggtcgtggcatcgcgggcaagggcggcaagaccgccggccgcggcacgaagggtcaaggcgctcgcgatacggttcccgtcggcttcgagggcggccagctgcccttgacgcagcgcacgccgaagctgcggggctttcgcaacccgttccgggttgcctatacggtcgtcaacctcgaccagcttgctcggcttggcgaggagggcatggccgaggtcgatccgacgtcgctggtcgcgcgcggggtggttcgtcgcggcgcgctcgtgaaggtctgtgctcgcggagagctgcatgcacccctcgtcgtgcgcgcccatgggttctcgcaggcggcgaaggcggcgatcgaggctgctggcggccgtgtcgagacggtcgcggtccccttcaagggtcctcggcctcgcgctgccggcagcgcgttgtccaaccgctgagcacgatcggcggggaggcaccgtgatcgagaatttcctgaacatcgtccgggtgagggacctgcgcaacaaggtcctgttcacgttggcgatgatcggcctgtaccagttgggttcgaacatcccggtgcccgggatcagctaccacgcgatccaacaggtcttctcggaggcctcgggccagggtgtcctcggcttcctcgacctcttctctggcggtgcgctgtcgcgcgcggcactgttcgggttgggtgtgatgccctacatcacctcgtcgatcatcatccagctgctcaccggcgtcattccgaagctctatcagtggcgggacgagggatcgtctggcgagcgcaagatcacccagacgacgcgctatctcaccatcgggctcgcgctcgtacaggccactggcctcgtgttcgtgttccactcggggctcggcctgttccttgcgaacggtcagagcgtggacctgatcccgcagttcacggtgttgcgggtgctgttcatcattctgaccctgaccgccggtacggcgctcgtgatgtggatgggcgagctgatcaccgagcgcggggtcggccaagggatgagcatcctcatcttcgccaacgtcgtgagcgtgatcccgaccgcggggcgcctgatctatgaccaggcgggcgcgctcaagctcatcgtgatcgtggtcgtggtggtcgcgctcctcgttgcgatcgtcttcgtggagctcgggcagcggcgtatccccgtcgtgttcgcgaggcgcgtcgtcgggcgtcgcatgtacgagggcgggcggacgtacatcccgctcaaggtgaaccaagctggggtggtgccgatcatcttcgccgcctccatcttgtacttcccggtgctgctctcgaacatcgtgcgctggaagccgctcgtcaccttcgtcaacgatcacctgctcaacgccacgagtggcttctacatcgtgacctacgggctcttgatcttggtcttcacgttcttctacgtgacggtgtcgttcgacccgtaccagcaagccgacatcatccgacagcaaaacggctacatcccgggcgtgcggccgggcgaggagaccaggcggtacctgtctcggatcttgaaccgcatcaccctcccgggcgccgtgttcctcgctgccgtcgccgtgatcccatcgattctgctcgctgcgtggcacgtgacgtcgttcccgtacgcgggtacgaccatcctgatcgccgtcggtgtcggtctcgagaccgtgaagcaggtgaactcacaactcaccatgcgcaactacgagggattcttgcgctagatgggggacgcggcacttcggcttgcgctgctcggtcgacagggcgcgggcaaaggcacgcaggcggtgcggatctcgcaccactttgcgatcgcgcacatcgccactggggacatcttgcgagctgcggtgcgcgccggtacgccgttcggggagaaggccaaggcctacctcgatcggggcgaactggttcccgacgcggtgatcatcggtgtcgtcgccgagcgcctctccgaggccgatgcgacgcgacggggcttcgtcctcgacggctttccacggaccgtcgagcaggcggaggcgctcgagggtctgctcgctccgcatggactcgacgtcgtgatcgatctcgaggtgcctgagtggctcgtgctggagcggctggcgtctcgccgggtgtgttcggtgtgcggtgccaactactccacgtccatgccgcctcgggtggactggacgtgtgacctgtgcggtggtgaggtggtccagcgtgcggacgataccgaggaggccatccgacgccgcctggacgcctacgagcgccagacgaccccactcatcgagtactaccgggagcgggagctcctcgaggtcgtcgacggtgtcgggggcccagaggaggtcatggagcgcatcctcgaggcacttgcccgacacggtgtggtggaggagggtcgatgaggcgttcggcgacagagcttgcgtcgatgcgcaaggcggggcgcgtcaccgcagcgatgctggaggcgacccgtgaggcggtcaagcccggcatctcgaccgcagccctggatgcgatcgcgcgctcggtgctcgagcgcgagggtgcgcggtcgaacttcctcggttacggcgggttcccggccgtgatctgcacctcgcgcaacgaggtcatcgtgcacggtatccctcgagaggacgagatcctcgaggagggggacgtgctgtcgatcgacgccggcgcgatcgtcgacggctaccacggagacgccgccatcacggtgcccgttggcgaggtctcgaaggctgcggcccgcctcatcgaggtgacccgtgaggcactgtgggcgggcatcgagaccatgcggccggggtcacatctccacgagatcggccgagccgtggaacgcgtggcgaagcggcaccactacggcgtgatccgcgactacgtggggcacgggatcggcaccgagatgcacgaagccccgaacgtgcccaactactggcccggtacgcccggccccacgctcctcgccggggaggtgttcgccgtggagcccatgttcacgctcggcacggaacgcacgagggttctgcgcgatggctggagcgtggtcaccgccgacgggacgtgggcggctcacttcgagcacaccatcgcggtgacggaggacggacccgaggtcttcaccctgggcccggatggccgttgaggcgagcgcactatactgcgtaggcaccggttttgcgcccgtcgccacgtcgtggcgtgtccgggcacgaacgatcgagagtaggaggacccactggcaaagggcaaggaggacacgatcgtcctcgagggcacggtggtcgagccgctgccgaacgcgatgttccgtgtcgagctcgagaacgggcacaaggtactcgcgcactcctcgggcaagatgcgcatgcatcgtatccgcattcttcccggagatcgtgtccaggtggagttcaccccctacgacctcacgagggggcggatcacctaccgctacaagtaggtccggagccagcgggtgcaaggtcgacggatcggttccggccagatccgtgtactgacagagaggaagccgacgtgaaggttcgtccgagcgtcaagccgatgtgtgagaagtgcaaggtgattcggcgcgagggtcgcgtgctcgtgatttgcgagaacccgcgccacaagcagaggcaggggtagacgatggcccgtatcgcaggtgtcgacatcccgcgtgagaagcgggtcgaggtcgcgctgacctacatctacggaatcggcccgacgctcgcgcgtcaggtgctcgaggccaccggggtcaatcccgatacgcgcgtgcgcaacctcaccgacgaggaggtcctcgcgctccgcagctggatcgatcagaacctgaaggtcgagggcgatctgcggcgcgaggtcgaccagaacatcaagcgcaagatccagatcgggtgctaccagggtatccgccatcgtcgcgggctgccggtccgcggacagcgaacccacaccaacgctcgtacccgcaaggggccgcgcaagacggtggcgggcaagaagaaggcacgccgctaggcgctcatgcgggcacgcgagcgtgctcgcggtgggcgaacgagtggagccagagtctctggctccgagggatgaacgagggaggttccccgtcggcgtggccggcacgggggaaccgaagaggacgcgagctgagcctcgccgagcaaggagcacacagagcgcatggcacgaccgaaggtaggagggcggcggccccggcggcgcgaacgcaagagcatcgcgcgtggggtcgctcacatccactcgtcgttcaacaacacgatcgtcaccatcaccgacccggctgggaacgtgatcgcgtgggcgagttctggcaacgtcggcttcaagggatcgcgcaagtcgaccccgttcgccgctcaggtcgcgggtgagacctgcgccaagcgagcgatggagcacggtgtgcgcgaggtggatgtctacctgaaggggccgggatcgggccgcgagacggcccacaaggcgctcgctggtgcggggatcgagattcgttcgatccgagacgtgacacccgtgccgcacaacggctgccgtccgaagaagaggagaagggtctagatggcgcgctacaccggaccggtgtgccggctgtgccggcgtgagcggacgaagttgttcctcaaggggccgaagtgcatgagcgcgaagtgccccattacccaaggccgggttcctccaggccagcatggtcgggatcggcagcgtcaaccgtccgagtacgcgatccagctgcgcgagaagcagcgcgcgcgccgaacctatggcgtcatgggcaagcagttccagcgcttctatcgtgacgcggcgcggcggtcggggatcacaggcgagaacttgctcgccttgctcgagcttcggctcgacaatgtggtcttccgtgccctgtggggctcctcacgggcgcaggcgcgtcagctcgtccgccatggccacgtcctcgtcgacggtcagcgggtggatatcccgagctatcgcctccggccggggcaggtcgtgacgctgaatcccaaggcgcgtgacctcgacatcattgcgttcaaccgagagcacctgacccgtgaggtcccggcgtggctcgaggtcaccgacggggggtctggagtacgcgtgctcagcgtgccgctgcgcgaccagatcgacaccgaggtccgcgagcagctcatcgtcgagctcttctccaagtagcacgcttctcgaagtagcgaggcagcaaccatcagtcagaaggaaccaaccatgcttgtcatgcaacgccccacggtcgagtcgctcggtgacgaggtcgacaatcgtcaacggttcgccatcggaccactcgagccagggttcggccactcgatcgggaacgcgctgcggcgtgtgctcatctcgtcggtcccgggcgcggccatcacgcaggtccgtttcgatgatgcgctgcacgagttcacgacgatccccggggtgaaggaagatgtgatcgacatcatcttgaacctcaaggacatcgtgtggcgttcgtggagtgaagagccggtcacggtgaggctcgacgttcgtggccccaaggaggtcacggcgggagacttcatgctcccctccgacgtggaggtcatcaaccgcgatctccatatcgcttcggtgtcggagcacggtcggttgggtctcgatgcggtggtcgagcaggggcgcggctacgtgtcggcggagggcaacaagcgcaccaccaccatcggcatcatcgcgatcgacgcgatcttctcccctgtgcgtcacgtcaactaccgcgtcgagccggttcgtgtcggtcagtcgacggacttcgaccaggtggtgctggaggtcgagaccgatggctccgtgacgccacgggaggccgtcgcctctgcggcccggacgctcaccagcttgttcggcctcgtcgccgagctcgcgaccgacgtcaatgcgctcgaggtcgccgcgaccgccgacgacagcgtgcgaccggccgagtacgacctccccatcgaggaactcgagctcacggagcggccgcggaactgcttgaagcgggcgagcatcaacaccatcggtgatctggtcgagcgcacccctgaggatctgttgtcgatcacgaacttcggccagaagtcgctcgacgaggtcgtcgagcgcttgacccagcgcggacttgagttgaggaagagggactgacgtggttccaggtcgaccgaagaagggtaaccgactgggcaaggacgctgcccaccagcgagccatgctggcgaaccttgcggcgtcgctcatcgaggccgagtccatccagaccaccgaggccaaggcgcgagccctgcgcccggtcgtggagaagctcgtcaccaaggcgaaggcgggcgatctgcaccgtcggcggcaggtgttggcgttcctgcgcgacgaggatgcgaccaccaagctgttctcgaccgtggggccgcgctatcagaatcgacagggtggctacgtgcgcgtcttgaagctcggcccgcgtcgtggcgatggcgcccccatggtggtcgtcgagttcgtctgaccggcgctcctcgcgcgaggcggcccctgcgtggtggtcggtctccgggaggtgtcgacgggtaggagcccaggtgggagcagtggagaccctcctgctcgtcgttggctacgacgggcgggagttcgcgggcgctgccccgcagccgggagtgcggaccgtcgtcggtgcgctgcgctccgcgctcgagctcgtgttgcaacgaccaacgtcgcttgcgatcgcaggtcggacggacgccggtgtccacgcgcgtgcgcagctcgtgagcgtacccctccagcccggggagcgggcgcggctcggggatgtggagcgtctgtgtgggcgactcggtcgactcgccggtcgggggctctgggtcaggagcgcaggcgtgctccctgggtccgtcgacgcacgcagggtcgcccgctggcgacactacctctaccggctcgatctcggccatggggaccgtcggggtcgggtgatactcgagccgacggcctgggcgtgtgggccgctcgagctcgacgtgctcgctggcgcgctcgcgacgttgcgaggcgacctcgatgcgaccggactgtgtcgtgccggcgccgcgggaggctatcgtcgcagggtgctctcgacgcgggtctgggcgcgcgcacgagatcgtgtcgacgtctccgtcatcggggtgtcgttctgccacgagttcgttcgtcgagcagtcgggaacgcggtcgcggtggcgcagggccggctcgacggggagcgctggcgcgagggtgtcgaccgaggcgagcgggcgctgctcgcgacggtggcgccaccgtggggcttgtcgctgtggcgcgtcgggctcgaggacggctgggagtggtcggaggagcgactcgcgcgcctggggtcggatgccgactggcgtacgctcgatccgcgcgaagagcccgcggtgtggggcgcagcacgaggcgcagaccggtagactgtcgcggtgcgctcacgcgggcgtctcgctgtgggccgcgcgtgagtgcggcgctcgaggctgaacgcagtgacgagcgtcgatggcgcgggcaccgacggcatggtcggtcgaggcagtggtcggtcgagcccagcggcgtctcgtggttggcgggcccggagcgggttggcgtggaaaggacttcggcggtgaggacgtacagtcccaaggcggctgagatcagccgcacctggtgggtggtggacgcggaagacgtcgtcctcggacggctcgcaaccgaggtggctcgggtgttgcgcgggaagcacaagccgacgttcacgccgcatctcgacatgggcgatcacgtcatcgtcgtgaacgcggacaagatccgggtcacctccgacaagggtgccacgaagcgctactggcgtcactcgggttatcccggcggcattcgctccgagacgctggcggaacggctcgcacgccaccccgagcgggtcgtggaggccgcggtgcggggcatgctcccgaagaatcgcctcggcagggcgatgtatcgcaagttgaaggtctacgccggccccgagcatccgcaccaggcgcagcagcctcgagtcctgtcgctcggtcagccgagcctcgtcacccaaggggagcacgcatgagccagacgctcgttcaggccacgggccgccggaagacggcggttgctcgagtccgtctcgtgccagggtcgggttctgtcatggtcaacggcaaggagctcgcatcgctcccggtgacgctggcccagcgtgcgttcatcaccgaaccgctgcgactcgccgaactcaccgagacctacgacgtcgtggcgcgcgtggacggtggtggcgtcgccggtcaggtcgcggcgctgcgccacggccttgcgcgagcgatcgcggaactccaccccgagctgcgcgtgcgcttgaagcgcgagggcatgctcacgcgcgatgctcgtgagaaggagtcgaagaagtacgggctcaagaaggctcgcaaggctccgcagtactccaagcgctaatgctgaccttcggcacggatggtatccgcggccgagccaaccaggagctcaccatggaggtgggcctctggatcggggtcgcgatcgccgaggtgctcggtggcaccacggtcgcgatcggtcgggacacccgtgcgtccggtcgctggctgtccgaggccgtgggtctggggctcgccgcttcgggcgtggatgtggtcgatgttggggtggccccgaccggggcgctctcgttcgttgcgcgcaccgagcagctcccgaccgtcgtcgtctcggcgtcgcacaatccgttctacgacaacgggatcaaggtgttcgctcccacgggagccaagatcgagcccgccgtcgaacgtgccatcgaggagcgtctcgcgacgcatcttggtggcgatcggccgacgttcggacctctcggccgctaccggtcgtcgtcgttcctggacgcctacgtcgcttggctcgccggtgccgtgtcgatcgagggtgcgccacgcgtgtgcatcgatgcggccaacggtgccgcggcggtcgtcgcctcgcgtgtgctcgaggccgctggtgccagggtcatcggtgccatcggggtcgagccggacggtgagaacatcaacgcgggcctcggagccctgcaccccgagaggcttggccatctggtgctcgcgacgggcgccgatcttgggctcgccttcgacggtgatgctgatcggctgatcgccgtcgcgccgagcggagcggtggtcgacggtgacgacgtcttggtgatcgtcgccgaggcgctggcggccgatggtcggctcgcgggccctggcgtggtcgcgaccgtcatgagccatctggggctcgagcgcaccctcggaccgcagggcatcgcggtggaacggaccggtgtgggcgatcgcgaggtcgctggagggctcgtcgagaccggctacgggctcgggggtgagcagagcgggcacatcatcttccccgcgctcgccccgaccggtgatgggctcctcacggcgctcatgctgctccaggcgctcggtaggctcggcgtccatgccgacgaggccttggcggcccgcgtgcgctacccacagatccaccgcaaggtccaggcacggcacggccgagccgtgctcgactcggagctggtggtcgaggcgctgcgcaaggccgaggagcggctcggcgaggaaggccgcttcgtcgtgcgacccagcggtaccgagccgatcgttcgcatcatggtcgaggcgacgacggagccggtcgcgatcgaggtcgccgagtcgatcgaggcagcggtgcgcctcgcgacctcgacccttggcgactgagcgcggctacgctcggtcaacgaccaggtccgcgcgtggcgcgggcagaaggaggccggtgtgtgcgggatcgtgggagcagtcggcaccggggatatcgcgggtgcggtcttcgaaggcctgcgacgactcgagtatcggggctatgactctgcgggcctcgccatcgtcgacgacgctgggatcatcgaggtcgccaaggccgcgcacgcgcgcacctcgctcgccgagctgaaggacagcgtggatgcgttcgatggtcggggggcgcgtgtcggtgtcggtcatacgcgctgggcgacccatggtgccccggtgctcgtgaacgcccatccccacctcgattgcacccatcgcgtcgcggtggtccacaacgggatcgtcgagaacttccggagcttgcgtgaggagctcctggagcggggccatcgtctcgtctccgacaccgacacggaggtgatcgcgcacctgctcgaagagcagctcgtcgatgaggcgcccgacgtggcgctcgcgtcggtgttcgcgaggctcgtcggccacatggcgatcgcggttgcgctcgccgaccatccggggctggtactggcgatccggcgaaccagtccgctcatgggtgcgcgcagcgtcgatgccgagttcgttgcgtccgacgtccccggggtcttgcaccgtgccacggagttcttcgaggtgcccgaggacgaggtggtcgccatcggtccggaggcggcgggcctgtcacgggctcggcgcctcgaggaactggtccgaccccagatcagctggacgagccaagacgtggaactcggcgggtacgcgagcttctacgagatggagctcgccgcaggcgccgaagcgctgtcacagacggtcgcgtcgttggtcgacgtggacgggtcggcgatcatggacgccctcgacgtcgatcccttcgagctcaagcgcatccgcaaggtcgtcgtcgtcggggccggcacgagctaccacgcgggcctcgtcggccgtttcgccatcgagcactacgcgcgcgtgccggtcgaggtggacgtcgcgagcgagtaccgctatcgcgatccgatcgtcgacgacgggaccttggtcatcgccgtgtcgcagtcgggggagtcgctcgacaccatcgtcgcggtccgtgaggcgatggctgcgggtgcgcgcgcgatcgccatcacgaacgtggtcggctcgcagctcgctcgggtcgctgacggcgtcctctacacgagggcagggcccgaggtctcggtcgcggcaacgaagacccacctcgcccagctcgccgccctcgagctgctcgcgctctggctcggggagctccgcggcgtcttgttccccgaggaggccatcgagcggcggcgggcactcggcgaggtggcacaggcggtcggatccgtcctcgagcagaccgaagcgctcggagcgacgttccgcgagctcgcatccagccaacggttcttcttcatcggccgcaacgtcgccctcccggtcgcgatggaaggggcgctcaagctgaaggagttgagctaccttcctgccgaggcgtacgcggccggcgaactcaagcatggaccgatcgcgatgctcgatcgggaggcggtggtggtcgccctcgttcccgccgaccgactgcggccgaaggccctcgccaacctcgaggaggtcaaggcgcgcggtgccaccctcgtcgcggtggtcgcgggtgaggacgcgcgcgtcacggagttgtccgacgtcgtggtcgaggtgccggcgacgccgccactgctgttcccgttcgtcggcgtcgtgccgctccaggtcttcgccggcacgatcgcgcgcgaacgcggactcgatctcgaccgccctcggaacctcgccaagacggtgaccgtcgagtagggcacctccccgggtccgcgaccgccgtggaccaccagcgggtggcgcctcgcgaatcggctcgactcgaacgtcggggttgcatgctccacacgacgcagcaccgctcttcggagcggtgctgcgtcgtgtgggaggctgcgtgcgtgcgcgctgcgctcagtcggcgagggcgaggccggtcactgatcggcggcgatcggcgatcgcagcgtgcagggtgcggagcgccaccatcgtccacagggcgaccagtgcgacggcgagcccgaccgcgaggtcgtggatcggggagacgtgggtcgcgatcgcgatctcgccaaccccagtcgtgaggacgccgagcgggaaggtgaagccccaccagccgatcgtgaagggataggtgccgcgccgtaggtactcgagggagagggcgccggcgacgaggagccaccagaggccgtagccagcgaggatgagcgcgccgacgacaccggcaccagcgagcgtggtcgagagcgcggacggcgtgagcacggtgagatcgtgaccgagggcggcgatggcggcggccccggtaccgagcgggccgaggatgagccaggtcgatgtggcgaggtgcggtgcggggaggtgatgggtgacgaggcgaagcgtgatgagggcgatcagcgacaacgcaagaggcaccgagaaggcccagaggagatagccgccccagacggcgtcgaccgcgagtgcgtggtcgaaccggggcgcgacgagcgcgagctgaaaggccgtgacctcggcggggacgatcgggaggagccaggttgcgttgacgtcttcgagcgtggcgagatggtgcgcgaagaggcggtagggcacgtagaggacggagacgagggtcatgacgagcgtgaggacgagccacacgcccagcccttcggtcgtcgcggcgtgggagcccagcacgttgggttcgagcttgtcgatgccgttcgagaccgacgacatcgccatcggcacacatccaaggaacagcacccgtgcagggttgtcgaggagctggcggaggcggaggcggtgccgggcaaaggtgatcacggtgatgagcgcgagtatgaggaggccgatcgcgttggcgacgacgatgatccggccgatggtcgtcagggcgggcgagatcgtcgggagcaggacaccgacgatgccggtgcccatgatgagcgagtagtactcgaagccgagtgagggcaaccgtcgagcggtgggccgagatgcggtgtggttcatcgatgctcctaccgtgggttggaagtggtttcgtgctgtgaactatcatggcggtagcgaaacgaaggtatgctaaaagtaatgaaacttactgattccatcactgagcgaatgattacggtcgacgagcgccggatcgatccgacgtacctcgtgacgctcgccgtggtggccgagacgcacaacctctcggacgcagcgaagatcctcggcatctcgcagcccggcgtttcgcagcagctcaagcacctctccgaagccgtgggccagcgcctccacgtccgctcgggtcacggggtcgagctgacggtcgcgggtctcgatcttgcgcggcgggctcgtgacgtgctgcgctcctggcgaggcgtgctcgactacgtcgagagcgtccgccagggcaacgacggcatgctgctcttggccgcgtccaacaccgtgtctgcctacgtcgtgccccgctggctggttcggttccgccagcgctatcccggcgtcgacctgcggagccgttcgctgaactcggccgaagtcgtcgagcgcgtcatcgacggcgaggccgaggtgggcgtgatcgagtcaccggtcgagtcgttgccccctgagctggtcgagatcgtggtgggcggcgatcgcctcgtctacgtggtcagtccggcagtggtcagcttcgcgaacaaccaggtcgtcggttggggcgaagtggcgaggatcccgctcgtgctgcgggaagtgggttcgggtgttcgacgcgccagtgagcaggcactgcgcgctcgtggactggccccccggctcgagctcgagctcgctggcggtgaggcggtcaaggaggcgatcctccagggggtcggcggtggcttcttgtcgtcgctcgcggtcgcgcgcgagctcgcgaccggtgagctggtcacgctcgtcattcgcgagctcgataccatcgctcgactgtttcgcatcatctgtcggcccaaggacgacctctccctgccggcgcagcgctttctcgagatcgccgaggcggtcggcgttgcggagccggtctagatgcaggtcgtgaccgggatcgacgtggtcgaggtcgaacgcttccggacggtgctgctgcgaacaccgaccctcgccgagcgcgtcttcaccgaggccgagcgcgacagcgcgaagggtcgaccggcccagctcgcggggcgcttcgccgtgaaggaggctgcgttgaaggcgctcggcgtcgggatcggtgcggtccccttgcgcgaactcgaggtggtgtccgatccgtcgggggcgccgcgactcgagctcggccccggggcgcgagccttggccgatcgacgaggctggtcgtcggtgagctgttcgatctcgcacgagcgttcggtcgcggtggcggtggtggtcgccttggtggtctgatcggaccgatgccctaggcttggcgctcggcccggaggaggccgccactgggcgatcactgggccgccactggggaggtgtgcgtgcaaccgatcgtccgacgtgctggcgtccgagccctcgacgagcgactggcccgcgagggcctcgtggacgcgacgatcgaacgggtcggccgcgccgtcgcgcgtgagctgcgtcgatccaggggagggctctacggtacccgcgtcgtcgtgatcgccggtcccggtaacaacggtcgcgacggcgtcgccaccgcgcgagcgctcgcgggctggggagcgagtgtgcgggtggagtcccttcgcgacgtggtggcgggcgcggcgaccagcgccattggcacctgcgacctcgtcgtcgacgccgcactcgggaccggtccggcgcggccgctctcgccgctcggcctcgagggcgtccccgaggtggtcgccatcgacattccgtcgggtatcgatgccgacacgggcgaggtgacgggggcggacctcggaggcgtggccgtcgtcgcccaccgcacgatcaccgtcggggcgctgaagcccggcctcctcgtgggggaggggccggagcacgccggtgccatcgtccgcgtcctcgacgacctcgtgcccgaggacgtggatgcctggctcgtcgagcgcgacgacgtcggccaggtgctgccgaggcccggacgcgatgcgcacaagtggcgcagtggcctcttcgtgctcggtggctcaccgggcatgcgcggcgccccggccttcgtcgcgcgcggggcgcgagccgtcggtgccggcatcgtgcacgtgctcaccaggagtgagcccatggagtccgtggcgctcgagatcgcgcccgaggtcgtcgcgagacgtctggtgaccggccacgtggatctcgcggtcgccgaggctgagcgcttcggcgcggcggtgatcggacctgggctcggtgacaccttggcgagcgcgaacctcgtgcgtcgcgtcgtttccggtctcggggtgcccttcgtgctcgacgccgatggcctcacgtcgctcgcgggcgagggtcgtctggcatcggtgctggcccagcgccgcgcacccggcgtcatcacgccgcacgacggggagctcgcccgggtggccccgcaccttggtggtacccgtatcgagcgcgcgaagggcgcggcggccgagttcggcgtcgtcgtcgtcgccaagggcaacccgaccgtcgtcgccgctcccagcggcgagaccatggtggtcgctgccgggacggcacggctcgcgagcgcgggcaccggcgacgtcctcgcaggcgtgatcggcggtctccttgctcaggggctcgatcccctgcgtgcggcgtgggcgggtgcgtggctccatggcaccgcgggcgcgcagcttgccatgcgcctggccgcaccgacggcgctcgcggatgcgatcggcaggctcgtcgcccagatggtgccgatccccgcccatccgggggcctccgtggaggcgcgcccgtgatcggccatcgaccgacggaggcgcggatcgatctcgagcggctgcgtgcgaatgcgcgtctgctcgccgagcgtgcagctccggctgcgctcagcgccgtcgtcaaggccgatgcgtacgggcacggcgcgagcacggtcgctcgcgccctcggcgatctcgtcgacgccttctgcgtcgccaccgtcgaggagggcctcgcgctgcgtgccgcgggggtcacggggcgcgtgctcgtcttgtccgagcctcccgagtcggccgtgtcggcgtgtgctgcgagttcgctcgagcccttcgtcgagcacgagcgcttcgtggaggcgttggcgggggcggcctcggcgctcggccgcgaagcctcggtccacatcgacgtcgacacgggcatgcatcgaagcggtgtgcacccggcccaggcggccacgctcgccgccagtgctcgtcgccacggcgtgcgcgtcgtcggggtcgcctcgcacctggttcgtgcggacgaagcgcccacgcatccgacgacgctcgaacagctctcgaggttccgcgaggtcgcggctcgtatcggggcgcctgagcgacacctgctcgcgaccgggggactgctcgcactgcccgaggggcgcttcgagcgggtgcgcgtcgggatcggcctgtacggctatggacctcgacgcgacgatgtggcgggactgcgtccggtgctgcggctcgtgagccacgtcgttcgcttggaggcccttggcgccggtgaggcggtgtcctacgggcatcgaaggccactcgacgtgcccgccgaggtggcgacgctgcccattgggtacgccgatggcgtgcctcgcgccgccttcgacgcgggcctcgccttctgggccaagggtgtccgactgccgatcgcaggcacggtgaccatggaccagaccatggtggcagcgccacgggggctgctcgccctcggcgatgaggtctcgctcatcggggacgaggtggatgcctgggagtgggcggacgtgctcggcacgatcccctatgaggtgctcgcgcggctcgggccgcggattccgagggtggtggagcatgggactgcctgagctcgaggcgctcgaggccgaggttcgcgcgtgccacgcctgtcgcttgtccgcgggtcgtcatcaggcggtgcccggcgagggcgccgcgcccgcaccactgctcgtcgtcggcgagggtccgggggcgcgcgaggacgaactcgggcgccccttcgtcgggcgctcggggcagctgctcgatgccctgttggctgatgagaccggcctcgatcggagcggcctctacatcgccaacaccgtcaagtgtcgccccccgggcaatcgcacgccgaggccggacgaggtcgaggcgtgcaggggcttccttgcgcgccagatccacctggtcgatccggtcgtgatcgtcgcgctgggccagagcgcagcggcgtggttcctcggacccggcgcccgcgtcggcgcgctccgtggccaggtgctcgagtgggaaggacgagcgctcgtcgtcacctatcacccatcggcggcgctgcgcggcggtgcggccatcgtcgccgcactgcgcagcgatctcgcccgcgccagcgtggcactcgcggagcgacgtcgatgagcgtgccagggccagcccctcgtcgcgaggagatgctcgtcgacgccgaggcgaccgagcggttgggggagcgcctcggtgtcgagatgccgcccggtgcgatcctcggtctctcgggcccgctcggagccggcaagaccacccttgcccgtggtgcgctgcgagcgctcggcgtgcgagaggcggtggtctcgccgacgttcctcggcttgcggcgctacagcacggccgattcgggcatcgtgtaccacatcgacctctaccgcagcgaggatgcgacctggctctggggcgagggcgtcgacgacgacctcgacgacggcgcgcgtgcggtcgtcgagtggatcgatcgtgaccggcggctcgcggccgacgcatgggccatcgtcgagctggacgtcgtcgagctcgacgatggccagacgggccggcgcgcgcggattcggaggcaccggtgagcgccgacgaggtgacgctgctcgcgctcgatctcgcgacgaggccgagcatcatcgcagctcgggtcgctggagtgacgcaggcggtgcgtggtgtctccacgcacccgctcgccgacctcggcgcccgcgtgcgcgacgtgctcggccaggcgaccccggaggtggtgggcgtggtgaccgggcctggttcggtgctcgggctgcgcgcaggcgccgcgttcgtgcggacctacgcgagcgcgaccggtgccacactcgtcccgttgcacaccggtgaggccgtcgcggccagtgtgcccgacgagccggtgctctgggtggtcgcgcccgtgggtcgtgggcgcgtgagcctggtggcgaccgagcgtggtcaagtcgtatcggaagcgatcgtcggtgtcgaggagctgcggatcccgcgtggcgagccggtcgcggggccgggtcttgctcgcggactgatcggggaggggcgatcgaccggcgtcgtcgagccgaccggcaatggtctcctcgccgccctggtgcggcggtggcgagcgggcgagtcggcagatccccattcgctcgcggtgcgctactcggtggacgcgggggttcgcttgccgcgacgcttcgcagagggcgggggtcggccatgatgacggtgcggccgatgcggcccgaggacctcgacgcggtgctcgcgatcgaggagtccgtgtcgcgcgtgccctggagccgacggtccttcgtggacgagctcggtgccgagggacgcctctggcgcgtcgccgacgagggcggcgtcgtgcgtgggtacgtcggcgcgctcatcgtcgtcgacgaggcacacgtcctcaacgtcgcggtggcgcgagaggcgtggggtcggctcatcgcgacgcggttgctgctcgacgcgctcgatggcctcgatgcgctcggggtgcgtgactgcacgctcgaggtgcgcgtctcgaacgcgcgtgcccaggcgctctatcggcgtctcggtttcgctccggtggggctcagacgggcctactaccccgacaatgacgaagacgccatcgtgatgtggctgcgcgatctcgccgcaccggcatccaaggagcggttggccgcggtccgcctcgacctcgaggggggtgctcgatgacgagtgcacgcagcctggaccggctcgagctcgtcgacgcgggcgtcgtgctcgcgatcgagaccagctgtgacgacaccgcggtggcggtcgtggccggtggtcgggtcgcggccaacgtggtgcgctcccaggccgcgctgcacgctccgttcggcggggtggtgcccgaggtcgcggcccgggctcacgacgccgccatggtcgaggtcgtcgaggaggcgctcgccgagtccggcatcgacgcgcacgaggtggaggccatcgcggtgaccaagggtccggggttgccgggatccctggtcgtcggcgtgggcgccgcgctcggccttgcggtggggctcgatcgaccgctcatcggtgtcgatcacatggagggccatctctacgcagccaccatcgaagggcccgtcgccctgccggcgctgagtctgctcgtctcgggcggacactccgagctcgtcgtcatcgaggcgccgtttcgctatcgcctcctcggccgcactcgcgacgacgccgcgggcgaggccttcgacaaggtcgcgcgcatcctggggctcggctttccgggaggccctgccatcgaggccgcggcgcgcgatgggcgtcccgacgcgattcgctttgcccgggcgcttcgcaaccaggggttcgatctgtcgttctcggggatcaagacggaggtcgctcgctatctcgaaggggctcgggcggccgaggtcgccgacgtggcggcctcgttccaggaggccgtcgtggacgtgctcgtggccaagctcgagcgtgcgctcgagagcgagcgggtcgagaccgtcgtgatcggcggcggggtcgcggcgaacgggccgctgcgcgagcgggtagccgagctcgcgcgagcaaggggtgtcggcgcgcacatcccggccaggagcctctgtgccgacaacgcggccatgatcgccgctgcgggtgcggcacgcctcgtcgccggcgagcacgcggtcgatggtctcgacatcgagccgacacgaagcctcgtcggaggtgacgaccattagcactcggcatgctagagtgctaatggtcgctgacccacatgccagtccactcaccgatcaaggaggcatgagcatgaacctgcagccaatggaggaccggatcgtcgttcgtccggccgagtctgaggagcggaccgcgtccggcctcgtgatccccgacaccgccaaggagaagccgcagcagggcaccgtgctcgcggtcggccccggcaagcgggccgagcagagcggcgagctgatcccgctcgacatcgccgtgggtgacacggtggtctactccaagtacggcggcaccgagatcacggtcgacggtgaggatctcctcatcctctcgagccgtgacgtcctcgccaaggtggtgaagtagcgatgccgaagatcttggagttcgacgagtccgctcgtcgtgcgctcgaggcgggcgtcaacaagctcgccgacaccgtcaaggtgacgctcggcccgaagggccgcaacgtcgtgctcgccaagagcttcggcgcgcccacgatcaccaacgacggcgtctccatcgctcgcgagatcgagctcgaggaccccttcgagaacatgggtgcccagctcgtcaaggaggtcgccaccaagaccaacgacgtggctggtgacggcaccacgaccgcgaccgtcctcgcgcaggcgatgatccgcgaggggcttcgcaacgtcgcggctggtgcgaacccgatggccctcaagcgcggcatcgagcaggcggtcgcggccgccgtcgagtccatcgccgagcaggccaagccggtcgagggccgcagtgacttcgcccaggtcgctgccatctcggcagccgatcaggcggtcggcgaggtcctcgccgaggccatcgacaaggtcggcaaggacggcacggtcaccgtcgaggagtcgaacaccttcgggctcgagctcgagttcaccgagggcatgcagttcgacaagggctacctgtcgccgtacttcgtgaccaaccaggatcgccaagaggcggtgctcgagaacccgtacatcctcttctacgcgacgaagatctcctcgatccacgagctgctgcccgtgctcgagaaggtcatgcaggccggtcggtcgttgctcatcgtcgcagaggacgtcgagggtgaggcgctcgcgacgttggtcgtgaacaagatccgcggcaccttcacctcggtggcggtcaaggcccccggcttcggcgagcgccgcaaggcgatgctgcaggacatggcgatcctcacgggtggccaggtcatctcggaagaggtcggcctcaagctcgagaacgtcacgctggatctgctgggccaggctcggcgcatcgaggtgacgaaggacgagacgaagatcatcggcggcgccggtcagaaggcggacgtcgatggtcggatcgcccagatccgtcgtgagatcgaggagaccgactccgactgggaccgtgagaagctccaggagcgcctcgccaagctcgccggtggtgtcgcggtcgtcaaggtcggcgccgcgaccgaggtcgagctcaaggagaagaagcaccgcatcgaggatgcgctctccgcgactcgtgcagccatcgaggaggggatcgttgccggcggtggcacggcgctcattcgcgctcgggcgcgcgtgaacgacgtggtcgccaagctcgagggtgacgaggcgacgggcgcgaccatcgtggctcgttcgctcgaggagccgctcaagtggatcgcctacaacgcgggcatggaaggcccggtggtggtccagacggtcgagcacgagtcgggcaacgttggcctgaacgctcgtaccggtgtgtacgaggacctcgtgaaggccggcgtgatcgacccggcgaaggtgacgcgctctgcgctgcagaacgcagcgtccatcgcggccctgctgctcacgaccgaggcactcgtggccgacaagcccgaggagccgggtcaggcggcggccggcgctggcgcagccggcggcatgggcggcatgatgtaaggcgagccacgctcgtcgcacgaggggagggtccgcaaggatcctcccctcgctgcgttcgtggcagcgtgcgatggtctcgagggcggagaccaagccgttggggcgcgcacgggcgccgccacgatgggaaccagtcgatctcggtcagccgatcgtggccgaacgatcccgggagtaccagcacgacgacgctcccgaggtggttgtgccctctggagcatgtgccgaccatgaccccaggtcgccgggcgaggtgacgaagacggcagctgcaaggtgccggtcgggcatgccggtcaggagcgcttgccggtgagggcttcttggagctcggcctctgccttcgagtccaggctcgagcgcaagacggtgccgccgtagcggctgagtgcggcgatcaccttgtcgctcggtacgtgctcgaccatcaggaagagcgcggaggtgcccggttggacgaggtcgcgtacccgttcggcgaactctcgattgacgagtgagcggtcgatcagaccggtgagcccgccgagagccgcgccgaacgcgacgccgagcaccgggacgaagaacaggaagccgaacaggagcccccacagcatgccccaggtggtcgcggcgccgacgacgtggtgattcgtctggacgcggaaccgaccgtcgctctcgcgcacgatcaccgccacggcgtccggttggatgaggagctcatcggtgagctcctcgatcgtctgagcggcttgggtggccgtgtcctcgtcggggtagccaatgaccaacagatcggacatcgcgtcctcctcgtgagggtcgttcctgtgaggaccttagccctttggaagccttctggaccattcccgccgagggcaggggtgtgcccgcggtgcggtgcgatgacccgtgcaagctcgcacgggtgcttgcgcgagcgcctctgcctcgagggcagtgacagcagaagatcatcaaagcgtgatgcggtcgggaggctcgccgtctccaagggttgaccgaggggactcaatcctcgcccgactcgagccgatatggctaccacgatccagatcgcacggattgtaacgttgcaaacacactgcgcgagcaaatggtcgctggttactgcggtatggtcaggtggcgttcgggtaggtcgcagcttccgggcattcgtggctgggcccgtcgatcgggctggtggcgggtgcggagatgctgctcagggggtagctgtgaggttgcgcgggcggttcgaggatgcagacgcatggagctggtctccgttggctgtcgtcgagagccgacgagaaggagtgaggtctgtgaggagcgtcgacatgtcgtccgccggcggtggcgacgacgaggcgagaaggagtgaggtctgtgaggagcgttgacatgggcaggagcgtgcagctgggatcggctcgggcgggcgcggtgcgagtcggactcatcgtccttgtgtcgggtgcgatggcggccctcggcggcggcgttgcgctggcgagcggcagctcgacgccgtctgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcagtcgtccccgagtgcaccgacgccagcggcgggtttccaaacgactgtgctgtcgcaggtcgtcgcgccgtcgtcgtccacgcagacggtgacggcgacggctgatggcgccaatgtgtcagtggtcgttcccgcaggtgccttcggcaacacgacggtcaatctcgtcgtgaccgagcccacactgtcggatctcacctcgacgctgtctgcgctcggcctcggcggatccaccttggcgaccggtgtcggggtcgaggtggtcgacgctgcgactggccagccgctgaccggtacctttgcgcagccgctgaccgtgacgattacctcgagcggcatcacgagtgcttccaaggtcatcgagttcccgacgagtggttcgcccttcgtcgatagttctgctgaagtggtctcgggcaaggcggtggtccaggtgtcgagtgaccctggcttcgcagtcgcgacgcccacctctgcttcggtgccggcggccacgtctccggtgaccggtaaggacttcttgccggtcggcatcgctggtggcgtcctcgtcgtcggcggtgcggccctgatcgtcgcttcggagcgacgtcggcacgcatgagtggtgtgagaacccctcgggggttcctgcgccccgcggcaggtctggttgtcctcgcgggcgtcctcgcggcctgtgggtccaccgcgtcgtcgtcctctgccccagcgagtggttcgtcgacggcacatcgcgggtcgatcccggtcgcgatcgtgccggtgagcgcgggagcgctctcgctggggccactgcaggcgaatggcgagttctccgtcctggcagggacgccgtcatcgaagggcgtcttcacctaccagctcagcactcggcgcgaggtggccagtttctcggtgtcgaatcaggcaaccgcgatcacccagttgccaaacggcgtcatcgcggtcgggcttggtacggggtctgtgggcgccgtcgatctcgagagcagcagtggccaacaactcgcctcgatccccgtcgctgctccggtgcggggcctcgccctcggaacggacgggtccacgatctacgtgttggagggcaccggatcgacacgggcggttgccgtcctcgacaccgcgacgaggagcgcagcgacgaccctgcccgtcaatgctgacaccgtggcgatcgcatcgtcgccgacccagcaggagctctacggtttggagagtactggtgcactggacgtgtactcgacggcgacaggccaacggatcggtaccttccccgtaggtcactcgggcgtcgccgtcacgccgtctcccgacgggactgccctgttcgtgttgaagggcgtcggcggggtgcgcaacgtcgcggtggtgaatctctcgacggagggggacgtgcgagccatcggcgcgccggctggcggcatcgcgatcgcccccaccctgaccggtgccgatgtcctggtgctcgcggtggggccggcgtccgcgaacgttcaggagttgcccacgtcgtgaggacctctccgctccaggcgacggccgacgatccgacgtcgccacgacacggtgtccgagtggaggctgcgacgggcacctcgacgatggcctggttgttggcgggagcggtgctgatcctgtggggccttcgtttcggggttggggtcgccgagtcggctgggttctcgctcgccgatgtggtcatgatcggggcgggggtcgccatcattgccggctcgccagccatcgcgacgcgccctcgcctgcactgggctgtgctcgcgctcgtggttgcggcgtttctggcatgggcgacacagcaagtcctgatcgcgcccgcctacgcgacggacgagctcgcgttcgaccagtacgccgcccacctcgtactccagggggtcgatccctaccgagtctcgatggcggcggcatttgcgcgctaccaggtctcgccgaatgcgtttaccctgcgcttcagcggacagccggtgacggccctctcgtaccccgcacttgcattcctcgcttacgtgccgctcctggtcgccggcatccacgcccaagccggcacgatcgtcgacgcccttgcgtgggcggtgacgatcgtcgtcacgttcgctgcggtgcctcggagctggcgaccgttggtgctcgcattgctcagcctttctgcgggcgtcgcgtatgccgtcggcggagtcacggacgctctcttcctgccgttccttgtcgcgagtgcagcgttgctgggacgcttcgtccgcggcgattcgtggggctggctcgcacccgtcgcgctcggtctggcgatggcggtcaagcagacgccgtggctcgtggcgccggcactcgcggtggtggtcgtgcggtgggcgcgcagcagtcggtcgacgtcgtgggcgctgggtcgcctcgcgtggttcgtcggcttggcgactctcgcctttctcgtgccgaacgtgccgttcatcctccaggatcctggtgcctggctccgtggggtgctcaccccgctcgatgcgtcggtcgtacctgcgggccaagggctcgtcgcgctctcgacagcctttggtatcggggccgggggcttcgtctggctctcgcttgcatccgtggtgcttctcgcgggcggcacggcactcgtgtggctgggatggccgcgttgtgcgtggtgtgcctggctcgtgccggtggtcgcgctcttcttcgcgacgcggtcgttcggctcctactacgtcaacctcgtgccgcccgcgctcgtggcgcttgcacgttggccgcgcggagccgcgcccctgccacgtgtgtggtatcgctgggcactcgtgacgggtggggtcacggtcgtgtgcgctttggcctgggtgcgaagcgcatcgccgctctccatcgagatcaccggtgtccacacctctggccagctcgcgaccgtcgcgcgcgtcacgctgcgcgtcacgaaccgctcggatgcgacgctcgcgcccgcctacgtctcctaccttgcgggctcgtactcgctcccatggcagctcgaggcaggccctcgggtggtggcgccgcacgcgagtgtcgacgtgacggtgggtgcgccgaacttcccggcccaaccctcggtggccggtgggttccagatggtggcactcgcgggccatgccatcgccccgagcgcactgtacgagcccgggctccttcacgtggcgctggtaccggacgcggtgaacatccccgtcgcgctgggtcagcaggtggtgctccacgcggagctgctcgatcgcttcgatcagccagtgcgcgaggcgggtgtgccgatcttcctcggtcagatcatctatgcgcagcgtggcctgctctactcgagcgcttcgatcaacggtgccgctccgggcgcaactccggtcgaagagctcactggtccgaatggggtcgcgacgttcgtcatcgtcgaccgagctgcagagcccgatccggtgagctttgaggcaaacctggtctcgacgagcgggtactacccctatggctactcgcagatcgtcccgatccggttcgagaggagctgagatggcgaccggggtcggggcgccagatgacgctcgtgtgcaggggcgcgggcgatccatcgcgcgggtgatgggatgcgcgactcggctgctcggctggtggcgtgacgggggtccggcgctttgggtggcctggggattcggactcgcccaattggtcgtggtgatcgtcctcgcggatcgcctcgtccgcgccggggcgctctcgatcgactacgcgatcgaaggcggcgggttctctcagatcgccgctggccacctcgacccgaccgtgtggcttttccagtacgtcaagcccttcatcgacaaccacgaggtcttcctcgactggcccctcgcgctcgtgatcgggctcgtgcacctgccggtggtttggacgctgctcattggactccaggcactcccgatcgctgcaatcggcccgctcgtcgcgtcgtatgccaacctgcgtggacgtgagctcggattctcggctcggacgcgcgcgctcgtcacgctggtgccagctgcactcgcggcactcgatgtctggcagtactggtcgacgacgttcgactaccacggcaaggcgctccaaggtctcgttctcgttgcggcgctgatcgtgctggagcgccgacggcgggcgtggtccattgtgctcgtcgcgacgctcgcactcatgggcgatactgcgtcgtacgtgctcgccgtcgtcgcagtggtgcttctcctcgagcgtcggtggcgcggcggcttggccgtgctggcgacggcggttgccgtgctcaccgtgccctctctgctcgggttccacattttgtcgctaaccgggggtctctatagcccgctgacacccctccaggcgccgacctatgacgtcgtcgttggcgtcctcaagcatccgggcttcgcgctcggccgcctcgggcgccgcctcccagacatgtgggccctcctcggtggggcggggatcctcggcgtggcctccgccatggggatcgcggcaatggccgtcatcgggccggtcgtctggctcggcattgcgcccctcgggtacgcgggcgtcttccaactcgtgccgctcaccgacgtcctgctcctcggcgcagcggtgacgctccttcgtgtcgctcgtcgtcggccgcgccgtgccctcgccatcggcgggttcgccgtggcgtgggcgtttggctggttcgtggtgttcgtcccccatctcgtggcatccatccgcgcgatcgcgcctgccgacgtacgcaccgggagcacgctcgaggcgctcgcgacctcgatcccgccgggccatgaagtggttgctccgatctcgatggtggggctcgttgcccaggaccatccgctcgtgtggagctatcggtgtcggacggggccgatctcgatcccgaccttcggagtcccgctcgacatcgtcgtggctccgggggttggcgtcgacacctgcagccccggaacgctgatggctgagctggctcgggtcgcggcgttgcccagtgcgtccctccgcgtgctgcctggtgatgtctacgtcgtggagtatgatccaggcccgggtcgagggagcctcgtcctgtccgatgcggcgccgatgacaggccgagagctcgctcccacctttaccaagggctcgacccagctgctcccgggcggagcggtcgcgctctcgcctggtccgctcgcgctccacggtgtgaccgcagagctcgccccgggtgctgctggagaggctctcgtgcgcctcgaggccgagggatccgtgagcgtgcaggtgtgggatgacgcgtcgggtcagttgctcgcccgtgaggagctgggcaccacgaccggggccgagacgctcgcgatccccttcgtcgtgccccaccggttcatccccccggctgcgttcagcgacggcgtgtggccgttcgtcacacgcttcctccccccgacgcgctcggacgccgtcgagctccgtgtgagcgtcgggccgggttcgcaggtggcggtcgccgatgcctggatcggccccgcctctcaggcatcgaccgtgttgtccttcccaggtctcgttggtcagccggcactgccgtagggtggacacatgagggggaagggccggggagcgcacagccgacagcgaggtcggggaatcgcgatcgtaggggtcgtggcgatgctcgctggtctcggcctcatcggctcgatcgtcgccttctacgtgcgctcctcccttgtgggtggcggactcatccagcaagcgcagaaggcccggacggtcgcggcgtggccgcgatcgctgctcgcgatcgtgcgtatcccctcgatcgggctcgtcgcgccggtggagcagggcaccggccagtcggtgctcgctgtggcggtgggtcatctcacgacgagcgcgctccctgggaaaccaggcacgtcggtgctcgcggcgcacaacgtcagctggttctcgggcctcggtggtctcggctcgggatctctcattgaggtcgatacaccgtacgggcagcaggtctatcgtgtggcctggcatcgcgtcgtgcacgtcggtgcgcccgtggccaacaccgccgcaccgactctggtgctcgaagcgtgctggccgctcaatgcgctctacttgacgcccgagcgctacctcgttggtgccaccttggtggcgacgacgaagatcgcggtcacgccggtcacgccgtcgtcggacagctaccagccgctcgggcttgcgccgacgctcgcgcacgagaacctctcgctcgcggccaacgacctaccgatgggggtgctcgccaccgttggctcgcctgctgcagcatggacgagttcacagcgaccctacaacttcgctggagcggaagtgacgtggaccattgcgttgttgcatgcgctcgaagctcacgacctcgtgctcgtcgaatcggtgacccacgagccagcaagcgtggtcgcaccattgctcagctgggacggaggcttcgcgagcctcgacgacctcaccgaggtcgtcgatggtgtcacggcgtcggctggctcctcgcgagtgtcgctccagaccgatcacgggccgctcgtcgttaccttgcgttttcgggtcatcgggcatggggtcgaggtagctggcgctgcggtcgggacgtcgcagggctcgtagcccgccgcagtgaccgcggcgggttcgtgcccccgggctggtggctcggttggcgagatcctcgggcgcgcgaacggcggtgtcgtcgcgctctgatggtggcgctcgttgttccagattgctcgacgggcaccgagcgcccggcgacgacctcgatggtcggtgggtcgtcgatcgcttcggacccggtcgaggcagctcgtggccggacggatcgccgtgatcagctcgggcgttcgtcgtcgaggttccgtgcgcacaccggccgacgaaggtcgggtcggctcacgtagcctgggggtcatgggtgaggtggcgtcgggcgggctgtgggatctgcaccggtttcgccagcgcatcgatgagccggagcgccgacttcgccttgtgtggccgtctcgtgcggtggacttcggaagcctcgacgaggcgagcgtacgacgagcccttgcgccggccccggcgagccgcggcggcgtcagtgcagcggtcttgattccgatcgccttcgacggcccctccggcccggaggttctcgtgacgcggcgtgcgcgttcgttgcgtcaccacgctggtgagatcgcgttcccgggaggacgggcacgcgcgggagagacgctcgtcgagactgcacgcagagaggccgaggaggaggtgggcctcgaggcgagtgctgctcgcgtgctggggtcggtcggggttggctacacccgctcgagtgcttacgcgttcgaggctctggtcgcggcggtgccgcgtgagacgatgctcacgctccaacccgatgaagtggagatggcggcgtgggtcccactggcgacactgttcgggccggagcgagctgcgagcgaactgtggtacgacgaccgagcgggttggctccgagtctggctcttcgacctcggtgatgacctcctgtggggagcgagcgctcgcgtcgtcgcggcgctggctcagtgtctcggcgcgacgtagagcgcctggagcaccgcgccgatcacaccgtcgtcatcgagcaacgtcgcgcgcgtgaggccaacaccatcggcgtcgatgaagctccgtgccgaaacggcgacgcgcgtcgtcgcgggctcgcgaacgaagtcgatgtggaggctcggcgggatgaagagccactcgtcgaaggcgaggtgggtcgagatcccgttcgcaacgtcagcaatgagcgcggcggcctcgagcggtgtcatcggctcgcctgcgacgaggtggatgcgcggcgtggcccagacggtcgcgggacctggttgggcgaaggagccgtcgacgaagcgccagtcgatcgcggcaccgtacgggaaactgtccatgatcggatcgcgatggccggcctcgggagccggcagcttgggtgttggtacgtgcgttggcgctcggccccgctcggtggcgaagaaccagcctcgtgcttcgaacgccacgcggtcgccgacgcgcgcacgcatgcgtgcgaggcggacgcgtcgtccgtcgcgagtgagttcgcgttcgatgcgcagtggggcgatcggtacggggccgatcagatccacgtcgagtgaggagagccgccagctggcctctggaacgatgcgccgcagttcgtggaccgcgagggcagccgggggtccgccgtgggtggcgttcgggtcccacggtccgacggcgtggttggtcggttcgatgaggtcgtcgtcgatcctgcgaaagaagctctcgtcgctcacgagcctcgagcctacgtcgcatcccacgccgctcttgcgggggctagtgagggtgctcagccacccagaggccgatccaggcgagtagggagcccgcgaccaccgtgccgagcatgttggcgagtgaacgcgtgagctggcggcgtctggccagggccagcgactcgaccgcgagcgtcgagaaggtcgtgtaggcgccgatgaatcccccgtcgatcaccgtcgcgaggttggctgggaggaggccgccgagcgcgagaccggtgacgagaccgagtgcgagtgagcccgacaggttgatcgtgagcgttccccatgggaaggtcgcttggggcagcacccgacccatcagtactcggtcgacggcccagcggacgatcgcgcccgcggcgccggcgatggcgacgagaacccaggtcacgagcgatgggcgatcccaaggcgccgcaacgtgctcgggaactcgatcgcgagcgcccgcacgccgtcgccgtcgagccgctcaagcagtgcctcgatgcgatcggcctggtcggcgatgacgatcgcgatgccttcgtcgtcgtcgagggacagcagcgtggagcgtcggagccgcaggtgctcgccgaagctctcgacggcccgaaaggcggttgcacccgcgaggccgagatcgagggctcggcgcatgacgtggtcgacgacggcctcgtggccgatccgatcgccctcgttcacgaacacgatgacacagcgcgcctcgtcggacgtcatagacaacctccctctatcccaggggctcgacggcgctgtgagcgggcgtcgagcagcgcggtcgtcgctgcgcggcctgcgacgaccgcgaggaggccagctgcgatcgtgagtgcaccatagagcacggcggacccccacgcaccgcgatcggcggtctgggcgatggcgagcgcgagcgacgacagcgtggtcaaaccgccgcacaggcccgtcgccacgagcagccgaagacgccgtccagaggtcggcgcgaggcgctccgcgagcgcgaggaccccgccgatcacgaaggcgccgaggacgtttgcggcgaggatcccgagtggaaacgacggggtggtgtcgaggacctgctcgagccagacccgcgtgagcgcacccacggcgcctccgatccccacgagcgccgcgcgccgcgctcgtcgcgcatggtcgccggtcatgggatcgatgcctcgaggctcgcgatgcgcgcgtcgaggcgggtcagctcctgggcgcgctgggcaggcggttcggggccgtcgagcaccagggcgcgcgcgagcgccgtcgctgcgagctcgagcctgggcgccgacggggccggcgcgatgaaggcggtggcggccgagctcaaggggtaggcggactcggtcggcgtgcgcgccgtctgggtcgcatccagaatgctcgcggcctccggcgaggtcgagttctcgaggaacgcgaggcatccgaccgtaccggcgcaggtggtcgagacccgcgctcggatctggctcgcggtgacgcccagcgtttgctggagccagatcgcgaccgtgctccctgcctcgatcggggcgatggtcaccggtaccggcgggagcgagagggacgggttgaggtgcgcgatcgtggcgtcgtcccagacgctgatgcgtccggtcacgaggtcggcgagcgcggcctcgctcagcacgagtccggtcgtcgccccgaggttgaccgaaacggtgagctcttcgggagcgtacggccagggcgcgagcccactctgggccacgatgctcgccgccggggcgaggctcgcgacgaccatctcgtcgtgcgtggtgacgagggagctagcgatctgggcgagcggcaccgtctggatgctcaccgacagggccgggtcgtcgcggcgcacggcgcgcacggcactctcgagggccgggagcgcacccggatcggcgagcaccgtgaggtgggtcgcgccgaggacgctcgcgagccgctgcgtcgccgtcgtcgaactcgacgacgggctcgtggtgccgcacgcggcgagcacgaccgctccgacgcaaggcgccaggcgcgccgccaccgttggtcgcatcaccctgtcgacgcctcccaccgcgtagactgcgagtcgcagtctacgagcgcccctgggggaaagcgtgagagacgcaatcgcacgacgtcccagcgaggagggtggttaccgtggcggagatcgagatcggactcgggaagtcgggccgacgggcctatgggttcgacgacatcgcgatcgtgccttcgaggcgaacccgcgaccctgaggacgtcgacatctcctgggagatcgacgcgttccgcttcgagctccccatgatggcctcggcgatggatggcgtcgtctcgcccgccaccgcgatcgagatcggccgcctcggcggtctcgcggtgctcaacctcgaggggctctggacgcgctacgaggatccggatgcggtctatgccgagatcgctcagctcccctccgacaaggcgaccgcgcggatgcaggagatctacgccgagccgatcaagccgtcgctcatcaccgagcgcatccgcgagatcaaggctgcgggggtcgtcgcggcggcgtcggtgacgccgcaacgcaccgaggagttcatcggtgcgatcttgaagggcgaactcgacatcctcgtcatccaggggacggtggtctcggccgagcacgtgtcgaagacccaggagccgctgaacctcaagcgtttcatccgagagctcgagatcccggtcatcgtgggaggcaccgcgtcctaccaggcgaccttgcacctcatgcggacgggtgcggtcggggtgttggtcggggtgggtcccgggcatgcgtgcaccacgcgtgcggtccttgggctcggggtgccgcaggcgacggcgatcgccgatgccgcggcggcgaggatgcgccacctggacgagacgggcgtctacgtgcacgtgatcgcggacggtgggatgtccaagggcggtgacatcgccaaggccatcgcggtcggcgcggatgcggtgatgatcggctctccgctcgcagcggcctacgaggcaccgggtcgcgggttccactggggcatggcgaccttccacccgacgctccctcgaggcacccgggtgcgtaccgagcagcgcggttcgctccaggagatcctggtcggaccggcccgggagaacgatggtcgcctgaatctcttcggggccctgcgtacctccatggccacctgcggctacgagtccatcaaggagttccagaaggccgaggtgatggtcgcgccagcgctccagaccgagggtaagtccctccagcgcgagcagcacgtcggccaggggcgctagtgcgccacgccgacgagcaggtcgtccttgtcgtcgacttcggcgcgcagtacgcgcagctgatcgcacggcgggtgcgcgaactccacgtgtactcggaggtcgtcccggctcgggacgcactggcgttcgtccgctcgcggcggccggcggcggtgatcctctcgggtggtccggcgtccgtatacgcccccggtgcgccggggctcgcgcccgaggtgctcgaggcgaacgtgcccatcctcgggatctgctacggcgctcagctgatggcccagcagcttggcggcgtcgtcgagcacggaggttcgggtgagtacggcagaacggtgatcgagcgcaccgacgagcgtgcgcacctgctcccgccgctccgtggcgaggcgcctgagacggtgtggatgagtcacgccgacgcgatcgttgccccgcccgagggcgcgcgggtggtcgcgagctcggccggggcaccggtcgcggccttcgaggatcccgcgaggcggcgcttcggtgtgcagtggcatcccgaggtctcgcacaccccaggtggcatggagctcctcggacggttcctgttcgacgtggtggggctcgagccgcgctggacgagtttttcgatcatcgagcaggcgatcgcagaggtccggagcacggtcggcgatggtcgggcgatctgtgcgctctcgggtggggtggattcgaccgtggccgcggcgctcaccgccgaggcgatcggcgaccggctcacctgcgtcttcgtcgacacgggcctcctgcgctcgggcgaggcggagcaggtcgaacatctgttccgttcccagttcgacatcgagctgatcgtggtggacgcggccgatcgcttcttcgacgccttggcgggcgtgaccgaccccgaggccaagcgcaagatcatcggcgaactcttcatccgcatcttcgaagaaacggcggcctcgaagaccaacgcgacccacctcgtccagggcacgctctatccggacatcgtcgagtccggtagcgatggctcggcgaccatcaagtcgcaccacaacgtcggcggcctcccggacgacgtcgcgttcacgatcgtcgagccactgcgacgcctgttcaaggacgaggtccgtcgcatcggcgtcgagctcggtatccccgagtcgttcgtgtggcgccaaccattccccggtccggggatcgcggttcgagtgctcggcgaggtgaccgcagagcgggtcgagacggttcgccgtgcggatcgcatcgtccaagacgagctcgacgaggctgggctctcgcgctcgctatggcaggccttcgcggtcctggcccctgggctccggtcggtcggcgtctcgggggacgcgcgtacctacgacgccccggtcatcgtgagggcggtcgagtccgaggacgccatgaccgcagattgggcacggctgccatgggaggtgctcgatcgcatctcgcggcggatcgtcaacgaggtcccgggcgtcaatcgcgtcgtctatgacgtgacctccaagccgccaggcaccatcgagtgggagtgacgaggtgctcgaggagctcctcgaggatctgaacccctcgcagcgagaggcggtcagcgctccgatcggaccggtgctcgtgctcgcaggggccggctcgggcaagacgagggtgctgacgcgccgcgtcgcctggctgctcgccgctggcgagcggccgtcgtcgatcctcgcgatcaccttcaccaacaaggcagccggggagatggccgagcgcgtccgcagtcttgttggacccaacgcggatggcttgtgggtctcgacgttccacgccgcgtgcgcgcggatgctccggctgcaccccgaactcgggggtttgcgctctggctggagcatctatgaccaagacgatgcgaggcggttgctcgagcggaccattcgacgcttggacctcgacaccaagcggttcccaccgcgggcgatcgcccagcaggtgtcgctcgccaaggctcggctcgtcgacccggagcgtttcaccgacgaggcggaggggctctacgagcgccaggtcgccatggtctatcggtcctaccaggccgcgcttgccgaggcgaacgcggccgacttcgacgatctgatcggactcgtcgtcgagggtctcgcgacgcgaccggagctcgccgagcattggcgacgtcggttccgccacgtcctcatcgacgagtaccaggatgcgaacccggcccagcacgccttcgtcgccgagctcgtcggtcgtagcgggagcgtgttcgccgtcggcgacgtcgatcagtcgatctacgccttccgcggtgcggatccctctggtgtcctcacgttcgaggagcgcttcgacggcgcgaaggtcgtcacgctcgagcagaactatcgctcgaccaacgccatcttggggctcgccaacgcggtgatcgccaagaaccgtcgtcgctacgccaagcacctgttctccgagctcggcgagggcacgccggcgcgacgctatcaggccaccgacgagcgggacgaggcccgttgggtggccgcgaccgtacgagagttcctccaacgtggcggcgtcgatcccagcgagattgcggtcatctttcgcaccaatgcgcagagtcgtccgctcgaagaagccttctcggaggcgggcatcccgttccgcgtggtcggaggcgtccgtttctacgagcgccgcgaggtgcgtgatctgctcgcctacctgagagtcctcgccaacccggacgacgacgtcgcgctggcgcggattctgaacgtgccacggcgcgggatcggccggggcaccgaggaggcgctccaggcggctgcggcactgcgcggtcggagcatgctgtcgctgctgcgtgcagagggcgtcgaggtgctcggtctgacgagccgccaggagcgggccctgcgagggttcgtcgagctcatcgatcgcctgggagcgcttgcgtcgctccatcgaccgagcgagctgatcgacgcggtcgtcgccgagacgagctacctcgagcacctcaacgaggaggatccgatcaccctcgagggtcgcctcgagaacatcgccgaactgcgtgcctcggcggcggaggctgacgatctcgagagcttcctggagcgcgccgcgctcgtgtcggcggtcgacgaggtgatgggtgcctcgggcgtcaccctcttgacggcgcacgccgccaagggtctggagttcgacgtcgtggtggtcgtgggactcgaggagggggtctttccccacgtgcgtgccatcgtcgatgccgaggcggtcgaggaggagcgtcgactgttctacgtcgccatgacccgagcacgcacgacgctcgttctcacgagcgcgaggcgccgggcgagctggggcgagccgctctacaacccacccagtcgctttctcgacgagctgccggctgatctcgtggcgacgaccgcggcgcccgtcgctgtcgggacggcgtgtgcggagtcgatccaacgtgcgagtgcggtcgtcgaagcccgtgcagcccggagcgagtgggtggtaggcgatcgagtcttccacgctcgctacggcgagggaaccatcagacgggtcgtgccgcggggcgtcgacgacgagctcgtgatcgcgttccacggcgctggcgagcgtcgcttcttcgcctcgatggtcaagctacgacgcgcgtgagctgagcccggctggggccgcgagagcccctgccgcgtccctggcggcgcatgtgcgccctcgtcggtcgtgtcggggcgcgcgtgtctcggctggctggccggatgggatgacgctgtcgagaagccggacgaccacagagcgtgggaatgcggagagtggtcacgcaacttcctgtggggagaaagtggcaacacagtgcgaacatgtcgatcaggtgtagtgaacagtgcgttacggggacaaatacctggagaactcgtgctggttggcccctcatggtgcggctacagttaccacagcgagagctgaaggtgtcgaattcgagtaaatgtgttggcacggatcgtcgtgcgtcgacactgatccgctcgacaaggaaggagaaccaccaccatgcgcatcatcgtctacggcgcggacggctacatcgggtggccgatggcgctgcacctcgcggcccaaggtcacgacgtgctcgccatcgacaacggtgcccgtcgccgttgggacgcagaaggcggtacccgtcccctgaacgagatcgcctcgttcaccgagcgcgtcgagacctggaacgccctcggcaagggtgcccccatccgcatcgccgaaggcgacatctgcgactacgacttcgtcctcgagaccatgcgcgcccacgacccagaggccctcgtgcacttcggcgagcagcgcagcgccccctactcgatgatctcgcgcgaccacgcggtgcgcactcaggtcaacaacatcgtgggcaacctcaacatcctctttgccatgcgcgaggtcaaccccgagatccacctcgtcaagctcggctccatgggcgagtacggaaccccgaacatcgacatcgaagagggttacctcaccatcacccacaacggccgtagcgacaccttgccctacccgaagctgccccacagcttctaccacctctccaaggtggccgactcctacaacatccacttcacgacgagggtgtggaacttccgcgccaccgacttgaaccagggcgtcgtctacggcgtcgccaccgacgagacggtgctcgatccgcgccttgcgacccgcttcgactacgactcggtctggggcaccgccctcaaccgcttcgtgatccaagggtccctcggctaccccatcaccgtctacggccgtggcggccagacccgtggctacctcgacatccgcgacaccatggcctgcatcaccctggcgctcgagaacccggccgcccccggtgagttccgtgtcttcaaccagttcaccgagcagttcaccctgaacgagctcgccgagaccgtggcaggtgtcctgggacgccgaggcctcacccccaccatcgcccacctcgacaacccacgcgtcgagaaggaagagcactactacaacgcccgtcactcggccctgctcgacctcggtctgcaaccccactacctcgccgacaccctcatcgactcgttggtggacttcgtccaggcgaacgccgccaacgtcgaccccgagctcctcgagaccccgacggtgacctggcgcgagggtgcgaacgaggtctggtatcgccacgcggacctcaccgtggcggccgagaaccgagcacgcgaggccacggacaccattcgggaggcgctggcgtaggtgccggcgcgagcagaggcgtgagggagggttgcgatggtcaagagccaggagtcgtcggaccgaccgtggtcaggcgatgacgaggagcagcgtggggctgaaaccatctggccgctcgtcgatcccgaatcgctcgagggcatcgatgtgacctcgtcggaggcggtcatcgacctgcgtgaggcgccgagtgcccctccggtgagcacgccggcggcgagtcctccagcgatggagctcccggtggtcgcagccccggtgcggccgtcgcgccgcggttggctcgttgccatcatcgtggcggtcgtcatcgtcgtggtcggctacgtggtcgtgagcggcctggctggctcaccactctcgtcgctgtcgtcggaggtggtcgacccgggtgaagtgagtctctcgttcccggctgcgggaacgatttcgcagctggccgttcacccaggcgagcgggtcgcgagcggccaggtactcgcgaccgaggtggtcccgggcctcagcgagacccgtcatgccgatcaggccgcgatcgcagcggacacgagcgaagtcagtgcgctgcaagcgctcatcgcgcagatgtcgagcgtgacctcggcgaacgctggggtcgtcgcccaggcggcccaggctgaggtcgcggcggcgcgccaagcactcacgagcgacgagagccagctggcatcggtccaagctcaaggggcggccacggtcgccgccgcacagtccctgctgggcgccgatcaggctgccgctgtggcggcatgctccggcgtcggcccgacggcttcgccgccaaccgcggcacaggtggcgtgtgctgatgcccagcatcgtgtcgctgccgatgagctcgccctcgcccaggccaaggcgagctcacagagcgccgtcgacggtgtccagagcctgattgctgcggatcaacgtgcgttgagcgacgcggaagcacaggcgagcgagagtgatggcgtgtcgtcgacgcagctcgcagcgctcaaggtctcgctggtagcagcccaggctcagcttgcgcgggatcaaggcgaactcaatgctgccgcccagaccgctgcgacacagaccctgcgagcgccgatcgctgggacggtcgtgagcgtcgacggcgcggtgggtgagacggtgagcgcgagtggggtcggcgatgcggtaccgagcggctcgagcgtggccgtgacccctgggttcacactgttcccgtcgacccagacggagtcgagccagccggtggcctcgaccccggtcgtggtcatcaagggtcacgcccccacgtacctcgagacgctcgtccccgagagcgtcatcggcaaggtgcacctcggtgatcaggtgacgttcacaccgagcagccaaggcatcggtgtcgtccacggggtcgtcgaacagatctttccccgcccggtcgttgcggccggcgtcgtgagctatgaggtccagtcggaactgagcggccgtcttccagccggtttgctgaccgggctcacggggaatgccagcatctcaagctctggtcgacgatgaccccacacggcgtcgtcgtcgtcctcggagccgtggccctgttggcggcgggcagttgggccgtgctccacggcgggcgtggtgaccatggcgacgggttgcgtcacgtgcgcctgccgtcaccgcagcgctcgatcccacgtctcgtagtgttcatcgtcgccatcgtggcgtggtcgatcctcgtagctcgcgactgggccgaggccgcaggcgcgttgaaggccgttcttgcgctgatcctcgagcgagccggactcggtgcctcgacggccagctcgtatctcgtccacaccaacccgctcttgctgctgctcgaggacgggagcctcagttctttcgtgatcgcacgtcgtcacagcgtgcgctcgctcgtcgtcagcgttggcgtcctcgctgtcgtcctcatcgggggaccgctcgtcgtcggggccgccgaggtgatggcatcgtggttcggggccccgtcggtggtggtcttctacctcgcagagctcgcgagtttggcggccggcttcgtcggcctgttggcattgatcttcctctcgagtgccttgccgcggcgctacgcggcaagggttgggctgcgcccgctcgccagcgcgctgctgctcatcggcgtcttcgtcctcattctcatcggcgccggcgcgctcgcccgcggcatcggtgggagcttgagcgctgtgtcgccgccggacggactgctcgtgttcttggccctgcccgcgctgatcatggccgtctcggtcgtgctgctgctcgtgcgcccgaaggatcgacctggggtcggggatcccacggagccgatcgacgtgatcatgccggccttcaacgaagaagctggcatcggtgccgcactcgccgcgctcgatgcggcggcggctgcctatcccggccgagtccgagtcctcgtcgcggacgacggttctcacgaccgcaccctcgaggtcatcgagatggcggcccagactgctcgggcggccgagatcgtcgctgtgggcgggccgcacggtggcaaggcggtcgcgctcaaccgggcgctcgaagccgcctccacgcgcatcgtcgtgcgtgtcgacgccgatatcctcgtggatgcgaactgcttgcggccgctcccagactggttcgccaacccggcgatcggctgcatcggtgccttcgaccttccgaacatggcgctccctgcgtggtacacgcgtggccgactcttcgagtgtctcatgaccttcgggttctctcggctggcgttcgagcgcgtggacgcgaacaacgttcccgggacctacatggccttccgcagagcggaggctctcgcgctcggtggctttgtcgaggggatgaacggtgaggactccgacctcaccttcaacctcggcaagctcggtctgcgttcggtgatcgacccgcgcatcgtgatctacgaggacgtcccccagacccttggggctttcttggagcagcgcactcggtggtcgcgcgcgtcgttccacatcggcgcgcgtcatcttccctggcgcgcgcgagagctccatccgcggctcatcatccaactccgcttcctcttcaacaagctcacctcgatgatccggccgatcacctacatctcgagtgccgtcttcttcttgctcatcccgcgggtcgctggctcgccgctgcgtaccctcgtgttgcttgctttcacccttgcgccgcaacttctcttgctgatcggcgtcgcgctctactggggattctggcgggaactacgccatctctgggtgtgggtgccctttaccatggtccgcaaactcggtttgctctcgggtatcctgtcgctgccgccgttgggcgcagccgtcgatccagaacgtcgggtcgaggccatggcagatgcgaacgctcgctaggcggctcatcctcggcgcgctcgcgctggcgctcgctggctgtggcgaggtgcaagcaccgcaccatcgcccgacgagtgagcgcgcggcgcacgagatcgccccgtcgctcgtcggggtgcattggtggctcgcggcctcggcgctgcgtcgcctcgatgcagcggcaggttcgagctggacgaatgcggtgttccgtccggcgaataccaccctgatcgtcgggccgtcgcaagcggccagctatgcggggtgggcggggcaccgcgccctcgatgcgacgagcctcgccggcgttcgcgaggcgctgcgcgtggcgacgtccggggatgtcgtattgctcgatctcgagcactggccgcgctcgccactggccgagcagcttcaggcgggtgcgacgttcacacaggctggcacgttggccagggcggcaggcgtcgatctcgtcgcggctcccgccaccgacctcgctctcgtcctcaccccgggccagcgtgttcggaccggttttctcgccagcggcgtggtgcaagcagcgtcgcgcgccgcgcagatcctcgagatccaggcacaaggtctcgaggcgacgccgtcgcggtatgcgagcttcgtcgatcaggtcgaggtgcttgctcggagtgcgaacccgacgattcgcttcgtgctcggactgtcgacgaacccgagtgggcaacgggtcagcgcgacaaccttggcccaggacatcgcgctgaccaaggctacggcgagcggctactggctgaacatcccccaggccggggtctcgtgtccgcggtgtggcatcgcgcagccgcaggtcgcggtggcgttgctgcggggtgagtcctgaggcgcaagctgctcctggcgggttcgctcgcgttggtggtggccgcggtcgtcgcggtcgcggcgccacgaggggcgaagcaccatcatcacacgcagcacctcttcatgccgagcccgacgggaggccaaccgatcgaggcaccaacgagcaggcacacgatctggctgctggccgaggcgcacttcgatcaagtcgtctccgtcgcccccgtccgtgctctctttgcccgtggcgtcgtgtacgaaccgatcacgccgcggcagcatccgagcaccctggtcccggtcattccgacggctgactttcacgccgagtcacagctcgcccaggcgatcgccgaccatgagcttgcgacgggagtgcgcgctgtgatctacgacaacgagcgctttgcgaacacccccaccgtcgagcaagacaacatccggctctccaccgagcgcgcagccgctgttgctcgcgccgcgggtctccagagcatctgtgactttatcgagtcggaccgacttccatcaggggagcgtacggcccagaacgaggtgccaccgtgcagcatcgtcgggctcaacacggtgcaacagtcggaacgatcgaccgcccggtaccgggctgtggtggcacgtgacgttgcggtgatccgctcggtcgatccgtcagtgccgatcatcgcaggcttgtcgtcgaatccgcgcggaacgccggtcactgcagcggagctcacggccgacatggaagcgacggcagggttggtgaacgggtactggctgaacgtgccggcgccaggcgtcggttgcccggcgtgccacgcgcccgaccccggactcatggcggaagcgctcgcggcgttgccagctgggttcgcgacgaccgggtgagtcggcacacacgacgaggacagtgacaaccagggggaaccacgacacgaggcgtgcgacggcagtggcggtggctgggtggcagtggctgggcgttgcgctggcgccaacgatctgctcgctcggcatcgtcgccgcgtcgtcggacacagctccagcggcgagcgaggtgccgggctggtcctttgccacggatctcgtcggcgcgacgacccaaggctcgctcgtggtgagtttcccgacaggcgcgagcgccggaacgcagctggtcgtcaacctgccgtgggcccacttctcgagtgccgtcacggtggcgctcgatggtcagtcctgccagggggtctcggctcgcgacgctggcgcgatcggcgcgagcctcgcgtgcacggttccggcggaactcgctgctggggagcacgtcatcgacgttgggggtgtgatgctcccgaacctcgtgctcgaggagtgagcgcccctgtggtggtcggtgctgaccggatctgcgcgaccgagtcggtggcgccacgttcggatgcagcggttggcgtgcgcatcgtggttcgcgacgcgagccgaagcgccgctggcgacagtgccctcgtcatcgcccagctcgtggatcggggcggtcttgcgaccacgaacggagccacgagcgttgcgctcgcgttcgacccggggaccggcgccagcgtcgcgccgccgtcgacatcgacgacacccgacggtgtcgtcggcgtgcggggatgtgctggccctggcaccgccggcatgacagcgaccgctgcgagctcgggcgaggtgctctgcgtcgtgatgcgccagacatcgtcggcgcccttgcgggtcgtcgacgcggcgagcgccttcgagtcgcctcagccgatggtcggtatcgctccgggctcggtcgtgggcctgggatcggcagcctgcgacgcctctgtcgtgacgaactcgggtggggtgctcgccgtcggcgagaacccactcggcgagctcggcaacggctcgaccacggtggcaagttcgacgccggtctcggtgacgttccctgctgggacccagatcgcgcaggtggccggcggtggctacttcacgctggcgcgctcgtcgaacggcacggtctctgccaggggcaggacgaccaggggcaggtcggcaacggcaccaccgaaaccgacgtcgccacgccggtgccggtcgcgctgcctgtcggcgctgccgaggtcgcggcgggttgtcacgcggcctcagtactgggtagcaacggcaccgtctacgcgagagggttcgaacacgacgggacagctgggtgccgggggtttcttcaacgacctcgtaccggtccaggtgcagttgcctcatggcgtgagcgtcagcgacgtcacctcgccaggcgtgtcgacggtggtcctgacaccacgagcggcgccgcctctgtcatgggcggcaacctgttcggccagctcggtgacggcatctacgtcacggccgcgacgccaacccgggttggacagtcacagctcgaagcggtcgcgatgggcggcttcacgaactggctggagccgttcccgaccatcgtccgcaccgacgctcggaccctcaagctcgagcgccctcctcggcgaggagtcgtggcagcgcacggggtgcgacgagcgcccgcacgacctcggcggcgcggcgtcgcttcgggacgatggctcgccgtgtgagaacgtcgtagtcgttgcgttcgacctcgagcatgatggcgctgtagagctcgcgtgccacctcgacgcagcggcgggaggcgcgcggcaggaggggatcaccggcgagtgagtcccgatagagggtccgtgctcgttcgatctcgaagcgcacgagcgctcgtaccgccggcgagggccgacgcgcgagcaagtcgtcgagcgccccgtggttcgccacgtcctcgagtggcaggtagatccgtccccgatcgaggtcttcgccgacgtcgcggatgaagttggtgagctggaaggcgagcccgagcgcgcgagcgggctcgcgagcagcgggtgggccaccgaggatggggaggaccatctcgccgatgacggcggcggatccttccatgtagtcgagcagatcgtcccatcgctggtagcgccggacggtgaggtcgcgccgcatcgcgccaaggaagcgagcgagcgtctccggctcgatctgccagcgctcgtaggtcgacaccagcgcatcgagggccgggtcgtcgctgccgccgcgtacgagggcctggcagagcatcgcttcgagctcgtcgagaccgcgacgcttttcgtcggtggtggcgctaccgtcgacgatgtcgtcggcccgtcgacagaaggcgtagatcgcccagatgcctgggcgcgcgtccggctcgaggaggcgggatgcgaggtagtacgtgcgcccgtagcggcgcgcgacggatcgagtcgaggagagaccagcggattggcgcatcatcgacgtaccatgcttcccgggtggtcggcgagcacgcgagccgcggcgagctgacccgaggtgagcgcgagcggaacgccgacgcccgggtgcgtccccgatcctgcgaggacgaggttgtcgaactcgcgaggggccatcggcgcgcggaacgggcccgattgccagaaggtgtgcgcgaacgagaacggcgtcccggcgtccatgccctgggcagcccacgcctcggggtcgagcacgatctcggagatggggtccgaacgacgagccagtccgaaggtgccgagacgctcttcgaggcgttcgcgcgccgcagccgcgtcctcgggccagcggagctggccgttcaggttcggcacgggctcgagggcgtagacgacacggccacggggcgcgatcgtcggatcggtgcgctggggcagcgagacgagcgtcgaggggtctcgcatgaggcgccgggtctcgatgaggtcgtcgaaggcttcctcccacgcttgcccgaagaacacgttgtggtgctcgaggtccgcgggaagcggggcgtcctcgtagcgcaccacgacgagggccgagggtgcgaggcgccaccgtcgcttggcgtagccgaggccgagacgtcgaccgaggccgagcgggtcctcggtcgtgacgacgacgtcggccgggtagcgcccctgtggcgtcgtgaccgcgctgatgcggctcccggtgcgttcgtagtgcgtcaccggctcgtcgaggtgcagctcggcgcccaggtcctcgcacaggcgcccgagcgcctcaccgagggccgccatgccgccgcgtggaaaaacgacgccgaggaccacgtccatgtaggcgatgacgccgaagagcccgagtgctcgctgcggggagacgccggcatagagcgcctggaaggtgaccgcccggcgaagcctcgggtcggacaggacgcgggccgcacgagcatccaagcgtccgaaggcgccgagtcgccacagacgccagagcgcgggtgcgcgcgtgagcagtcggtcgacgctggcgacgtcggcttcgatgaaggtcggcagctccgtcccggcgagctcctcgagccagcgggcccagcgctgccactcgtccagggcccgcgtgccggcgaaggcacggacttcctcggccatgcgctcgcgatcgctccaggttcgcagcacccccgcgccatcagggcccgtcgagtctgcgaacgcgagccggtaaccgggctcgacggggatgaggtcgaggtagtcgtcgaggttgcggcccgccgcgcgccagatcgatcgcagcgtaccgaccatggtgagcacgacggggccgaggtcgagcgtcgccccgtcgatgcgcacggcgtcggctcgcccccctgggcgcgagcgacgctcgagaatggtcacccgatgacctgcggccgccagcctcgaggccgcggagagtccggcgaacccagcgccgacgacgatgatacgtgccatcgatcagtgctgacgggcgacgatgaaggtcgcgaggtccccgagcgcgcagcgcgcctcagcggagagcgggaggtcgccgagggcatccatcgcctggtcggcaagctcgtcgatgcgttgctcgacccgatcgagggcaccgctacgacggacgaggccgagcacgtcgtcgagcgcacggccttcgaggttcgcatccccgagcgcctcgtcgaagcggacgagatcggcgacgtcgagccgctctcgggtctcggcaaccagcagggtccacttcccttcgcgtaggtcgtcgccgaccggcttgcgggtgcgagcaccgtcgccgaagacgccgaggacgtcgtcacgcagctgaaacgcgagccccaaggggagtgcgaagcgcgagagcgccgcgagcaccccgtcggccggatccgccagcagcgcgccgagatgcagcggtcgctccacggtgtacttggccgacttgaacagggcgatgtgctcggcgtgctccggggtgtcgaagagctgggcgctcgcgaccacgtcgaggtactggccgagattgacctcgagcttgagctgtgtgaacgtggcacgcaccgggagcggggccgcctcgagggcgccgtcggcaagcgtgagggccaagtccccgaccaagatgccgatcgcatccccgtaggtctcggcctcaccgcggagcttgagggagcggtgctcgtcgcgcgcgcgcgcatgaacggtcacagcaccgcggcgaagttcggagcgatccatgatgtcgtcgtgcacgagcgcgaaggtgtggaggagctcgatcgccaccagcaggtcaccgaggagctcgtcgtcgccgtccacaccgagcccacgcgcggcccagaacgcaagggcggggcggaggcgcttgccgcccgcacgcgtgaggcgtgacagctcatcgaacggttcggcgaagcgttcgtcgatggcgcgccagcgtgccgcctctgcgtcgagcagatggccgaggcgtgcctcgaccaggcgtgtgggggctccgaggacctccggttctgcgacgcacggctccaccaccgcgctcgattcgtcgtccacctgcgcctgactcctcgaccactcgtccttcacgacactgtgcaaccgcgaggtcgcaccgtggcttcccgtaccgagcctagtgacgagacctcggtaggctgaagccgtagcgacctggaggggagcgtcgtgatcgatccggagctggtggacctcgtgctccagcgcgcgctcgcccgtgggggcgacttcgccgaggtgttcgtcgaagaagtgcgctcgacctcggtgagcgtcgacgacgggcgggtcggcgccctggccgacgttggatggcgtggggtcgggatccgcgtcgtcgtcggcgagacgaccggctttgcccacaccaccgacctgtcgcctcgcgcgctcgtcgcggcggccgagaccgcctcgtcgatcgcgaagggaggcgcgagtcgggtcgctcccctcgaggtagcacccatcgagcctgcggcgcccgagcgcgacccgagcgccaagcggcgcatggtggagctgctgcgcgctggtgagacggaggcgcgagggctcgccgatgcgatcgtccaggtgtccggccaggccgcgaccgcgcggcgtcggatcctcgtggccaactccgagggccgattcgtcaccgatcggcaggcacgcacgcgtgtgtcgttccaggtcgtggccgccggggacaccggggcccagagtgggcgcgagacgtctgcggccaccgtcgatctcgaggagttgctcgacgccctcgacgtcggcgccctcgcgcaggtcgctggacgacgggcgcttgccaaactggcggcgcgtcccgctccagcaggcgttctgccggtggtgctggcgaaggggtcgggcggcatcttgttccacgaggcctgcggccacggcctcgaggccgaccacatcgccaagggcgcctccgtgtacgcaggccgtctcggtgagcgggtggcgagcccgctcgtgacgctcgtcgacgacgggacccgggccggggagtgggggagctaccacatcgacgacgagggcaaccctgcccagtcgaacgtgctgatccgcgatggtgagctcgtcgactacctctgggatcgccgcagcgccacgaagctcggccagagcccgcgtggcaacggtcggcgccaggactatcgatccctgccgatggtgcgcatgacgaacaccttcctcaccccgggggagagcgatccagcagacgtggttgcgagcaccgaccacggcgtctacgtggccgccctctccggcggtcaggtcaacacggccaccggagacttcgtcttcggggtgcaggaggcctacctcatcgagcacggccgcatcaccgctcccattcgcgacacccagctcatcgggaatggccccgaggtgctcgctgccgtggatgcggtcgcgaacgacttcgacatgaccgcggggacctgtggcaagaacggtcagtccgttccggtcgggtgcggccagccgacgctgcgactggccggtgtgacgctcgggggaacgatcggtggctgagctgttggagcaggctctcgcgctcgtggacgatcggcgggccggggaggaggtcgaggtcgtcgtcgggcgatcgcgccaggtggaggtcgtcggcttccacggcgcggtcgagtcgctgacccaggccgaggaggtcaccatcggggtccgggtcctcgtggcgggccgcatcggcttcgccacggtcgatgcgctcgaccccgctgccgcccgcgacgcgctctggcgcgcgagagagaacgctgagctcgtcgaggcggaccccgacgcggtcttcgcggtgcccgacgacgtcgcccccgtcgtgctcgagctcgtcgacgagaccctgtcggcggtctcgctcgatcgcaagatcgccacgtgcctcgatctcgagcgcgcgtgtcgggctgcggacccgcggatctgcgacgttcagtcggcgacctacggcgagctcgacggcgaggtcgccatcgcctcttccaccggtgtcgcgacgcaggtccgatcgacccgcgcttggctgttcctccaagcgctcgctgcggatgggcgcggtgtgctctcgacgggttttgcctcgtctggggcgcgaggcttcgagggcctcgacgcagatcgcgtggcgcacgaggcggcgagccgtgcgctccgggggatcgacgccaccaagcccgtgggccgcgaggtccaggtccgtttcgagcctcgctgcgcacagacgctgctcggtctctgggcgggtgccctgtcggggctcgcgctcgctcgtcgtcgctcgatgttcgtcgatcgcctcggagagcgggtcgcgccctcgtggttctcgttggtggacgacccgacggacgggcgctcgctgggggcgaccccggtcgacggcgagggactcgcgacccgaccccatcggctcatcgagggtggcgttgccgccgaggcgctctatgacgcctatgccgctcgactcgccggacggcaatccaacgcggccgcgctccgcgcggttggcggcctgccggcgccgggcgcgcgcgccgtgcgggtcgaggcgccgaggcgaccggtggccgaactcgatgccgccggtgacgtgctcgtcgtgcggtcgctgtcgggggtgcactcgggcaccagcctgatctcgggggacttctccgtggggatcgaaggggaactcgtcgggccgaacggtgctcagccggtgcgtgaggcgaccatctcaggcaacctccagcgcatgctgctcgatctcgctggcgtcggtgacgacgaggtcgaactgccgagcgggacgcgcgcggcgagcctgctggtcggatccatgacgctcgcgggccgctaggtgcgcctcgatctccatgtccacacctacgcctcgggggactcgacgacgagaccggaggagctcgcggcccgcatcgggcccgatgacgtcatcgccgtcaccgaccaccacgcgatcgtcgcggcgcgcgaggtcgcggcgcttgtcccgggccaagtcatcgtcggcgaggagatcgacaccggcgcgggggagctgatcggtctcgggctcgacgctcgggtgccgccgcgtgcgggcctcctcgagacggcgcggcgcatccgcgacctggggggtctcgtgctcgccccccacccgaccgatcccgcgcgtcgtggtctcggtcgagcgggactcgagcggctcgcggacgacggtctgctcgatctcgtcgaggtcgccaacgccaaacgcgtcgcctgggatcgggaggcggcgctcgtggcacgtgagcgagggatcacacaggtcgccgccagcgacgctcacgtacctgaggctctgttcgcgtcctacgtcgaggtcgccgggccgcggtgcgagatcagagggttgacggagctgctcgcgctccttgcgcgtggggcgctgcggcacgcgccgcgcgatccggtacgtccctggccccggccggtggtcccgggctcctgaggctcgaggacgatcgcgctagacttcgcgtcgtggacgatgtcctgtggctctccgccatccgtcgggcgccggtgcttgggcggggtggtcacgagtttggtcgtgtcgatgacgtggtgcttcgcctcgtcgaagccagctatccggtcgtcgtcggcgtcctcgtgcacgtcgacgaccagcccatgttcgtgccggcagatcgcatcgaggagttcggcaccgagcggatcgtcacgacgctcgaagagggcgagctcggccggttcgagcgtcggccccaggaggtgctcgcggttcgtgacctgctcgagcaccacctgatctggtcgaagtcgaagctgcgtccgcgactcgtgagcgctcgggacctcggcatgatcccgttcgcgggcgagtggcgcgtcatcgcggtcgacgtcgcccaagagcaccatcgacgcttctggcacgccaagcgcgaggcgagggtcgtcgactggcgcgatctcgtccccttggtgggccatgtgccgagtgcgaggatccgcctcgagctgcgctcgatccggcgcctgcacccggccgaactcgccgacctcctcgaggacgcctcggagtcggaggggcgcgagatcatggcggcgctgcaggcggacccggccttcgaagcggacgtcatggaagagctcacgccgcagggtcgtcgggacgcgatccgcgagcgcagcgacgccgaggtcggcgagctgctcggcaccatggagcccgacgacgcggtcgacttgttgatgagcctggagcaggagcgacgcgagagcgtgctcgcgctggtgcccgagccgcagcaggcgaccatcaagcgcctgctcgcctacaaccctgagtcggccggtgggctcatgacgaccgacgtcgtcgcgctcgcggcagggacgaccgtcgcggaggcctgcggcacgcttcgcgcgcgcgccgccgtaccggagaacctgtgggtgctgttcgtcgtcgacgccgagggtcgcttcctcggtcagctgcccctcgtcgcgctccttcgtgccgccgacgacgcctcggtggatcagctcgctgacaccgaggcgcgcaccgtgcgtcccgacgcggacctgacggaggtcgccgtcctcatggccgacttcaacctcgccgccgtggccgtcgtcgacgccgagggggtgctccttggcgcggtcaccgtcgacgacgtcctcgttcgcaccatccaaccgggatggcgccgacgtgccgaagcgctcgacgggtagccgcggcgcgcgtggcgtgtgcgggtcgatcgtggtaggcgcgcctgcgagcgctcgcgcgtgaccctcgctggcgcgctcgtcagtggccgaggtggacgaagctgacgaccatcagcatcaccgcgatcaccaggtaggcccgaagcccgatgagggcgacctgacggcctcgcgagaagcgcgggcggtgcaagagggcagcggcgggcatcgtccagcgcagacggtcttccatgggcatcgtgggacgatggtggcggctgcgaagttgggcgatcgcgacgaccgccgtcgcgacgacgacgagggcaccggtcgcgaggacgagcccgatcacgttgatcgagggcacgatcgtcaccaccgtgagcaccaggctcagctgcaggagcaagcccacgatgaacgttgcgaggacgttgagccaaggcgggttgacccaggggccgaggatctctcgatcgttgcacaggagcagcaagaacgcgagggcgctcggcaggaggacgcccgcgaggacctgcacggcgaggttgatgaggctgagggggagacgcgggatgagggtgagtcctccggcgagcaccacgagcgcgacgtagctcgcgtagaagcctcgagcctcgcggacgggggcgttcagcgactgctcgaccccgaacaagtcgccgagggcataggccgtcgagagcgtgaccgtggcggccccgatgagcgacgcctcggcgagcacgatggcaaagagcgcacctgcgacgacgctgacgtggtggctgaagcccgatgcgatcgcgcctgcgctgccaaacgaccctgcggctcccgcgagcgccgcggcggcggcgatgatcaccgcggcggcggcgacgttggtgacgacggccccgatgaaggtgtcggcacgctcgaagcggatccagcgaggcgtgatgcgcttgtcgatgacgttcgactgctggaagaacagctgccacggggcgatggtggtgccgacgatgccgatgatgaagatggtcgcctgcgaaccgaggccgcccttgacacctgggacgacgaggccgtggagtgcggccccccagtgcaccgggctcatgcccatgagggggaagacgaggaggctcacggccaccaggatcagcatgaagcgctcccagcgctcgaaccgtccggagacgacgctgccgatcagggctacggccatgaggcccgccgcgatcgtcgggctgatcccgaagaacccgagcgcgtagcggatgccgatgaactcggtgacgagggtgaggaagttcagcaggaagaggtcgacgacgctgaaggcggcccagaaggtgccgaagcgctctcggagcagcttgccgtggccgacaccggtgacggcaccgagccggaccaccatctcttgggccaccgcgaggacgacgatgaggatcggcagcgtccacagcagcgtgtagccgtaggcctggccggcctgggcataggtggtgataccaccggcgtcgttgtcgccgaccatgacgatgatgcctgggccgaggatcgcgagcagcgcgagcagacgccggcgccagttgggtgagccagccagtgtgccagcggtgacggaaccgagcccgccacggatgacctcatcctcgggcgtgctcgtgcgggagtcgtgcacggggggacctccacgttcgagacgatggccagaacgagcgcttaggcgcggcgtgcgcgccaagcccggacggagcggcggggacttgagggctcggtgcgcatcccagcctcccttcgctgcgtcggggtcctcagtgcatgcaggggcagtctacgccggatggggcgcgagcagggtcaggcggggacgtgcccgatcacgatcgccgcctccgagacgaccgggatgacctcgacgccgccgaagccagcctcccgcaggatcgtgacccagcgctcgcgggagatcggcctttcctggacgcgcaccacgtagcgcacggcgttcttggcgatgcgccagtacccggccggtccacgggcagcgaaggcgcggaccttctcggcgatgatcgcgcggtcgctggcggactcgccgcgcccgagcatcatgtcgccgatcacgaggcgacctcccggccggagccagccgtaggcggcacggaccacctcggccttcgcgcgatcggagagatggtgcaagacgtagttggagaccacgacgtccacgctgcgaggctcgagcgcgaagcgctcgagcggcgtcgcctcggcggtgacgttggcgaggttggcggcgcgcgcgcgctcgaggaggcgggcgaccatccgctcagagatgtcgacgccgtggacgtggtgggcgatggcggcggcgggcaagctcacctgacccgagccgcagccgaggtcgacgacctcgtcggtggggccgagcgcggcgtgggcgacgaccgcctcgacgacccgttcgagccctggcgaggcctcgtgctcccacgatccgacgcgccgttgccacacggtgcgttggagccagattgcaaggtcttcgctgcgtgccacgcggccagtgtaggagagcggggccgaggtacgcttgagggccatgtgcggccgtttcgaccagcggttcgggccggagcgcctcgcgcgagcgatcgccgagcttgcgacgccgctcggcgctgaatcggcgacgccgtcgggcatcgcgtcccgcggcgtcgtcgtgccgtcggacggcgcgatcgtcgtccgtatgagcccctcgctcgaggtcggtgagctcaccttcggcgtgaggacgcgggccggctcgctcgtcatcaatgcgcgtcgtgagacgctcggcgagcggccgctgtttcgcggtgcgctgtcggggggccgctgtgtggtgccgatcagggggttctacgagttcaccgggccgcgcggtgcgcgctcgccggtgttcttccactggaatggcgagctgcactggctctgcggcctcgccgtcggcgagggactcgtcgtcgtgaccgagcctgctggcgggcccgtcgccgggtggcacgatcgcgagcctgtcgtgctcgatcacctgggcggcgccgcgtggctccgcgacggcgaactcgccacgggcggtgcacacgacgccgaggtcatcgtgctcgatcgctcgtggacgtcgccacgtggcgatcgcgacccgttggcgttcggggggcctaggccggatccgacgtgatctcgggggtcgccgattcgtgcgcgccgagccaggtgcggatcttggcggcgatcccgaagccgtcgaggccgagatcggcgaggagcgcgtcggggggaccgtggtggatgtagcgcgtcgggatcccgagcgtcgcgacggggatggtcgggcgcacggcgcgcagcgcatcggcgaggaacgcgccggcgccgccgtggacgtagccgtcttccacggtgacgaccgcatcggccgaactggcgagggcgatgaggtcggggtcgatcggtcggacgacccgtgggtcgatcaccgtcgcctcgaggccatcgtcgtggaggaggtcggctgcggtgagcgcgggcgtcaccatcttgccgtaggcgacgatcacgaggccagatcccgcgtcgcgcaccacccgagcgccaaggcccgtgccgacgccgccgcggatgcgccggggacccggtgtcttcgagaagcggatcaggctcgggccgtcgagcttgagcgcctcctcgagggcgatgcgcacctcgtcggcgctcgacggcgtaaagatcgtgacgtcggggatcgcgagcatctcgacgaggtcgaggacgccatggtgactcggtccgtcgtcgccggtgatcccggcgcgatcggcgacgaagacgacggggaggtggtgcagaccgacgtcgaggttggcctggtcgaacgcccgagagaggaaggtcgagtagatcgcgacgaccgggcgcagcccgaccatcgccatccccgctgcggcggtgacggcgtgcgcctcggcgatgccgacgtcgaagtagcgatcaccgaagcgttcctggaacggcaggagccccgtgggagcgcccatcgcagccgtgatcgcgacgacacgccgatcgcgttcgccggcatccaccagcgcgcggctgaacgcctcggtgaacgagaccggctcggccccctcgatggtcgtgagcgctcgtggcaccttgaggtcgtgcatgcgctgcacctcgtcgtcgaccgctggctggtagccccggcccttctcggtgagcacgtgtacggcgatcggcccgtcccactccttggccccctcgaaggcgtagacgagctcgtcgatgtcgtgaccgtcgacgggcccggcgtagcgaatcccgagggcctcgaagaacacccgcggctcgatcgcttcgcgcagcgcggcggtcaccgaggcgatctgggatgcggcacgagggccgacacgaggaatgtccgagatgacctgtttgacgcggttgcgcgccgacatgtaggtggggttgagtcgcagtcgggtgagcgacgacgagagtcgggagatcgtgggggcatacgagcggccgttgtcgttccagacgatgatgatcgggagcttgcggtgaccgatggtgttgagcgcttcgtaggcgagcccgccggtgagcgagccgtcgccgaccaccgcgaccacccggcggtgtggtgcgctgccggtgaggtcgaagccagcggcgatcccgtaggcatacgacagtgccgtggaggcgtgggagttctcgatccagtcgtgctcgctctcggcgcgattcgggtagccggacagccccccttgctggcggagcgtgtcgaagatcgcgtgacgcccggtgagcagcttgtggggataggtctggtgcccggtgtcgaagaggatggcgtcacggggcgagtcgaacgcgagatggagcgcgatggtgagctccaccgctccgaggttggagccgaggtggccaccgttcgcgagcacggtcgtcacgatgcgttcgcgcagctcggcacagagcgccgtccgttgggcgggggtgagcgagcggaggtcctctggccccttgattcgatcaagtagttcgtaggacatgtaacccctagcttacgacggcgacgaccctcgttgcacaacgcgaatcattgtccacttcgtcccgtaggctcttcgtcgtggggcactggttctacctcgaggtccttggcctgtgcatactggtgacgctgccgctcgaggtcctcggggcgcgggtgtggcgccagccgcgtcggctcgctctcagcgtcggcatcgtcgccgtctgcttcagcctgatcgacgccgtcgaggtgtaccagcgcctgtggcactacaaccctcgctacgtgaccggtctgcgcatcggtgatctgccgatcgaggaggtcgcgttcttcgtcgtgatcccgatctgttccctcctcacctacgagaccgtgcgacgacgccacgagctcgtcgcgcggtggcgccggcggtgagctacacgctcgaggcggtggcgctcgcgatcgtggccgtcgccatcgactggtgggtcacgcgctcgcgtgtggtgcgaaccgcgtcgttctggatcacctgggtcgtggtcgctgcgttccagatccctgtcgacggagccctcacccgactccgcgcgccggtggtggagtaccgatccgggacctacctcgggatacggctcggccacgccatcccgatcgaggacttcgtctacggctttgccctcgtgctcgtgacgatctccctctgggtccggtttggtcgtcgcgcgagtcgctagggtggtactcaggcgtcgacagagcgtctctggcggctgtcgacggcgaagcaggaggtggcgcatgctcgtgctcatcgcgctgatcgcgttcgtcgcaatggaacccgtggccgcgctcgtccatcgtgggatcatgcacggtgtgggctgggtgatccacgcctcgcaccatcggccccgggaagggacgttcgaggcgaacgatgccttcccgctgttgttcgccctccccacgatcgcgttgttctggttcgggcggcatgaccctgtcgctgttgcgatcgcggtgggcatcacgctctacggcgtcgcctactcgttcgtgcacgacggctacatccacgagcgcctcggtcggatgccgaaggtgcgctacctcgagtacctcaagcacgcccatgcggtgcatcacctctacaacgagggcccctatggcatgctcgccccgatcgtgcccgccaagcatcgcgcgaagctcgagctcgaggcggtgcgcgcctggcgtccatcggtcgcacggtaggagcttcgctcctcgcatcgacgagaccagacagctagcatcgggacggtcgagcgaaggaggctgatcgtgccgaaggtgctcatcctgaccggcgacgctgcggagtctctcgaggtcttgtatccctaccagcgactgctcgaggagggctacgaggtcgatatcgcggcaccgtcgaagaagaagctccgcttcgtggtgcacgatttcgaggagggcttcgatacctacacggagaagccgggctactcgtggcctgcagacctgagctttgcggaggtcgaccccacggcctatgtcgcgttggtcatcccgggcggtcgggccccggagtacatccgcaacgaccccgatttcgtccggatcgtccgccacttcttcgaggctgaccagcccgtcgcgcagctctgccacgcgccgatcgcgctcgctgccgccggcgtgctgcaggggcggcggtcggctgcttatccagcgcttgcaccggacgtgcgcgctgcggacgccgagttcgtggatgcggcggcggtggtggatgggcagatggtgtcggcgcgcgcgtggccggatcatccgagctggatgcgggccttcatcgggatcctccgcgagaaggctccggtcggctgagtaccgtgccggccgcgaccagcttgtcgtaggtcggcatcgcacgacgggtactgtcgcgatcggtgcgacgtctggccacggtggtggcgcggcgaagctcgcatctcgcggcgtcgacggtcgtgtgcgagccgaggtgtcacggcgcacccgtcggtgactcaggggggtgctgtctgctcgagcacgtcccggagagggcaccgtctgttcgggcatcgtctggtcggggcgtcgggtggcctcgccggttggctggaccggttgtacaggaccagccgcgctggatggtcggtgcgagaccctcgcgggcgatgaggtgcgctcgcggtcgtgccgagtgggtcagtcctgcgcggcgaagttcggccggatctggaacagcaagtaccacccgatggcgatctcgatgagcgtctcgagcacaccgccgaccccgacgaagatggcgatgacgatgccgaaggcgagctggaggaccgtccccacgaagatgaggcgccagcctcggtagcgtccgcgcttcagcggtcccgtggccgcgatgtagagtacggcgaagaccgccgtcagggcggctgcgaggtagagctcactcgtaacgtgggtactcacgaagaagatgcccgcgagcgacgagccgagctcggtcgcaaggcgtgcgagctggacggcgtcgagtgcgaagaggatcccgacgacgaggctgatcagccacgcccaacgggtgagccacgccacggctccggcgggtagcttcggcaagccctcgctcagcgagccgaggcgctgctcgagcgcagtgatcacgacgacctccagttctcagcgatgtctcagtgtagcgacactcggtacgacgaagcggtcgttcatggggcggggcgaggagtggcgatcggcgcgacggtcccggcaccgaggtcggcgaggcgcgctgcgtcgatcgcgacgatggtgtcgggcgtgcccgcggccacccatacgacgcccgcacgagcgagctcggcgtcgaccaccacgcaggcagtcggcggcgcgatgagtggggtcgcgcccccgggcacgacgccgagcgcctcgatgaggtaggtccccggtgcgggctcgatgcgctggcgggccgcgcgctcgagcgagcgtcgatgcactctgcgatcgcccgcgacgacggcgagcaccgggccaaggtctccgcggaacacgacggtcttggcgatcttgtccgggtgcgtgccggcggctgcggctgcatcggaggcgaggtgggtcccggtcgcgaactggcgaatggtcgcgaggacgcctcggcgtgcgaggcgctcggcggccaagccagcgggatcggcgagcagttgcggcgtcatgcctcgagcgcgtcgacgatcgagacgccggccgggccgtcgagctcgccgatcacgagcacgcgcaccggctccccggccgcgacaccgtcgccgtcggggaccagggcgagcacgttggcgcccgcgagccctgagagcacgtgggagccctgaaggcggtagggctcgacgacgagctcgccgctgcgaacgtgggcccgcgcgcggacgaggtgcagcttgccgtcggggtggcgggtgatgggttcgagtgccctcgcggtgaggaccgggcgatgccaggtccgagcaccgagcatcttgcggatgagcgggcgtgcgaacaactcgaagctgacgatcgacgacaccgggttgccgggcaggccgatgacgggtgtctggcccatgcgcccgatggcgagcggcttggcgggcttgatcgcgacctgcatccagcgcatggttccccgctccgcgagcacctgcttggtgtagtcgaagtcaccgacgctcaccccgccgctcgtcaggatgagatcggcgctcgcagccgcctcgtcgaaggcgcggccgaggagcgctggatcatcggggatcgcgccgagatcgctgggaatgcctccggcctctgcgacgagggcgaggagcgcggggcggttcgagtcgtggatcttgccggggggaagcgggtcgaggtcggtgagctcgtccccggtcgagaacaccgcgacccgcggccgacggtggacgaagaccttgcggacgccgagggacgcgagcaggcctctgaccgctggcgtgacgggcgtgccctcggcgaggactcgctcgccggcagcggcgtcggagccgcgtcgacggacgtgcgtgccggccgcgatcggagcggtgaggtggacctcagagccgtcgacgatgacgtcctcgacgatcgcgatcgcatctgcgccctttgggatcggggcaccggtcatgatgcgtgcggcggtgcccgcggtgacgacgacgtcgttcgggtcgtggccggcggcgatggtagccacgatcgacaaggtcaccggcgtggcgcggctggccgcttgcgtgtcgacgctacggacagcgaagccgtccatgccggtgttgtcgaacggagggagcggatcggcgacgacgaccggcgcagcgaggacggcaccgagtgcctcgtcgatccccacctcgaccacgggtctcgcaccggcaagctcgagggctgctgcctgggcttcagcgagtgggatcacggtcctcctctgtcgtctcgaggagctcggtgagcacccttcgcagcgccggaccgaggtcgggccgttgaagggcgagctcgacgacgctccggaggtagtccagcttgtcgccgatgtcgtagcggtgacggccgtcgaagcgcaccgcaacgaccggctcgtgctcgatcagccgtgcgatggcatccgtgagctggatctcgcctcccttgccgggcggggtctcggcgagggcgtcgaagatcgccggcgtgaagatgtagcggccggtgatggcgagattcgacggcgcctcggaggcatcgggcttctcgacgacgctgcggacgtagtcgacaccgtcctcgtcgacgacaccggcggcgccgtagagcctgatgcgctcgggcgggacctccatgagcgagagcaccgaggcgccggtgcgctcgtggagggcgagcatgtcggccaggagcggcgaggcgggtcccatgatgtcatcggcgagcatgacgacgaaggggtctcggcccacgtgctgggcggcgacgctcaccgcgtggccgaggccacgcggttcgccctggcggaggtagtggatctggccgagatgggagatgtgctcgaccagcgccagttcggcgaacttctcttgcctggcgaggaggagctccagctcgacggcgcggtcgaagtggtcctcgatcgatcgcttgccgcgcccggtgacgacgaggatgttggtgaggccgtgcgtcacggcctcctcgacgacgtactggatggccggctggtcgacgaccggcagcatctccttcggttgggccttggttgcagggaggaaccgtgtgccgagcccagcggctggaatgaccaccttggtgagcacgaccgcctccatccatcgtctggcgcctggccaacagagcggagtctaggcgacgagaagggccaggttggggcctacgatggaaggtaccaacgtgcgcgccgtgtgcgcgagttgcgatcgtggtgcgatgagtcgttcgaccgaggtcgaggaggacaccgatgccgacctacgagtatgcctgcaagcagtgcggcgagcacctggaggtcgtccagtcgttccaggacgagccgctcagcgagtgcccgcggtgcggcggcgagctgcgcaaggtgttcggctccattgggatcgttttcaagggttctggcttctacaagaccgattcgcgtgcgagctcgtccgggtcggtcggtcgcagccacggctccggtgggagcgatgccgcgagcgctcccgcgtcgacctcgtccacgtcgacgtcgaccacgggcgctgagtcgtcctcgtcgagttcgtcgacggctggctctgccgcctagggtcgcctgcccgggcccgggggttaccggacggtaggctacgtccgtgcacaaccaccaggcctggtgcggtccttcggccgtgcgagcgagtcggggcgccagctctcgtggctgaggatcgtcttcgtatcgccctcacggtgtatcgagggaaccccacctccggaggccaaggcgtctacacggccgaactcgcgcgccgtctcgtcgcgcggggccacagcgtcaccgtcgtgtcgggtccaccgtatcccgcgctcgccgagtcgatccgcctcgagcccctcggcggcctcgatctgctgcgccagccggatccgtttcgccggccccgactcgacgaactcaccgacgcctacgacctggcagaggtcgcgctcttggcgaccggcgccttccccgatccccgcgcgttcggcctgcgctttcgcgcctggtggcggcgtgagggtcatcggttcgacctcgtgcacgacaaccagtcgctgacgccagcgcacgccgagctcgtgcgcgacggcgtcccggtggtggccgcgatccaccatcccatcaccgtggatcgccagctcgccctcgcggccgctggatcggtcaaagagcgcatcggcctgcgccgcttcttcggcttcgtgccgatgcaggtgcgcacggcgcgggtgatgccgcgcgtgctcaccgtctcgtccgcctcggctcgtgacatcagccgcgagctcggggtggcgcgctcgcgcctccgggtcgtgccgatcggcgtggacgcggaggtcttccgacccctcgaaggggtgcagcgcaccgccacgttgctcgcgaccacggcgagcgcggatgtgccgctcaagggtctcggggtgctgctgctcgcgctcgcgcgcctgccgagcgacgtcgagctcgtcgtgatgggcccgcgccgggagggctcccccatcgaggcgctcatcggtcagctgggcctcggtgagcgcgtgcacctcgtcggtgcggtgagccgcgagcggatggtggaggtgtacgcgagcgctgcggtcgcggtcgtgccgtcgatgtacgagggcttctccttgcccgccgtcgaggcgatggcctgcggggtgccgctcgtcgcgacgaccggtggggcgctcgcggaggtcgtcggcgggctggcgccccaggtgcccccgggcgatccggtcgcgttggcccaggcgatcgccgcacagctcgccgaccccgccggcgcccgcgagcgcgccgcgagcgcgcggagccgggtgctcgcgcgctactcgtgggacgaggcggctcggcgcaccgagcaggtctaccgcgaggtgttggaggcgtgatcacctttcggccggagcacctcgcaccgctcgagggtcgtcgcgtgctcgacctcggtgcgggtggcggtcgccatgcggcatggctccgcgaccacggggccctcgtcgtcgccggcgacctcgtcgtcgaaccgaccgatcgtgagggggtcgactgggtccgcctcgacggtgcggctctgccctttgcggacggctcgttcgacgtggtgctctgtgccgaggtcctcgagcacgtcgcgcacccggctcaggtggtgcgcgaagcgcggcgtgtgctcgcacccgggggccagctggtcgtgagcgtgccctcggcgtggccggaggccgtctgttgggcgctgtcgctcgagtaccacgccgttcccggcggccacgtgcgcatctggacgctcgcagggatccggcgcctcctcgaggccgagggtttccgcgtggtcgcgcgccatcgccgtcacgccctgcacgcgccgtactggtgggctcggtgcctgctcggcgtggagcgctcgggtcaagatccgcgcatcgagtggctggggtggcgtctcgtcaaggcggccgtcggcgaggctccgctgctcgcgcgcctcgagacgctgctcgaccccgtcctcgggaagtcgctcgtcctctatgccgaggccgcaccgtgctgagccggagcgagctgcgtcgcaccgcggcggccatcgcgagggtccagttgccctcggggatgatcccctgggccccgcgtcgccatggcgatccgtggaaccacgccgaggcggtcgccgcactcgcgctcggtggggaactcgccgccgccgagcggggtctggactggctggcgggcgtggtcgcgcgagacggtgccttctgtcagtactacctcgcgagcggcgtcgaggagcctcggatcgacctgaacgtgtgtgcctacccgatcgtcgcgatcgtcgcgtgggtcgcggcagggggctcggtcgcgaccgcacgggcgcacctcgcgtggtaccggcgcaccctcgagctcgtcctcggccaccagctcggcgacgggaggttcccctgggccctcgaccccgggcgtcgtcccctcgagggctccttgcgtgccggttcggccgcgatggtgatcgcgctcgatggcgccgcctgggccgcgaacgaactcggggtgctcgaggctgggccgatcgaggaagcgcgctcgcgtctcgcgctcgcgatcgccaaggacgaggggttcctcgaccgcttcgagtggtcgatggactggtactaccccgtgctcgcgggcgtcctcgagctcgatgcggccgaagatcggctcgatggactcttcgagcgggcgcgcgagtcgaccggccagctgcgctgcgtgctgtcggctccgtgggtgacgacggccgagaccgccgaggcggcgatggcggcctggcgactcggtcgcatcgcagatgcccgagcgctcctcgcgtccgtcgagtccctccgcgaacccgacggctcctaccgcaccggtatcgtcgtgccggagggacactccttcccgaccggggagtgctcgacctactcggcagccgcggtggtgctcgcgcaccacgtgcttcgtgccccgccgcgcgccggcctcatcgaggccctcgtcgcggcctcgtagcgcgcctcgcgatggcgagcgagccggtgcgctcgacgaggtcgaagccgaggtggagggcggcggtgagcatgcgccacggtgcctggcccccgtcggccgggtcctcgaagacgtcgtggacggcgagcagcccgcccggtacgaggaagcggcgggcgagctcgagatcgagatggcagctccgcgcgtcgtgaccgccgtcgacgaggacgaatcctgccaccgggcgcacgaggtcgatgaggccacgcccatcgcccacccagagggtgacgtgacgctcgaggtcagcgagcgccagggcgtcgcgcagcgtcccgagcgagtcggggctaccgaggtcgccgtcgaggagacgcgggtcggcccaggggaacggtgggcgcatctcgatggagccccggtggtggtcgacggcgaggaggcggaggcctcgttcgcgtgcgaccgagccgagccgcacggtcgagcgaccgcagtaggaaccgagctcgacgagccatccgcccgctcgcggggcgactcgcgcagcctcgatgagcgcacggagctcgtcggcggggaagaagcccgggagtaggtcggcgagagcagccggcccgtctcgcctaggctggtcggcgtgcagcttcgctggatcgtcgtcgcgctcgtgacgctggcggccggcggcgccctcgggggcgccggctggatcgcgggtgccatcgcggcggccgtggtcgtggccgccgggaggcgatgccgaggggcctcgtgcgcgagctcgcacggcgggctcaggcgagttggctggtgagccgtcctgcgtagcgggcgcgcaggcgcaggttgacctggtagcgctccagggtctgggcgagcacgcgcttgcccgccgggatcgggtgctcctcgaggaagcgtacgatctcgccggcgcgctggtaggtggtcggtccgatgacgagcgcgatgctctggagcatgcgatcgatcgtgttgagcgggaatcgggcgagcatctcatcgaagcgagcgaacaagaagtcgatcgcctggttctggagcgctgggttcgcgatcactcggttgatgaggaagggtgcgtcctgggttcgcacttcgctcatggccagatccagcacgcgccgcccgagcgctggttggcggaactccgcgagggcgaacaggtgacgctgctcgtcctgggggttgcgcgggtgccgatagcgatcgagcatgaaggcaaagtccgactcatcaccgaagcgcgcgacgacgccgaggacggccgcgacgagatcggcgctcggcccgccgatgccgctcatctcctcacggaagcgttctctggcgtgctggcgcacgtcgggatcctcggcgatgtcgccgagcacgtcgtaggcgatggcacgcgcggtgcgatcctgcggggtgtccgtcgggcgggcctcggtgccgaagtagtcgaggaccggtccgaacaccgaggccgcgagggcacggacgtgggtgatctcgctcggttcggcgatgcgctccagcaggccgagtgcggcttggccgatcccgaggatgttcgggtcgcgctcgtcgcggaggcgctcggcgagaccgaggaagtcctcgagtggcgcggcgcccgactgggtgagcgcccatgcatcggcgatgaggttgaagcgctcgagcgtctcgagctggccgaacgactcggccagctgggcgaggagctgttgggcgtagcgggcccgaaagacgccctcgccgtgggcgttgaccacgaccggcgcgggaccgacctcggccgacatctcgggctggtcgagcagcacccgccgctcgccatcgacgagcgagcgcagtgcgatcggcacgtgccacagtgatccgatggcgccgatcggatcgtcgtcggccgcgaggagccggaacggcgtctgggcgagccggacgccatcggggagcggatcgacgctgacgagcggatggccgccctggaacacccaggtgtccatcatggcgccgacgtcggtaccgctcgcctcgccaagggcagcccagagatcctgggtctcggcgttgccgtaggcgtgggcccgcaggtagcgacgcacgccgtcgcggaagacctcgggtccgaggtgctcggaggccatgcgcaagatggacgcccccttctcgtaggtgagaaggtcgaacatgtcctcggcgtcctcgggtgcgcgcaccgtgtactcgatggggcgggtcgagggaagggcgtcgatgcccatggccgcgagccgaccgatggcaaaggcctcccaccggcgccactcggggcggaaggcgtcgacggcggtgacctccatgaaggtggcgaaggcctcgttcagccagatgccgttccaccagcgcatcgtgacgagatcgccgaaccacatgtgggcgagctcgtggcagacgacgtcggcgacgcgctcgagatccacctgcgcggcgttgtcgcggtcgacgaggagggcggtctcgcggaaggtgatcgcgcccaggttctccatcgcgccggccgcgaagtcggggatcgcgagcaggtcgaccttgggggcggggtaggcgatcgcgaagtagtcctcgaagaaggcgagggcgtgctgggcgacctcgagagcaaaggccgtgagctgctccttaccgggcacgtgcacgacccggatggggacgtcgcggtggaagaccggctcggtcgcgacgaagcggccgatgaccatggcgagcaggtaggtggacatcgtcatcgtgggcgcaaaacgccaccggtcggtgccgggtgcgatcgtcgtgcgctcggtgacgggatagttcgagtaggcctcgaggtggctcgggatctcgagcgtgacggcgaaggtggccttggcgtcgggctcgtcgaagcaagggaaggccttgcgcgcaccggtggattcgaactgcgtcgtcgcgatgcgatgcgtcgtgccgtctgcgtcgcgataggtcgacaggtacagtccgtcgaggtcccgacgcagcgcacccgagaagtcgagatcgagcgcgaaggggccggctggcatgggcgcatccgcgtggagctcgaccacgccgtgctcgctgcgcgggcggggtgtgagggtgacgcgcgtcccggcgaacgtggcgatcgccgacgagatcgccagatcgaccgcgtgcacctcgagcaccgcggtgggctcgtggacgtcaccgtcgatgcgcacgtgacccgtgtaggggtcgacgtccgggtcgacctggagcgtgaggtcgtagtgtcgaggggtccagacccgcgaaagccggtacgggttgtgctctgtcacgggtgccacgctagctcggcccaggtccctgtgagacacgatgccaccggtaggctcgccgtgtggccagacgagacgtggtagcgctggggtcggcgatcgtggatctcggggtgcgggtgcgcgctcgggagatcgatcgtctcggccttgcacgcgggacgatgacgcttgccgaggccgaggacctcgatcgcctgatcgaggcggtcggtggtgaggtcgagatccgaggtgggggatcggccgcgaacacggccgtcgggctcgcttcgctcggggtcgacaccgccatggtgacccaggtgggcgacgacgacctcggggagcggtgggcaagcgaggtcgccgaggccggcgtcgaggtcgtgctcgtgccggcgccaccgggctcgcggaccgcacgctcgttgatcatggtcgacgaggggggagagcgcaccatggtgacctcgctcggggtcgcgagctcgctcgatgtcgacgagctccctctgcccctgctcgccgaggcccgctggtgcttcgtcgagggctacctgctcgatgcggccggcgacggactcttcgagcgcctcgatgtggtccggcgtctcggcggtcggatcgccctctcgctcggtgaccaactgctcgtcgaccgtcaccgcgatcggctcgtgcgggctctcggtcgcgtggtcgacgtcgtgctcggcaacggcgccgaggcggcccaactcgtgcgtcgccaggccctctcgaccatcgtcgaggagctccaggctcgcggcgtcgagggcgcactcacgctcggcgccgatggcgcggtcgtcttcagcgcggacgaggcgctccatcagcctgcgcccgagaccatcgcagacgtcgtcgacaccaccggtgcgggcgatcagttcgcggccggctaccttgccgcgctcgtccgcggtggcgacctctcgagccgagcgatgctcggcacgcacgtcgcgaccgccgtcgtgacgcacgagggcgcgcgtccacggcccgacaccccactcgccgcggctccggcgctcaccgaactcttggccgggctcggactgagtcgtgaggcggatcccgccttcgacgagcggtcgagcgatgagcctgtggcgggggagcgccacggcgagtgacgagccatcgggcccgcgcgggtgggccgtggacctcgtgtgcgtgcggtcaggtcgccctgcgtcgttcgtcggcgcgcggggggcccgccatggctcgggtacctcggcgcgcaggtgccggcagaagttgcgcgatggtcagggcgtcgggctgggtgagggaccaggagcagctgggctgcgacgattcgtgagccagacgagggtcgcgagtgcgacgccgaccccggcgaagagccaggtcagctcccgcgcgccgaggcgcgggaggaggagcgctgccgcgagacccgccgcggtccacccgatcgagtagctcgcatagaggacggagaaggcgctcgtgagttcgttgggcgcgaacatggtggggacgagtccgacgcggagcgcgttgatcggcgcgatggcgatgcctgcggcgacactggtcgcgagccagagccacgcggcaggcgccgagagcccccaggcagccagggccgctccaagaccgagcacgagcgctgcgagggtgctcacacgtgcgggccgatggctccagatgcgcgtgtagacgaccccgctcgcgaccgagccgacgctcatcgctgtgagtgcgacaccgccgagcgggctcgatcggagccagtgcacggcgagagggaccgcgagcaggaccgcacccccctcgagcacgccctcgagcgccgagagcacccagagccaggtgccacggcggagccggtgggggagggctcgctggtcgatgtgcggcctcgtgcggtagcgaagtgccccgacggtggcgacaaggccggcgagtgcgacgaggtcgaggaggagcggacggaggccgacgacgacgaggacgctggcgacgaggggcgccccgagccacgtgagctcctgggccaccgagtcgatggcgaaggcgcgcccgcggtcggaaggatcgaggcgatcggtgaggttgcggcgcagctcgcccgtgacgagggtcgctgcggcaccgacgccgaacgcgccgacggcaccgagggcgagtggggcaccgacggtgacggcagcgagcagcgcggcggcgcaggtcatgaggccgaggcggctggggagcgacgcggcagcgacgaaggggacggcgagcagggcgagcgcgccgacctcgccgagggggacgagtgccgcgaggccgctcgcggtggcgtagccaaggcgcgcaccgacgacgtaggtgatcgcgatggggacgaggaagttcgcgacgcgatagggggtggcgagcgcgagccatcgagcgagcgcgcgaccgggcggcgcgctgcgttcgaccatgggagtcaccctaccggcgagcgcacgacgaggtgggcagggcagcgctcgtgtgattggatggtaggcgtggcacttccactcgaacagtacggcttcgtcggcgatctgcacaccggcgcgatgatcggtgcggagggcagcgtggcgtggctgtgcgtgcctcgcttcgacgccgatgcgtgcttcgcgtcgctcctcggcgacgagtcgaacggcacgtttcgcatcgctccgtcgggcccgttcgagtcgacgcagacctacgtcgaggacacgctggtcctcgagacgacctttgcgacccggactggtcgtgccaaggtcatcgacttcatgccgatccgagagcgccatgcacggctcgtgcgcatcgtcgaggggatctcgggcgaggtttcgatggaggtgaccctgacgctgcgcttcgactacgggcgctccattccgtgggtgcggcgcgtcgcgcgtggccactcgttcgtcgtggggccgatcgcggccctgctcgagaccccggtcgagctcgagggtcgcaatcagcgcacggtcggttcgttcgtggtgcacgagggcgagcgggtcccgttcgtgctcagtttccacgactccgtcctccccccgcccaggcggatcgacccccagctcgagttggccggcgtcgtcgagtggtggcggcgctgggtcgccacttcccaggtgcgcttcggtcgctacgagccccttgcgcgacggagcctgatcaccttgaaagcactcacctacgccccgacgggtggcatggtggccgcgctcaccacctcgctccccgaggaccccggtggttcgcgcaactgggactatcgcttctgctggctgcgtgacgccgcgttcgccgtggaggcgttcctcgcgcgcggcatgctcgacgaggcccgcgcgtggcggggttggctgttgcgcgccatcgcgggggacgcgcgtcagatccagatcctctacggggttgggggtgagcgcaggatccccgagctcgaactcgagtggctgcccggctacgaggggtcgcggccggtgagggtgggcaacggcgccgcgggtcagttccagatggacgtctacggcgaggttgccgacgtgttgtggcggatggtgcgagctggcatccgtcccgacgagaacgcatgggagatccagcgctacctgacggacttcgtcgtgtcctcctggcgtgagcccgacgacgggatctgggagatccggggcgagcgccagcacttcacccactcgaagatcatggcctgggtggcgatcgatcggggcgtcaaggtcgccgaggcgatgggcgtcgaggcgccctcggcctggcacgcggcccgcgctcaggtgcacgccgccgtgctcgaggaagggtggaacgagtcggtcggtgcgttcacccaggccttcgggtcgacgcggctggacgcggccgtgctgctcgccccactcgtcgggttcatcgaccccgacgatccgcgggctcggcgcacggccaagaccatcgcccgatccctcacgaagggcgggttcgtccagcgctacgagccgaccgccggtgtcgatggcatcggcgagcccgagggtgcctttctgccctgcaccttctggctggtgcagaacctcgccctccagggcgaagtcgacgaggccgaggtctacttcgagcgtgcgagccgggcggccaatgcgctcggcatcttctcggaggagtacgagccgacggagcgacgcatgctcggcaacttcgcccaagcgttcacgcacgtcgccatgttgcacgccgcccacgcgctcgagcgtgctcgcgaggcccgtcgcgacggtgagcgtgagcgccagggggcctagcctcagttctggagatggtcgagcaacgggaaggactggccgatgacgcagaggattccgttcgtgctcttcggggcgaccggcgacttggctcgccgcatgctgttgccggcgctcatgtcggtgcgagagcgccatgcagactaccagttggacatcatcggcgtcgcgggtagtcgtttcgacgacgagagcttccgtgcgcacgtggtggagatcctcaccaaggacaagcgctgctcccgcgaggaggccgagaccttcgcgaagaccatcagctacctctcgggcgactaccacgacccgaacctcttcgacgcactggccgctcgggtctcgcccgacgagcgtcctatcgtctacttggccatccctccctcgctcttcgaggtcgtgatcgaacagctcgcgcgcgccggcttcgacgagcacgctcggatcatggtcgagaagccgttcggccgtaacctcgccgacgcccagcgcctgtcgaaggtgctcgcaagccacttccgacccgagcagatcttccgcatcgaccacttcctcggcaaggaggcggtgcagaacctcttggtgttccgcttcgcgaactcgatcctcgagccgctgtggaatcggaactacgtctcgcggatcgagctcaacatgctcgaggcgttcggcgtcgaggggcgcggcgccttctacgacggcgtcggcgtggtgcgcgacgtcgtgcagaaccatctgctccagctgctcacgctgctgctcatggagcccccgctcgcgatgagcgggcgcgacctcaccgaccagcgcacgaaggtgctccaggccatccgtccgatccggcccgacgacgcggtgcttgcccagtaccgtggctatcggctcgaggccggggtggccgacgactcgtccacgcccacgtacgcggcaatccgcctcgaggtgaactcctggcgctgggcaggggtgccggtgttcgtgcgtgcgggcaaggggttgcgcgagacccgcaccgaggcggtcgttgagttccggcgcccgccgacgctgatcttcggcaccggggaaggggagcagcaccagcccgagccgaacgcgttcatcttccacttcaagcccgacgggcgcatcgagctcttgatgcagtcgaaggtgcccggtcctcggctgatctcgagaccgacgatgctcacggtgtcctcctcggacgactcggcgcgctccgacgacgcctacgcccagctcatcgacgacgtggtgcgcgacgatcagacgcgctttgcgacccaggagtcggtggaggctggatggcggatcgtcgatcccgtgctcgaggcgccggccgagtcgacctacgtcgtcggcagtgatggaccgcgcgaggccgatcgcctcgtcgccgacgtgcatgggtggtatcgatgacggcgcaggtggcgagatgggggtccgacgatgagtgacgagatcctcgcggtcgatctcggcgggacgaactttcgcatggccaaggtgagcagcgagggcgtgctgctcgctcgggccgagatcccgacggcgtcgatcaccgacgtcgtggacggcctcggtcggctcgtcgaccaggtcgacggtggcggggtcgcaacgctcgtgttcgcggcccctggcgtcgtcgaccgtgacgcgggcacggtcgtcttctgcgggaacctcgatgacgccgtgcggcgcaccatcgtcgcgagccggatcgccgatgcgctcgccaagcgcgtcgtcctcgtcaacgacgccgatgcggccgccatcggtgaggcgtgggcgggagccgggcgcggcgctcgaacggtcgtgtacgtgaccgtctcgaccgggatcggtgcgggtctcgtccaccgcggcacgctctacgtcgggcgcttcacgggcatggaggccggtcagatccgtctcggcctcgaagacgtcgatcgcgccgagcacgtcggttcggggaccgcgctcgctcgtaccgcccgccagctcgggctcgagctcgccaaccccgaggtcgtgcgccgcgcgcaccaggagggtgtcgcgcgcctcgcgctcacccgcacgatggaggcgctcggggtcacgctcgccaacctcgcctggctcctcgtgcccgatcgcatcgtcatcgggggcgggctcggcctgtcggatccgctggtcctcgagctcgccacgcaggcgttccaccgcgccggcccggcgttcctcgaggatctctccatcgtcccggccgcgctcggcgacgacgccggactcatcggggcggcgttcgcggagcgggcgctccaaggcgcccagtgaggttctcgctccagtcgacgcgctcgctcgcagcgctcgctggggcgagcatcctggtcggtgcgtacgatcaggcagcgatcggggtcgccctcggtccgctgcgacgcagctggcacctctcgagctccgaggtggcgctcatcgcctcggcatcggctgcggggatggtggtgggtggcctcgtggccgggttcctcgccgatcgctgcgggcgtcgtcgcctgctcgtcgtcgacgtcgcgctgctcgcgctcgcgagtctcgccgctgcgttcgcacctggggcgggtgtcctcctcgctgcgcgcttcgtcggtggggtcgccgtcggggcgagctacacgatcgtcttcgtctaccagcgcgagctcacgagcgccgcgatgagcacgcgttggatggcgaccacgctctgggcggccaactggggcatgcttcttgcctacggcgtcggcgccgtcgcaggtggcaccacgttgggtgcgcgcatcgtcctcggcgtcggtgcgctcggcgcccttccgctcgttgcggcccgacgtcggctcccggagacccggacgacggatgggcacctctcgctccgcgcgagcctcgcagccctccgttcggtgcgagagctcgaggccgcgggggcgtggttcctctatcagatctctgaccagggcatcaacgtgctgctccccatcgtcgtcgccagcctcggcgtggtgtcgctgcggagcgccgatgcgacggcgctcgtcgtgaaagccgtgaccatccctgcgtcgctgacgacgatctggctggtgggttggctcgggcggcggcgtctccagttggctgggttcctcggccgagcgctcgccctcgggctcgtcgcggtcgccttcgccctgggcgctcctctcgtcgtgaccgtgatcctgctcgcggttggtcttgcggcaggctccatgggccccgacaagacgacggtgatgggggcctgtctcgaggacgagccgatggcgctcgcgacgcgccagggcgtcgcacagaccgcaggtcgcctcggtggcatcgtgggaccggcggcgttcgtgctgctgaccagcgtcggtggcccggcacccgggatcgccctgttcgcgctcagcgcgctcgcgggctgggccatcaccctcccgatgacggcgtgagctggtcggtcggctagctcgcggcttctcggggcgcgtcgcccaccagcacgtcggtcgcgacctcgggagcgacgacgttgatgggcacgccggtgccgagctcgaagcctgcacgggtggtgagcttcggatagacgtgggcgtgccagtggaactgcccgaaggcgcgatagggcgatgagtggaacaccacgttgtaggcgacgggcccaaggcgcgtccggaggcgtgcgaggccgtcgcggaccatctcgccgacggcgaacaaggtctcctgggcagcgaggtggaggtgggctccgtggtgacggggcacgatgagcagctcgaacggcgtcgccgaccagtagggcgcgatcacgaccgcgtgttcggttccgagcacgaggcgctcaccgatgctctcttcgagtgccaccgtgttgcagagcagacatcccccgacgaagcgcgcaaaacccgcctgctcgtcggagagctcgcgtgggacgaaggagatgccgaggagctgtgcgtgggggtgggccatggaggcgccggcgtcacgcccttggttgacgatcacctgggagtagcggatggcagccgagtgtgagtgcgcctcgatccgatctcggatggccgacatgaccacgtgcgtctgctcgtcgtcgagcgctgcccagctcgcgtcgtggtcgggggtgagcacgaggacctcgtgaatgccgctcgcgggtgcgctcgtgaagaccggtccgtgggtcgtcgagaccatgggctcgtcaccctcgaaggcgggatagaggttcgggacgacccgtacgctccacgagccgctcggcccgtaggtctcgagggcgggaggggtgtcttcctcgttgcccgggcagaaggggcaaggacgcgagtcgtcctcagggccgtgctcgtcggagagggcgagggcctttggacgccagcgacgctgctctgcgacgacgacccagcgaccggtgagtggatcgaggcgcagctgatgcgtggccatgggctccctctgctgagaacggacttatcgcccccagcgtagcgcgtcggcggttgctcgggcgggcccgccggtcgctggcgctcgtcgtggttgggtgtcgcctcgtagactcgctcccatggcggtctacctcgaccacgccgcgaccacgcggatcgcgcccgaggtcagggcgctcatggttgagctgctccgcgtcgagggcaaccctgcggccgcacacgcctgcgggagggccgcgaaggccattctcgagcgggcacgggtcgaggcggccgacgcgctcggcgtctcgtctcgtgaggtcgtcttcacgggttcggcgaccgaggcgctcgacatcgggatcggcgatctcgacctcgcgcccgacgtcgtcgtggccacgagtccgatcgagcaccccgccgtgctcgatgcgctcgcggggcggcccatcgtcgagcttcccctcgacggcgaggggcgagtggccatcgggtcggcgcgcgagatcctccgcgacctcggcccacggctcggagcgctcgtcgtgaccggggctgcgagcgagaccggcgtcattcagcctgtcggtcggctcgcccacatcgcacgcagcgtcgctgcgaaggcggtcgtcgtgagcgacctcgtggcgctcgcaccgctcgggctcgacgcgggctctccggctcgtcggatgctggaggtcgtcgacgtcgcggtggtcgcgccgcacaagctcggcggtccgacgggggtcggagtcctcgtggtgcgggagggaacgccgctcgcgccgcggcgtcgctacgtgggccaggagcgcggcctgcgcggtgggacacaagcggtgtggctggcggggggtgcggcacgcgccctcagccttgcggctgcccagggcgcgtcacggcgcgaggccatcgtcgcgcgacgtgaacggctcgagcaagcgctcgtggaggcggttcccgctgccaaggtggcaggcgcgggtgctgcgcgtgtcgggatcagcctggtggccgtccctggggctcgctcggaggaactcgcggtgctcctcgacaccgaaggcgtgtgcgtgtcggtgggggcggcctgtcgagcgggtgctcccgagccatccccctcgctgctggcgatggggtgggacgagcccgaggcgcgatcggtcgtacggctgagcgtcgcgccggagacgaccgacgacgacgtcgtcgcggcggcgatggcgctcgcgcgtatcgcggagctcctcggggccgccgggtgatcggtcttctgtcggccacgggtccgatcgcgacggtgctcatccttgcccatgtcggcgtcgggatcgtgggctatggtaccaatgcgctggccggctgggacgcaagcgaggtcctgcgcggtcggacggaggggcggcggtttctcgacgggagcgtcgcgccatcgcagctcgccatgctctgggttccgatcctcggggcgctgctcgtggcactcgtcgatccagaggcccttggcacggcgtggttcctcgtcgcgttcggtgcgtggtgtgtgagtgtcgcgctcgtgctcgcggtggcgtggccggcccagcgagaactcgggcgcttgctcgctgcgacgtcggccgtacccgaggcgctgcgcagaccagctcgacggatgctgcgtgcgcagcagctcatcgtggtctgctacgtcatcgcgttctggttgatggtgctgaagccagggaatcggtaacgatctgcgtcgtacgagcgtgatcgattggggtggtggcctggatcgcaaggatgccgatcatggatcggactgatcgccgggtgcgcgatgcgacgggccttctcccagccagtgtgacgcctgctaccggaggagagaattgacatgacgccgagctcgcccgtcgcgtctctgccgcgcggcgccgacgaggacgccaccttaaggcaggtccgacgaacgtaccctcgctggtgctcgaccagcggcgcaggtgtgttggcgtcggctgtgacctcggcgcgagcgacgcgactttggcaactcgggtgggccgggaacgcatcgatcgacgtgagcaagcccaggagcgcgcgcgtccacgcggcgacgccgccgaggagtggctggccgcatgagcatctgctcccaccgcgaatcgagagacctgtgccacacacatggtcatagcagacaggcgatgctcttggcgactcgccagaaggtgtcgcagccggcatcggtcccggttggggtcgcaagaagacaagcctgtcatgagccacatccacgacacgccctcatcggtggacgtgcttgcgatcaagccaccgcagcgggccgggatcactggcggcatcggtccccaggcggacaggtcccaggcattgcaccccgacggggtcactcggttcatgcgtctcaccgggaaccagacgacgacattgatcgatcctgccagcaggcccgaggccagccaaggacgatacgtacaggtggttcagtccgctcccacgacactctcgtgccaacgtactcggctgtgtgcgagggatggggcatcacgtcagcagggagggaactgtcgactgcacctcggtcgaatgcagggaccgagaacaccgcccaggcacggtgtgcctgggcggtgtggagtgggggatcagtggtctagtacagccgtgcgagggttgaggccggctccagatacaccgtcttcaagttgccgctcggggtgaactgcaccacctcgaaggaggagaagacgttgtggtactggttgaagttctcgttgccactcgcgccctcgtagttgatcttcttgccctctttgaggagtgttgcgcagctggtgtagctgtagcacttgatcccaggagggttcgagaccttggtgatgtagggccgccacaccgtgggattggacgagtgggctgcatccatggcgagtgccgcgataatcaccgcgtcgtacattgccggggaggccggcaggggctggttggtgtgccacaccgcctcgtaggccgacaggaaggccttgttcgactgggcgtatcccggaggcgccgccatgccggtcagccatcgagacgcattggagagtcccatcgcctgagccatctgcagtgacgcacccgtgtcgcccgtgatgtaggggatgttgagatgccccagctgtttgacgttggcgaagaaggtgctcgctgtctgcggatccatgtggaagaacacgcatcccggctgtgcacctgagaacatcttggccacgaccgacaggtaggagctctggcccgccacgatcgtctcggaagcgacgatcttgccaccgagcttctcgtacgcacgggtcactggtccaacctcggcttgcgcgttcggcccggagtcgtacacttctgccgcctgggtgcagtgcttggccgtgtaggcgtagtaggcctcgcccgacaggagctcagagtctgacgggaacactcgatagacgtatgggtagcgcatgtagtcgagctgcgtcgtgccgccttccatgagatcgaccacgtggtcaggaccgaagtcccggatcacgccctcgatctcgagcgaggacggtccaaagaccacgaccggcttcttgagcagcaacgtccggagcgccgtgactgcgtccacagggtcccccgcagtgtcctcgagctgtgaggtgatcttcgcgccgagtacgccgccaccgtggttgaccgcgtagatgcccgcgagcacgccgtggtcgaaccattgtccgacgaacgcctccttgccgctcatcggcagaaggatgccggcttgaatcggtccggtcagcttgccagaggagctcgccgagctggccgacgagctcgacccgcatgctgcgagcgccagagatccgagcgcagcaagccccgccgccatgccacgggtccgccaccggcgagtcccctgtcggttccgttgcatctatccttcccccttcgttgtcactcgtgatcttgggaatcacgatcccaggaagaggcgaccgccgcctcctccgccccccccgattggccgaggaagattgctgccatgtcgagctttgcgagctctgccggcgccccgtcacgaagattgcgtccggcgacgaggatgtagacccagtccgcagaggcaagcgcccgctcgacgttctgctccacgacgaccacggtcgtcccgagggcggccacctgggcgatctgcgaccagacaacgtccacgttcgccggtgagagaccggcagtgggctcgtccaggagcaccaccttcgggttgctcatgagcgcacggcccatgccgagcatgttgcgctggccaccggacagcagacccgccttgcgcttgcgggccagcgccaaggcggggaagatctcgaagaccagctccttgcgggcgtcgagcgaacctcgctcgacgaatcctccgagctcgaggttttcctcgacgctcatcgaggcaaagacgttgtccacctgagggacatacgccatgccagctcgggcagcgtgatgggcactgagatccgtgatgtcggtttcgtcgagatacaccttgccggccatgcgcggaatcagtccgaaggtggccttcagcgccgtcgacttgcctgccccgttggggccgatcagggtgacgacctgggagaccgacgcgtggaagctaatcccgtcgacgatcggcgccttgccgtagccagcggtaagtccctcaacgcgcagcacgtgcatcgctggctcctcccgtcaagtacgcattcacgacggcctcgttctcgcgcagctcggccatggtcccggttgcgagtgcgcagccagctgccatcaccacgacgtggtcggtgatccgctcaaccacatcgaggttgtgttcgacgatgagaaaggtcacgcccagcgaagagcggatctcgttgatgtgttcgcagatgcggtcgaccagcgcggggttgatccccgccatgggctcatccaagatcagcatcttcggctcggccatgacggcacgagccagctcgagcagacgcttctggccaccagagaggctgccagcgtactcatcgcgcatgtgctccaacccgaaggccgcgaggatccctcgggcgcgtgcaaccagctccagctcctgctgtcgatagcgccgaggtgcgaagagcgcggtcatgagaccctcgcccacctgacggagcggggacaccatgaggttttccatcacggtcatcgccggatactcccgtgagatctggaaggttcggatgagaccgagctcggcaaccttgtggggcgcgagtccagtgatgtcgtgcccgtcgaagttgatcgtgccggcgtcggggcgcagcgctcctgcgatgaggttgaccatcgtcgacttgcctgccccgttcgggccgatcaagccggtgatcgatccgtccgcaacggtgaagctgcagccatcgaccgcatggacacccccaaaggcgcggaccacaccgtcgaccaccaggatcgggtcagtcgtcgacatcgacggcacctccagccacgggaatcggatcgggcagacctacgagcttgactggctccgggaagcgcgctttgcgctctgggacaacgccttgcggacggaaccacaagacgaggatgacgagtgcaccgatgcacatgttgcggatctctgggatcaggttcggcatcgaggagatcgctggcaagaatcgagtggcctcattgaagagcaccgcaaccaggaacgatcccacgaccgcaccagtgttgttgccacgacctccaacgatcagggcggcccagatgacgaaggtctcactcgtgccccagcctgccggggccagcgccgtcacgtaccagatggtgaggacgcccccgatcccgacgaagacgcaccccagcaccatcgcgatcatgcgcactcggtaggtgtgcttgccgaaggcctcggctacgtcgaggtcctcgcggatggcccgcatcgtgcgaccgagcggcgatcgatagaggcgattggcaagcagccagcagatagccatgaccacagccgagaaggcgagaaagaccagggaataggagttcggtccgagctggagcacgccgttgaagggttgcggcaccccgaccagtccctcgaacccatcaaagatcttggtgttgttcccaacgagcccatagatgatcgagccggcggcgagcgtgacgattgcgaggtagtcgctgcgcagccgccggagcgccacaagcccgatcaggtagccaagcaatcccgctgacgccgccccgatcagcatcgagattggccatgggagcccaaggccaaggatgtagtagatccccgagctcggcacctcgtgggtcagcgacgcgacccccgccatgtaaccgccgatcgccatgaaggtgatgacggtgaagttcaggatccctgcgtagccgaactgaatgttcaagccgagcgcgaagatgttgtagatacagaagtacaccccgagagtggccgcataccccacgatgacgcccatgatgtgcctcctaagcctttccagcggtcgcgaagatcccctgcggccgaatgagcagtgtcaagaccagcaccaagaaggcgacgtccaggctgtaggcagcagagatcacgagcgtcgagaggctgatggcgagcccgatcacgagtgcgcccaccatggcgccgtagatcttgccgataccgccgaggatgaccgcggcgaagatcacgaacaggaaggtgttgccggtgaaggcttgaaactcgaccgtgttgagtgcgagcgtgatgccccccagtcctgcgagcgcaccactcaggaaccatgtccagcgtgtggtgcggcgcgtgtcaatgccgctcgcggcggcgagcggcgcgttgtccgacatcgcccgcatcgccatgccgagtcgcgtgcgcgtcagcagcaggtggaccccgaccatcaccacggcggcgacgatgacgaccccgatctgggcggcggtcaagctgaaaggaccgaggtgcaggggattgcctgctgcgatggggtagcgatcgaacccaaccccccagattgcctgcaccaggttcagtaggatgagcgagaggccgaacgtcacgatcaagaggaagaagccactcgtgcctcgacggacgaaaggctcgagcacggcgacatcgaccgccacagccgcaagcccactggcgatcaccccgaccaagccgccgagccagaagggcaagtgcaggccgaccgacgcagtgtaggtcacgaacattcccactgcgagataggctccgtaggcaaagttgacgtagttcgtgactccgaactgcaagctgaggcctaccgcagcgagcgccagcaccgccgaagtcacgatcccaaagcccagggtcagtaagaacaggctcattctcccccctctcgttggcctctcgtcttagtgccgcttgcaccgcgtgcgggagtttggccaccaagatgcagtttcgtgcgaatcgtgcactttggctcgtttcgctcaccgcgcctcacccctgggagctcgcgggtccacgcagcgaccgtgtccgtgccgtggcgacgcgtgctgggggagggacatgaacagtgcatgctgactcgcccctggtgacggcccgccaagtgccggcgaggcgccccaccggaccggacaattccatcgcgtcgcttcggcccaggtcctcgatcggcaccgcacgatcaggaggtcgttcgcgagcgcgacgtgaacgagccggtgcttgccagccggaccaccctctgttgcagtcgtacgtgaggccacgtcgctggtcgtgtcgctgcacggagagggtggttgacgattgagaccccggccaccatgacgcccgagcgcatgccaagtcggcacgggaccagagccatacccgatatgcccggaccaagggttctcgagcgaacccgaaggacgagatgctgctctgcattcgtgggctcgggcaggccagcgatcggggcgtcaagtcgttggccgatgctgttcagcacccctgtactcgggcctttgccgagcgtgacagcctctcgaagcgagggggagagcttcggtccgccaaacgggtcgcgggtccttccgcgtcagcgagtggcgttgccgcgtgagcgtggtcaagacggcgcgcggtcgtgcccgctagggtcctcgtcgctctgtgcagccggaggtcgcgcgtctcgagtgctgccctgttgggtgaggccgaccgcatcaaggctcgcaaggccaccgcgttgcagaagacgtcgccgtagacctggagcgaccgatcgtcgccgacgctggcgatcacgaggcatgaggtggccccgacgcgtgcggtcgtcgtgcgccgaggagcacacagcgcgtcgtctccggggccacggtcgtcttggggaagcgagacggcagctcgacactgcgccgatgtcgagcgcgcggaagaaggtacggtaacgtgttcgcgctcttcgggtgttgtgtcgaccagcaacgcccatcgtcggcatgaggttgagccgcggacctaccactcagcgaaccgcggccgtgatcgccgagatcgggcctgcgcgagggcggacagcgacttgcgatggaccggtgcgttgcccaggggggagtggccgaggatcggcgtgcgacggtgtccgatcccatcccaaagcctgccaccggccgagcaggagagggccgtccggagctgcgggccgaggtgattggtcttccccgcagaccgaagcatgcagggccagcatcgtgccctgcctgaagtcggtctgcactggctgagagacctggtgagctgcgacgaccgaacccgggagagcctcgtcttgccggttccgctcgtcgctcgccatgggctcgtcgctcgtgcgattacgtggatgaggttggtggcgatggtgatgcaacctcgtgtttcggttgggactcgagtccaaccgaccctgacgtggcgagccggtgcgggtgctaacgaggccatcggtagcgatgctcaggtcgcccgattccgtagcggagcacgagctcgatccgtcccatgcgcgcgaggtgtgagaggtagcgttgcgcggtggcccgagagactccggagcgggctgcgacttcctcggccgagagctcctccgtcgcgccgcgcagcgtctcgacgatgaccccgagcgtctcacgcgattgccccttgggcagcgaacgttcgacgctcgttcgcagcgtggtatagatctcgtccaccttgtcctgactggcctcctcaagggcgtcgagcttcttccgcatggcggcataagcctcgaggcgctccatcaggatcgagggtgcgaagggcttcaccaggtagtagagggctcctgagcgcacagactcggcgacactcgcaacatctcgtgcggcggtaatcaccatgacgtcgatgggtcgccctgcgatgcgcccgagtgccttgagcacttcgagccccgagacatcggggagatagagatcgagcaacacgaggtctggatggtgctcctcggcggcagccagcgcgtgcgctccggtgtgggactctgccacgacctcgaagcccgatacacgctcgacaaaggccctgtgcagcgcggcgacccggaagtcgtcgtccaccacgaggattcgatacctcatgagtgctgcgtgtcagagaaggctgggatgtgttgacgcaggatcccaggcaatcgaacgacaaacactgcgccaacctctcgcagcacctcgatcgaccctccatagcgctccacgagttgcctgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcagccgtacgagggcgaggccaagcccccggcgtgtcccactgcgcgtgagcttggtgctgaagccgtcgagaaagatctctgaggcgatgtgggctgggacccttggacctgagtcggcgacgatcatggtgagcgcatctcccatggcgagaaagctcgcctcgatccaggcgttgggagtatctgcagctgcatcgatcgcattgtcgatcaggttgccgagcagtgtgacgagatcgctcgcgggcatgcactcgggcggcacgcggtcggaaggtccgaggcgtagctcgacgtgacgctcggcagccactgcactcttcgccaacaggagcgccacgatgacgggattgcccacctcgcgggccaggcgatccatgagcgcggtgtcacgaagtgcgatgtcggtggcgaatcggatggcctcatcggtctctcccagttcgatgaggccgacgacggtgtggatccggttggagaagtcgtgcgcctgtgctcgaagcgcgtcggtgagtccgagcatgccgtcgagctcgcgcagcagtgcctcggactcggtgcggtccacgagcgtgacgacatagccgagtaggcgcccttgcacctcgacggctcgacgattggcgatcaggattcgatcctcgtggacgacgagcaggtccttgcccacgacctcgcccgtcagaatgccttggagtcgaccatctggcaccagcacgccgacagggcgctcgaggaaccttactggaaggtgtaggaggcggcgggcctcctcgttggcgaactggaaccttccctcgggatcgatccccgcaaccgcctcccggatgccgtggaaaatcgcgtcctgttcctggatgagtttggtcagctcgtcgagctcgaggccaaaggtgcgatcgcgaagccatcggctcgccagccacgatcctgctgcaccgatggccagtgccacggtgagcgcttcgagcgcacgcactgcggatccggtgatgagggcaagtgggttaggcgccgagaactcgacgacgactccgagaccagccgagtgcgagatcggggctcgcgcagcgacgggtccggaaccgccgttgaggacgccactccagacgtttcgtccgtcgagctcggcgacgagctgaccacgagtgagtgatccactccccgcctcgacgagaccatggcgattcacgactgccacggcgagcgcgccaatggccctgcgcgactgtgtgaggagggcttgtcggttctccgttccggactcgagggtggcgatatctgggttcgcagcgacgctctgtgccgcaaggagcgcctgatgtgtgtcggatccgagcccagtcgggacctcgagcgtcacccacgcgatcgctgcaatgacgctcaccagaatgatcccggcctggatggccagcatgcgagaggcgagcttcgcgccccgcctacctctcgagaccgacggatcgtcacgcatgtgtaccccaccacaacacgccgcacggtctgcattgacctgcccttgagtgtacggtggtcgcttgtgcccgcgcaagtgagacgaagtgaaccgagcctcctcgaagtcgcgcggtcgctcgtggcgcagcggccagcgcgtgtgtaggcaccgggcgttaactgaccctagaacaccggaacgatagtgacccaccctccagagtaggttgccctcgagaatcaagaagggggcagcccgatgctgaagggcaggatgctcctatgtctgtcaagtggcgagcgcgctcagcccttcgagccactggcgatactggatggccaactcgtcgtgacgcgtgaggccgccctcgagccgcgataggcgccccacggtcgttgacagggcagctgcagccgcttggagcacgacgcccaagggagtgccgtagctcgcgaagttccgtgccggtgatgacgggcgcggggttcgtgaggaggccaaagatctcccgggcgatggagcgcttcaggcagcgcatgatctctcgatcactcttgccttcctggcgtcgccgctcgaggtagcgcatggtcgggccgtgacggtgggcgaggcggaccatcgcgatgcgccagagcgcgttgttcgcctcacggttgccaccccggttcaggcgatgtcgtacgaccttgcccgaggaagctgcgatggggctcaccccggcgagcgcagcgaaggaggcctcgctccggaggcgctcggggttgtcgcccgctgccacgacgagggctgaggcgacctcgggcccgacacccggagctgcgacgagtgcagggttcacctccgagcacaggcgagcgatcgcgtggtccagctcggcgatctctcgctccagggcctggtggcgcctcgccagcgtcacgagcgccagcgtcgttgcggcaccagtcgcaagtgcccacagcgtcgccccaggctgccacacgctccacctggcgagcacgacgaagcctcgtgagttcctcacgctgctcatcggccaaggtgacgatcaggtcgcggagctggttgccagcttcgggtgcgtgctcggatcgcagagcgacgcgcgacgccaagtgggcttccccccatttgcttgacagtctgaatttaggccacggccgcctcctcccgggcccaggtgagctcgtactcgattggcggtcggtacccgaggctcgagtgcagccggacggtgttgtagcgatggatccaggctgcgatggctgagcgggcctcggcgaggttcgcgaagcggtagcgagccaccagctcgcgcttcaaactcccgaagaaggactcggccacggcgttgtcgtagcaagtagtcaccctgcccaccgactggcgaacgccgagggtcgcgagcaggctccgaaccttccgggagaggtactgtccggattcaaccggtcgtcgcaacacctgttgctccatctgagcctaggagtgcctccagcgcttctgctggggtccgccagccgagtgtcttgcgaggccgctggcccgagcgcgaaggcgaccgcgtcgaggtcgtgctcactccagcgggacaggtcggtgcccttcgggaagtactggcgcaggagtccgttggtgttctcgttcgtcccgcgcatccatggcgagtgagggtcggcgaagtagatggcgagtcccgtgtcgatgcgcagctggacgtgctgggccatctccgtgccgcgatcccacgtgagcgatcggcgcaggtgctcggggagggtggtgatcttggcagcgatcgcagtgcggactgcctcggcaccgtggccggcaaggggtggtccgtgcttcgcgcgcgcctcaccgtcgtggccctccatgggcggtaggtggagcagcatcacggagcgggtggtgcgctcgaggcgcgtgccgatcgccgaacggtgcagcccgatgatgaggtctccctcccagtgcccgggcaccgcacggtcctcggcctcggcgggccgctgcgagatcagcacctccggggtgatgaagccctggcctcgtccgtgagcccgtgctcgtgggacccgaagggctcgtccggtcctcaaggcaggtcacgagttcgcgcctgagcaccccgcgcccctggacgaagagtgcctggtagatggcctcgtgactgatacgcatcatcgtatcgttcgggaagtcgatcgggaggcgcttggcgatctcgtcggggctccaggcccgtgcccacctgcgatcctgactgcggccgtggcgacgacccgtgaacctgacggtgggaccgtctgcggtcgtgccatcgggatgggcgatgcgaccagcgaggcgatcctccacgtaggcacggagctcctcgttgcgaacgagcttggccaccttcgggcgcttggcggcgagcttgcgccttccactgggcaacgaccgcccggtactcgagcgtgccacccctcgtggctgcgttgcgacggagctcacgcgagatggtcgaggggtgacgcccgagctgacgagcgacgcttcgaccccagccccttttcgctcgtgcgagcgcgatctcctcgcgctcgctgagagcgagagggagcggcccgagggctcgcccagcgtgcatggtggcaccccaccagcatggctgaaccagcgcgcaccgaccgccaccgacacgcccacgcgctcgcaggcgtccgcggtcgagatccccgtggcgatgagctgccagaaggcccgctggagcacccgtggtgggtctggccgccctggggagcgcatcggcggccgcagggcacgatcggccgcccactgtcgcctcgctcccggaggagcctggttcctgtttcgttgcacgtgctcctccgtcaccgggggtgttgcaacgaccggttgaacccggacagtagctctcccggaaggttcggagcctgctcgcgaccctcggcgttcgccagtcggtgggcagggtggctacttgctacgacaacgccgtcgccgaggccttcttcggaagtttgaagcgcgagctggtggctcgctaccgctgcgtgaacctcgccgaggcccgcgtcgccatcacagcctggatccactgctacaacaccgtccggctgcactcgagcctcgggtaccgaccgccaatcgagtacgagctcacctgggcccgcgaggaggcggccgtggcctaaattcagactgtcaagcaaatggggggaagcccaggcctcctggcgggagatccagtggtagcggctcactgtcccccctccttcacccagaaggccatcgctcgcttgagcagctcacgttccatggtgagctgcttgacctgccgacgcagccgggtcagctcctcgcgctcggcgctggtcaggccttctcgctcacctcggtcgaatggaggagccccgaagcgaccagctcatcgatgctgccgccgtactcgaacattgggttgagactcagccaaggttccggccaaagcgttccctcgctgagggcttcttgcaccctggaacggattcgctcatcgcgaatatcaacgaagctctcgacgaatgatctgaactcgcgaacgacggtgtctcgaaggtcgaagacgtccattgccgtcctctagagctccgacgtcagggtcacaagttgatgcgaaccattctccactacagtgggcttccccccatttgcttgacagtctgaatttaggccacggccacctcccggcaggcccaggagagctcgtactcgacgggcggtaggtacccgaggcttgagtgcaggcggaccgtgttgtaacggtgaatccagctagcgatggcagagcgagcccctgagaggttcgcgaagcggtagcgagccaccagctcgcgcttcaagctcccgaagaaggactcggccacggcgttgtcgtagcaggtcgcgaccctccccaccgactggcgaatgccaagggtcgcgagcaggctccgtaccttccgggagaggtactggctgccgcgatcgctgtgaaagatcgccccagccaggctgccccgagtcccgagtgcttcgcggatcgcctcgaccaccaggtcatcgggcatgtgacgcccaagtgaccagcccacgatgcgcctcgagccaagatctgccaccgtggcgagatagcagaacccctcatcggtgcggacgtaggtgatgtcgctcacatacctgcgcttcggctcaccaggagcgaagtcctgacggacgaggtccgggagcgctgcgtcctctccccgcctcgtcgtgactacgaagcgccggcgtgggcccgctgccatctcgagctcgcgcatcaggcgttccacccgcttgtggttcacgcagaacccgcgccgtcgcagctcgtgggtgatgcgggggctgccgtaggtgccgtcgctctcgtgccagatggcgcgaagctcgctcgcgagcaccaggtgctcgggatcctcgcctcggtcccgacggtgtcgccaggcgtagtaggcctggcgagagaccccgatgactcgtgctgctgccgctacagagaagcccttggcctcctggcgggagatccagtggtagcggctcactgtcccccctccttcacccagaaggccatcgctcgcttgagcagctcgcgttccacggtgagctgcttgacctggcggcgcagccgtgtcagctcctcgcgctcggcgctcgtcaggccctctcgctcacctcggtcgatgcgttcctgacggacccagttaccaagggtctgctcgttgatgccaagctcacgggcgacgtcagcgatggtgcggcgctggtcgagaaccaacgctgccgcgtccttgcggaactggctcgggtagcggccgcgtcgtcgtccagcggggccgtcgcccggtggtgggttcggtgtctggctcatcccttcctcctatagcaggtgtcaacctggaggggggaaggccacagtctcctggcacacaagcatgctggtgcgagcaccgaggccatggctcgatctcatgtcgatcctcggcgaagcttagcggaggccttgggtgagggccagcggcccgggatgccagcgtagcgtcgctgccgctcgtccagggtgcgaacgcggtttggccgagccacatggacctcgcgccaggagcaaggttgtatccctcgtgctccgtgccaactcctctgacgtgcgcacggtacacgcggagcatggacccgcatgagctccacagcgaacttggctgcaagcaccgtaacggccgtcggccccggcacagccggggccgacgtggtctgggtgggagtgaaggttgtgtcggctacggagtcgtgtcgtcgttgacgttgacgtcgaacgtcgaccagccctgagccccgttcggtcctgtcgcgatgacgcgccagtagccggccgtcgggaacgtgagggtcgcctgggccgtgccgtcgacgagatcgactgatgcggggtacgtggcagacggagcccccgacggaccgaccaccgtgaggttcaccgtgcccgagacggatgtatccgtcgtgaggccagcagtcttcgcctcgacgttcacgacgagcggcgttccgggcgtcgctgcgagattctcggcaggatcggcgacctggatcgtgtcgctcggcacgtcgggtagcgatacgggagcgatcggcgcttggtggaagtcgaacatgccgagcaggtcgttctggcgggccaccagcttggtgagcgggtgcatcccccagaggcgatccatgagggcaaggatccccatgtcggtcgtctgcttcgagaagactccgggtcgcacccacggcgagatgaccaccatgggggtgcgggtgccgtagccgaaacgctgcgcgatcggcggggccacgtgatcccagaagccaccgccctcgtcgtaggtgatgaagatggcggtgctcttccactcgggcgagtgctcgatcatcgacacgagctgtccgacccatgcgtcaccgagctggatgtccgtgggcggatgctcgctgtagagccaggtcggaacgacgaaggagaagttcggcagttggttgttctggacgtcggccacgaactggctcgtgttcgcgacgtcgttccagaggtgcttgtcctggagcaccggcgtgtaccaggctgggttccagtgggtgacgaagccgttcccctcttgggttgggggtgggccgttgtagtcgccctggaagatgccccaactcagcccgtgctgggtgagctggtcgaagacggtgcggatcgggaaggacccagagctcggcggggaatccgacagccacgcgtctgcggtgcccgccacggcgtagatccgattgggctgggtcgggccgatcgcgggctggaagttgttgtcggcgagcacgaagtgctgggctaggtcccagaggttcggctcgacgctcttgccgaaggtcgtgatggacgcaaggccgttcgtcggcagcgtggtgtagtagttcatcttccaccccggcttgccggtcaggtacgcgttcgacggcgtcgcggaggtgaagtagcccgtcccgcccgccagcagtgcggggcggtagtccatcgcctcgatctcggcagcgcggttgtggttgaggtccaccgtgtcaccgacgttggcgggagccgggatcggcgcgacgggtgcggctgcgtagttcgtcgacggattcgggaactcggttcctgccgggatcccgttcgcgccagggaacgacccgaacaggttgtcgaacgtatggttctccagcatgatctcgacgacgtgctggatcgggctccgcatgccgctcgtcgcggctgctggggctcctgtgccgagggtgctccagcccactaaggctgtcgccaaactggtcgccgccgcgatcgaggcgacccaccgactgcgtgctcgcatcgttacctccccttcgatgatgtgggtgtccactcgggacgactccatgcttgaccccagagcttgcgctcaggttgcgctcaggtgactcgcaggacacggggagtggaacgtttgggtggcggtccgacgatcggtcgccctcgcgagttcggatctctcatgtccccacggccacctgcatgcgacgagcgcgaggccgctgcccgagggagcttgctcgcgtggcagatggacccctgaccggctccttccggcgagctgggcgggcgtgcgagatgtcgcggccgcggtggtcgtggcgctggtaccgggacgcatcccacggcagaaccgtgcgcgtgggggtgctcatgtcgtcccgcacaccccttcgacctcacggccgaggctgtgcttgcagcgaggtggtgccctgaaggtagatcgatcgctcccgctgggaatcggaccgcgcgagctcggcgaaccccacagcatcccacgcgatcgctgccgtggcgcgagggcggctcgaccgcgcgacacgtgtcgatcgccttcgtcgccccgacctaggtgcgcccccaccgtgggcgcgatccgtgcgcgtgcgcgtcgcggatgtgccgactacggcgcgctctggccgcggtggttcgccaactcgaggacctcggccccgtgtgcgagtccctcgacgacgcgttcggcgtgcgtcaccacgaccagggttcgatcgatggcgagccgggcgagaagtgcgacgagatcatcctcggtctcgccgtcgacgttggcggtcggctcgtcgaggatccacgtgtgctggtcggcgagcagcaggcgagcgagtccgatgcgctgtgcctcgcccgaggagacggcgtcgtgggcgaggcgcgtttggagcccgtcgggtagtcgcgcgagcagcggtgcgagtcccacgtcgccgagcgctcggacgaggtcggcgtcggatgcgtcggggcgggcgagccggaggttcgccgcgagcgtcgcgtcgaagacccacgcttcctgggggacgtagccgacgtggtgcgccacggtcgactcggtgagctggcgcgtgtcgacgccgccgaggcggatcgtgccacgggtgggctcccatgcggctcgcagcagaccgacgagcgtcgacttgccagccccgctctcaccgacgacgaggagccgacctcttggagggatcgagaggctgaggcgatcgaggatcgcggtggtggcgccagggtaggagaagctcacgtcctcgacgtcgatggcgaggggaccgtcgggcaggggcgtagtgttcgctggctggtcgcgacctcggagcgcgaggaccgagtcgaggcgtcgggacgaggcgagctcgctcgcgagatgggtcgcgctcacgccgatgccgctcgtcgcctcgaagagcccgagggcgaggaacggcacgacggcgagctccacggcctcgaggtggtggtgcgcgatcgccccggcaccgatcgcgacggttgcggcgatggtcagtgcttcggcgagaccggcgagcgaggcggggatcagctcgagcgctgcgttggtccgtcgacgcctggcgagcttgcggatgtgggccgcgagctcatcggtgagggtgtgctcgcccggcgttccggcgcgctcgggagcagagtcggcgatggcgagtgcgatcgtgtgggcggcttcggcggtcgcggcgagttcgcgggtcggtgctcgcccgagccgcgccgcggccgctggcgcgacgacgagcgtgacgacgaggccgagggcgaggaccactccgagggcggggttgaagacccaggccacgaccgtgcccacgaggcctgcacccaccgcaccggcgaggggagccgcgatgcgcaggagcagcgaggagagcgcatcgagatctcccgtggcagctcgcgagagcgtgccggcgatcgcgctcgggaccctgtggggtgcggccccagccacggcacgatagagcgcgacgcgaaccacgcgcacgaggcgcagcgtgaggcgatggccgaggaggcgctctccatactgaccggcacctcgggcgagggcgaagaagcgcaccgaaccgacggccacccccagcgtcaagatgccaggtcggagcgaggacttggcgaggaggtaggcggagaaggcgaacaggatggctggggagagcgcagcagcgagtgaggtacccaggtagccagcgaccagtctgcgctcagagtcgaggtggttgcggatgatcgtgacgaggttcatgtcgtcggctccgtcgtcggcgatggcgtcgctcgggtcccgatcgaagcgtcgctgagctcgaggacgcaggtagcgcggcgaaccacgagctcgcgatggctcgcgctgatgacgatggaccccttcgcctcgcgcgtgagcagctcgaggaatcgctcctcggtgcccacgtcgaggtggctcgtcggctcgtcgagcacgaccacgtcgcggccgagtgcgagtgcacgcgcgagggcgactcgttgtcgttggcccgccgagaggttcgcccccccgggtgcgaccaggtcgtcgcggcgctgaacgagttcgatcgcgccgagctcggcgaggaggtcgagtgcgacctcgaggcgatcgtggcccgcgacgagttggaggttgtcagcgatcgttccgggcaccatggcggggcgagccggcacccacaccgttcgttccgcagggagcgctcgatggatctcgtggtcgagcacgagggttccacggagcgttgcgccgcgacccacgagggccatgagcagcgtcgacttgccgatgccgctgcggccgacgacgcagagatggtcgccaggtgcgagcgacagcgtgaccggagggtcgagctctatctcgacagtggtcacggaacggagctcgagcagcgcctcatcgtgcgacggtgcggcccgcaggagacgtgtcgccggagcttgggacgtgcgtggcacgggggactcaggaggcgccgcgagggcgtcgatggcctcggctgctgcgcggccgtcggcggtggtgtggaactggagcgatgcggcccggagcggggcgaacacctcgggcgtccagaacaggacggtcgcgcccgtggcgagcgccatcgaggcgtcgttcagtcggatgccgatcgagacggcgacgagcgccacgacgatcgccgagaggatgtcgaggctcacacccgagaggaacgcgatctcgagcacgcgcatggttcgatgctcgagcgatgcagctgcggcgtcgacggcatcggcctgctcgtcggcgcgtccgaaggcggccagcgtccccgcaccaccgaggagatcgaggtagcgatgctcgagctcgatggtggcatcaagttggtcgcgagcgcgccggtcggtggcgatcccgatgagcgccgcgaggatcggcatcgcgacgaggccgccggcgagctcgatgccgaggatggggctggccaaccaggtcgcgaccacgagcgtcgggatctgcgcgacggtctcggcgaccggtggcgcgaccgatgcgaccgcggtcgcgaggcggtcgaggccctcgctcgcgagataggcgaggcggctcggatcggggttcgtcccgcgtgcggccgcgaggagggcgggctctgcggcgctggctgctcgctcgccagcctcacgggccgccacctggcccagccgccgcaggacgacccgcacgacgagggcagccccgaggacgacgccggccgtggcactcgcgccgagtcggtgcgcgacgacggcgtcgctgagcgctgcgccaaaagcgcgagccgccacgaggagcgcgacgagttgggcgagcgtggtcgcagcgaggatcgcccagaacggcatcgcccccggtgcgcgaagcgcccgggggtcgatgggaccacgtcgctcgctcacacctcgtgcggctggtcgctcgcggggacggtctcgtggggcagcgagacgcgacgccggaagatgtagtagctccagccctggtagaggaggacgaacggggtgaagatcgccgccacgatggtcatcgcgcgcaaggtgtagggctgcgaggcagcctcggcgatggtgagcgacgcagcggacgagagcgacgaggtgatgacgtcaggatacaaggtcatgaagaccgtcgccgtgatggcgaggatggcgacgcccgtcacggtgaaggcccagcccgagagccgctcgcgattgagccagctcgccgcgaccacgagcaggagggcggacacggggatcatgcctgggacgtcaccggcgtggtgctcggtccgtgccacctcccacgtccaggcgaggaaggcgaggatgatgacggcggtgatcggcgcgatgcgcccggcgagcgcggaggcacgctccttcagtgcgccggtggtcttcaggttgaggaacaaggcaccgtggaggaggaacaggctcagggtcgcgagccccgcgacgagcgcgtagggctgcaggagcgagagcagcgagcccgtgaagatgccgttcgcggtgatcgggatccccttgatgaggtcgccgaaggcgacgccccagaggagggcgggcaccagcgaccccaccgtgatcacgatgtcccagttgcgtcgccaggtcgcgctctggcgcttgccgcggtactcgaacgcgacgcctcggatgatgagcgcgacgaggaggatgaacagagcgaggtagaacgcggagaacatgcgggcataccacagggggaacgccgcgaacgtcgccccgcctgccacgatgacccagacctcgttgccgtcccaggtcgcaccgatggtgttgatgacggcgcgacgttcgaggtcgtcgcgtccgatgagcgtcagcagcatgccgaccccgaagtcgaagccctcgaggaagaagtagccggcccagaggacgccgatcaggatgaaccagaagagttcgagaccagtggtgtgcatcgtgcgctcctagtagatcagcgagccgacttcgtgctcggtctcggtgtcagcgccgggttcgagtgagcgtcgaccatagcgaaccatcaacgagatgtccacgaccgcgaggatgccgtagagcaccgtgaacccgacgagggtgatcccgaccgaccatggcgacaggtgcgaggccccttgggaggtcttcaacaagccgtagacgatccagggctggcggccggtctcggtgtagatccagccggtggtgttggcgatgaaggggagcgggatggtccagagggcgaccttggcgaaccagcgcgactgctcgaggcgatggtggtagagcagccagccaccccagagggcgatcaggatgatgacggctccgatccccgccatgatgcgaaagctccagtagtcgagggcaacgggcgggatgtagctgcccgggccgtactggcggaccatcgcggcttggagctgattgatgccctgaacgaccccgttccagtggtcggtggcgagcaggctgaggacgtgcgggatgccgatggagaagatgggcttgtcgtggaggttgccgatcgtgaggatcgattcggacgcaccgcgggacgtgttgtagagggcctcgccggcggcgagcttcatgggttgggtctcggcgatcacctggccgtcgatgtggccgtcgaggcccatgagcagcgccgagatgagcatgacgatgagcgacacgcgcgcgcctgcggcgaagacctcgcgggtctcggtgctgcggtggtactgccacagcgagatgccgagcacgagcgcagagccggtcaggaaggaggcgagcagggtgtggaacagcgtcacgaggaagagctcgttcgtgaggatggcccagaagttcgtcatgaccgcctggtgggtggccggatcgatgcgatagcccaccgggtgctgcatccacgagttcgcggcgaggatgaaggcggcagacagcatggtcccgatcgagacgagccagatggaggcgaggtgcacgcgccgtggcacgcgatccttgccgaagagccacacgccgaggaaggtggactccatgaagaaggcgaggagtccctcgatggcgagcggcgggccgaagatgttgccgacgtaggcggagtaggccgaccagttcatcccgaactggaactcctggacgatgccggtgacgaccccgatggcgaagttgatcaggaagagcttgccgaagaagtcgagcacgcgctcgtagcggtcgtcgcccgaacggtaggcggccgtctgcaggatcgccacgatcagacccagcccgatggtgacggggacgaacaggaagtggtagatggtggtggctgcgaactgccacctcgacagcagcacggtcatcgacgcgaccatgagaccctccctctgacaccgcagctcgagctgaacgtacgcaaccgagctgcgagctccagcctacgaatcgtcctgatgggcgcacctgggcccttcgtcacgtcttggccgggactcgggtcgcccgccgggagcagcgagtcgactagcctcgtggcttcatgggttctctcatcaagaagcgccgcaagcgcatgcgcaagaagaagcatcgcaagatgctgaagaagactcgctggcagcgccgagccggtcgctagctcgcacgacgttcacgaacgccccgcggctgcggggcgttcgtgcgtcgtggcggcttcgccaccggagcctgcccgcttcgccaccggagcctgcccgctgtgccagcggccctcggcggtcaggctgactcgccggcgctcggtgtctcgctcgacacctcggtcgctggggaggcgagggcgcggggcagcgtccgtgtctcgatcagccacacgggcaagtccgcgagcatgaggcgcgtggcccggacgtcgtcgcctcccacggtgacgtgggcagcagggcccctcgcgaactcgtcgccgaggccgagggtgcctgccgagtgccaccacgccagcgtcgagcccgagccggcgagtcgaggacgtcgtccggtgcgtcgctcggcagcggcgatgagcgcccccagccgtggctcgatggcgcaggcggcggcctcgaggtcgtttgcgacctcgtcgtcgtcgtgtggtccaccgagtgcgtcccaggctcgatagacggagcccgtcgcgacgccgaagggcggcacgatgagcgtcacgaccgcatccaggtcgtcgagggccatgacctgctcgccgatgccgcgggcatcgacgtggccagcgagctgacacagcgcgacgtcggcaccgaggtgccggccggtcgcgagcggtgctccgaaggcgcggaggacggcgcccgcgtcggcggagccgccgccgagccccccttcgaccgggatgcgcttcgtgatcgcaagggtgcctgtctcgccgatgagctcaagggctcgccaggcgaggttcgtcgcgtcggtcgggacgcgagcgaggtcgacccagggggcgccagcgacgaggtcgatggtggtggcaggggccggggcgaggtcgacggtgtcggcgagggcgaggtggacggcctcgatctcgacctcgtgcagaccgtcggctcggcgtccgagcacgcggagggtgcgggtgagcttggcgggcgcgacgagcctcaccgggcacccttcgaggttgcgatggcgcgccccagcgcgacccactcgtcgagcgcgagcgactcggcgcggcgcatggggtcgatgccgacggcatcgagcgccgccagctcgtcgtcgccgagggcgcgtcggagcatctgacgccgacgttcgaagccgtggcggatcgcacgcaccgtggcgtcgaaggtcgtgggctcggtcaccgcgagcggctcgctgcggcgatcggcgacgacgagcttcgaccacaccgtcggctgcgggtggaagacgaccggtggcaccttggcggcgacgtgcgcgtcgatgctgagcgcgagccgcaccccgagcgccgagcacgctcgggtgccggcggcagcgacgatgcggtcggcgaactccgcctggaccatgacgaccacacgctcgaggaaccaggcctcctcgacgaggcgaacgaggatctgtgagccggagtggtaggggaggttcgcgaccagcgcgctggggcgtcgttccagcgggagcgggtcggcgagcgcatcggcgtgctcgattcggacgttgtcgatccctcgcgcggccagcacctcgccgagcgccgggatcagtcgtcggtcggcctcgagcgccaccacctcgtcgaagtactcggccagccacacggtgagcgagccgaggcccggccccacttcgaccgcgacccgaagccccgcctccgcggccagcgctgcttccttgcgcgcgatgttgccgtcggtgaggaagttctggccgagggccttggagggctcgagcccgatgcgctcgaggtgtgcgacgatctcccgcttcgtgactggacgcatggtgctcagggagatggctcgacctcacggagcccgaagagccgccgtgtcgtcgccgcggtgatcgccgcgagccggtcggcgtcgactcccttctcgctggccacgaagcgtcccgtgacggcgacgttggcgatgtggttgggtcggccgcggagcgggaccggcgcgaggaagggcgtatcggtctcgacgagcagccgctcgatcggggcgagccgaagcgcctcgcgaacgggctgggcgttcttgaaggtcacgatccccgagaacgacaggtaccagccgcgtgcgagggcgcgctcggcctcgtcgggaccttccgagaacgagtggatgatgaccgctggcggactcggggcgtcgtcgaggatggcctcggtgtcggcccaggcttcgcgcgtgtggaccacgagggcgagcccgaggcggtgggcgagggcgacctgctcggcgaagacgcgccgctggacggggcgcggcgagtagtcgtagtggtagtcgagcccgcattcgcccaccccgacgacgatgcccgggtactcgacgacgagcgcggcgaggtcggcgatcgcgccaccgtgcgcctcggcatcgtggggatggatgccgatcgtcgcgccgacgctgaggtcgagccgttcggtggcgagctggtcggcgatacgggccgcttcttgcgagctcgcagggtccgtcccgatcgcgacgaacccgacgaccccggcgtcgacgaggagcgccagctcctcgtcgaggctcacgcgctcgggatgggcgtgcgcatcgatccagcccgcactcatcggcgccccaccacggcatcgaggtcggtgcgtgggaagagcggggctggcttcgtgatggtggccccgcccatgcccggttgccaagcgagcggtcccgcctcgtcgaacccgagcgctcgtcgggcacgttcggccccatcggggatggcgggggagaggagcacgctcgcgaggcgcgccccctcgcgagcggtgccgaggacggaggcggcctcggccgatcccttcgcgagacgccagggctccgtggcctcgaggtaggcgttcagccgatggacgaggccgatcgctgcgtccatggcgtcgttcggccgccaccgttcccaacctgcgcggacggcctcgatggtctcggcgatggcgagctcgtcggggggcgtcgcgggtgcgtcgggcacgtggcccccgagccgttggacgatgagcgagcccacccgcgcgacgaggttcccgaagccgttcgcgagctcggcgttgtagagtgcgacgagcgcctcgagggacacgtcccagtccggcccgatcgccgaggagcgcaccaggtagtgccggagcgcatcggcactgagcgcgcgttggacacccagcgggtcgatctggttcgcgagcgacttcgacatcttctcgccctcgttgagcagccagccggtcacgatcagctgggccgggggatcgatgccggccgcgaggcacatcgccggccaccacacggcgtggaagcgcaggatgtccttgccgagcaggtggtgggccgcgggccaccaggcggccacctcggcggagtcctctgcgtagccgatcgccgtgaggtagttcacgagcgcgtcgtaccacacgtagaagacgtgtcgcgagtcccaggggacgcgcacgccccagtcgatcgaggtgcgggtgatggagatgtcggtgaggccgccctcgatgaagcggagcacctcgttgcggcgcgactcgggccagatggcctccggatggcgctcgtagtgctcgaggagacgatcttggtagcgcgagagggcgaagaagtagttctcttcgcgcatccgttcgcaggcgacgtggtgcaccgggcaaagctcccccggctcgagctcgccgggttggtagtaggcctcgcaccgcacgcagtagaggccctcgtaggtgccgaggtagatgtcgccgcggtcgtggatgcgctcgaggaagcgttggacgcttcggtggtggcgtggctcggtggtgcggatgaagtcgtcgtaggagacctcgagcgcatcccaggcgcgtcggaactgggccgaggtcacgtccacccaggcctgtggactcacgccgtgcgcctcggccgactgggcgatcttcagcccgtgctcgtcggtgccggtgacgaagcgcacctcgtcgccgatcaggcgatgccagcgggcgatcgcgtcggcgaggatcacggcataggccgtgccgaggtgggggtcaccgttgacgtagaagatgggggtggtgatgtagaagcgccccacgagcccagcgacctcctcgccgatcgatctcgtcccaagcttaccgaggcgccggtcgctcgctgggacgagcgtcgggacgcgccgcgaggatggcggcataggcctcctggcggggcgcgttcgtgaggcgagcgacgatccgcgccgcctccgacggcgcgagcgaactctcggcgagcgctcgggtgaggcgctcgtgctcgacgacgctcgtgggcggggcaactcgtgccggccccaccacgacgacccactcgcctcgccgatcgatggcgcgcgcccacgcccctgcggcgcgcgcggtcccttggaaggacgtctcgtggatcttggtgagctccttggcgagcagcacctcgcgctcggggtcgagctcgccgatcgcatcgacgagctcgaggatgcggttcggggcctcgaagacgacggtggggacgccctcggcgagcaggtcagcaaggagccgtcctcgctcggccccgcgctggggcaagaaccccgccacgcagtagcgggcgacctcgtggggccagagcgccatcacggccgtcgcggcgctcgggccggggatgacgacgacggtggcgcccaccgcgcgcgcggtggcgacgaatggcgcccccggatcggaggtgcccggcatgccggcgtcgacgacgagcacgacgtgctctccgtcgaggaggtgtgtggcgagcgcttcgggctcgatcgcgttctggccgcggagcgcgcggaccgctcggaggcggatgccgagtgcgctggcgaggcgcctcgtgacgcgggtgtcctcgcagacgacgaggtcggcggtctcgagggcgcttcgaagccgcgggctcgcgtcggcgaggttgccgatcggggtgccggcgacgctcagcacgccgctcatcgacggacctcgaggcggtcgcccgccgaagggggggcgtcgtgccagagggcgcgtggcaggacgacgatgcgccagggggcgacgacgaggcgtggccgccatggatggagccgaacggtgctgcggacgagcccgttgcggtcgagggcgagcgcgagcgcatcgccgagctccccgagcccgctccagagcgcgatcggtgtcgagatgagcaggccgtgggagtcctcggtgtgccagatcaccgggcccgcggcgtccagggtgccgagcacccgaccgcgctcgttcaccagccacgccatggcgatcacacgttgaagcggatctcgagcacgtcgccgtcggcgacgagatagtcgcgcccttcgagccggaccttgttctgcgccttggcccgggtccacgagcccgcctcgaccacgtcgcgccaggaggccacctcggcgcggatgaagccgcgggcgagatcggagtggatgatgcccgcgcaggtctgggcgttcgagccgcgtcggaaggtccacgcgtgggtgtccttgtcgccgctcgtgaagaaggtccagcgctccagggtttcgaaggcggctcgagcgatgcgctcgagggcgctcgaaccgatggcgagggcctccatcatctcggcacgttcggcaggctcgagcctggcgagctccgcctcgagcgcgagcggtgcggtgacgacggtggcgtgatcgccgaggcgccctcgcacggtgtcctcgacggccacgtcggcctcggcaccctcgtcggcgttgatcaccgcgatggcgggtttggtcgtgatgagaaaggccgagcggaccagctcgagcacgtcggtctcgagggtggcccgatagagggggatcccgtctgcgaggaccgcttggacgacctcgagggcggccacctcgggtcgggccgaggggtccgaccgcgcgaccttgcggcgccgctcgagcgcgctctcgacgctggcgaggtcggcgagggtgagctcgagctcgagggcgtcgaggttcgcgatcgggtcgtcgtcgcccgggactcggtcgtcgtggaacgcgcgcagcacgtagaggatggcgtccgcctctcgcagctggccgaggaagcgattgccgaggccggcgccttgggaggacccagcggtgagcccggcgatgtccgcgagctgcatgtgggcatagaccagcttgcgcgagtggtggatcgccgcgagcgcgtcgacgcgctcgtcgggtacgaccgcctcggcgatggtggtgtcggtggtggtgaaggggtggggcgcgacgggggtgtcgagaccggtgagggcgttgaagagtgtggacttgccggcgttggcgagtcccacgagaccgagcttgtccatggccccctcgatcatagggccagcggggagtcgtctctcgagccgctagccttgccccccgtgtcgaagcgaaccgtcaagcgcaagttgcgcgcgaagaagaaggccaatcacggacgcaagccgaactgcggtcgcggctagtcgtcaggcgtgatgccccgacgtcgctcgatgccggtgatctgaccccggagctcctctgggacgatcggtctgggtttcgtgctggcctcggcgagggcggcctcgatcgcgtcgtaggcctctcgcgatttgggcgcgcgtgccagatagagcacgacgtgcgcgagcgtgatgcgggcttcgggcatgccgatgcgctcgaccgtgtccgcggccgcggccgcgaggacaagagcctcgggatcggcgaggccgacgtcctctgatgcaaagatcacgaggcgccgcgcgatgaagcgcggatcttcgcctgcggcgagcgccgcggcgagccaccggatcgcctcggtcggtcggctctggcgcatcgacttgatgagcgcactggcgagctcgtagtgggtcgagtcgtcgagcccgagcgcggcgatctcgctgatgcgctcgaggagctcgacggtgagcggtcgctgggccgccgcgggggctgcacgctcgaggatgcgcaacagcgccctcgcgtcgccgcgcgctgcggcgacgagccaggcgatcgccgcatcgtcggcgatgaggccgaggtgggcgagcgctcgctcggcgaccgcgcggagcacggggggctcgagtgcgcggagccgaacgacgtcgcagcgcgacagcagcgcgggtgagagcgtgacggcggggttctcggtcgtcgcaccgatgaaggagatctcgccccgttcgatgggcgcgagcaggagatcgagctgggtccggccgaagcgatggacctcgtcgacgaaccagagtgtcccgtcgccgtggcgggcgcgtcgggcggcttcggcccgcgcctcgcgcaggtcccgcacgccggtgtcggtcgcgtgcagctcgacgaggtgctcgcctcgtgcccgtgcgagcaggctcgcgatggtcgtcttgcccacccccggcggcccggtcatgatcaccgcgatcgtccggggcgcggtggcgagggcctcgaggcgcgctcgcgcgtggtcttgtccgaggacctcggcgagcgaggtcggtcggagctcctcggcgagcgggcgtgctcgcaccatgtgctcctcgaagagactcaccgcgtccctgagcgcagctcgcgacgtcgcgcctcgagcccgagtgcagcgagcacgccgtcgtcgacgggcttcggtgcaccggtcatggggtcctggccgctctgggtcttcgggaacgcgatgacctcacggatggtctcctcgccgagcaggagcgcgacgaggcgatcgatcccgaaggcgaagccgccgtgcggcggcgggccgaagcggaaggcgtcgaggaggaagccgaagcgatcggccgccgcctgctcgtcgagcccgagcaggccgaagatctgtgcctggaggtcgggacggtggatcctgatcgagcccgagccgagctcccatccgttcatgacgaggtcgtaggactgggagcgcacccgcaacggctcgcgctcgaggaggtccatgtcgtcggcgtggggcatcgtgaaggggtggtgggccgagacgaggtgaccctcgtcgtcgacgccctcgaagagtgggaagtcgatcacccagaagacgtcgagcgcgtcggggtcggcgaggtggcgcccgagcgcgaggcggatggtcccgagcgcggtgcaggcgacctcgaagcgatcggcgacgacgaggatcgtgtcgccgacctcggctccggtgcgctccacgagtgcttcgagcgccgccggcgtcatcgccttggcgagcggtgaggcgatctcgagcggcgtgcggctctcgacacggaaccaggcgagtcccttcgcgcccgcgctgcgggctcgttgggtgagctcgtcgagtcgggagcgcgagaggggctctgcgacgacgagggcggtgacgtagtcggccgcgagcgcgcgcgcaccggagtcgcggaccgcctcggtgacgtcgacgagttccatgccgaagcgtcggtcgggcttgtccgagccccagcgggtcatcgcctcgtgccaggtgatcgtcccaatggggacgtcgtcgacgccccgtaccgagcggatgacctcgcgaatggccgcagagacgaaggatcgcacgtcctcttgggtgacgaacgacgcctcgaggtcgagctgggtgaactcgaactgtcggtcggcgcggagatcctcgtcgcggaggcagcgcgcgatctgatagtagcgatcgacgccgccgatcatgaggagctgcttggcgatctggggcgactgcggcagggagtagaccgatccgggctgggtccgggagggcacgaggaactcgcgtgcgccctcgggcgtcggtgtccagaggagcggcgtctcgacctcgacgaagccctgggcctccatcgcgcgtcggatggcggcgttggtggcggcacgggcgcgcaggttgcgctgcatgcgtgcgcgccggagatcgaggtaacgccacctgagccgcgtggtctcctcgacctcggcgtgctcgtcgagggggagcggcaggggatcggcgtcgccgagcacctcggcgtgttgcacacgaagctcgatcgcgccggtggcgaggtcggtgttctccgttccttcgggacgccgcgccacctgaccctcgatgcgcaccgccgcttcggtgtgcagcgaccctcgaccgtccatgacgcactgcacggtgccggtgtggtcgcgcacgtcgacgaagacgaggtgttctccgtgctcgcggatgcgcgccacccagccgcagacgctgacgtcgcggtcgaggagggattcgtcgagcgcgccgatgtagtgcgttcgaaggccggctgctggcggcagggtccgttcactcatgcgcggtggcatctccttcggttcggggcgctggcctcggcggcagcacctcgcgagcctagactgccgccgtggtcacggctcagggaaggctcatcggcgtcggggtgggcccaggggaccccgacctcgtcacggtccgtgccgtgcgtacgctcgagcgcgcccgcttggtgctggcccccacgctcgatgcggcgagccccgggcgcgccgagcgcatctgccgcgaggcggcgccgtcggcacggatcgagcgcgtggtcatgccgatgacgagcgatgcggaggcttcgtcgcggcgccgggcgagcgccgccgaggtggctcccctggtggtggccgcgctcgaggtgggtggtgacgtcgcgtgggtgacgctcggcgacccagggatctactccaccttctggctcctcgtcgatgccgtccatgcgctcgcccctgacgtgctggtcgaggtcgtcccgggcgtggtcgccttcagcgcccttgccgccgcggccggcgttgagctcctcgacgacgccgaccacctcgtcctcgcgaccgggcgcacccggaccgaggtcgtcgacgctgccctcgccgatcccgacagcgccctcgtgctctacaagcccggtcgccaggtccagagggtgcgtgaggcggtggcgtcgtcggatcggcgtgcggtcgtcgggtggctgctcggcacgcccgaagccgagatccgaccgctcgccgaggcgcccgacgaggttccctacctcaccacggtgctcgtcgcaccgaggaggccacgggcgtgagcgtcgagctcgtgctcggggctcggcgatcgggcaagtcggcctgggcggaggcgcgcgccgtcgagctgcggatcgggacctatctcgccaccgcagcggcacacgcgctcgatgcggagcgtctcgcggcccatcgtgcgaggcgcatcgggcgcttcgtgacgctcgagccgggcgacccgggcgaactcgtggagttggtccggaccgtcccggggggcctcctgctcgacgggctcgggctctgggtcggctggcagctgagctcggaccacgacgtgtcctcgggcgagctcgtcgcggcgctcgcacggcggagctccccgacgatcgtcgtctccgacgaggtcgggtggtcggtgcatcccgagcgtgcactcgcgcagcgcttcgtcgatgagctcggtgcgctcaaccaggcggtggccgccatcgcggcccaagtcaccctcgtggtcgcgggcctgccgcttcggctcaaaggtgcgtgagtgaagctcgtccgctcgctcgccgggggcctcggcttcctcacgatctggccgttcgcggcaccggtgagcgccgagagcgtcctcgggttcccgctcgcgggtgtgctggtggggctgtgcctcgtcgtcgtcagggtcggagcccagcgtgccggagccctcgtggtgggggcgctcgcgttggcggcggacgcactcgtgacgcgtgggctccactacgacgcgctcgccgacaccgccgacgggctcggggggttcatggagccggcagagcgtctcgcggcgatggacgacccccgtctcggcggcctcggcgctctcgcgctcgcggtgacggtggtggtgcgcgctgcggtgctcggtgcggctggcatcagcgcgctcgggctcgtgctcgcgctcgcctggtcgcgctccgtcatgggtgtggtggtgctggagagtccgagtgcaaagcccggtggcatgacgcggtggttccgcgacgcctcgctcggggtgcgtgtcgcctcggtgagtgccctcgtcgtgttctcggcggcgatcgtcgtggtcgagggcgcgccggggttgttcggcgtgtgcgtcgggacgatcgcgggcgggttgctgtggctgagggccactcgcgcgctcggcggcgtcaccggggatgtggtcggcgcggtcggcatcgtggccgagaccgcgctcatcgtgggggtcgtgctgggtgcgacgcactaggtcgctcgagctcgcggtcgcgctcgggctcgatgcgatgctcggtgacccgcccgaccgctggcacccggtggcctggttcggtcgggccgcgagcgtgctcgagcgacgctactggcgtgacgatcgtcgtgtcggcgcgctcgtggcaggtgcgctcgttgtgggtggcacgctggtcggcgcggtgatcgatcgcgtgcctggtggggccctagccagtgcgtgggtcgccctcggaggggccgggctgcggcgacgagcgctcgacgtcgcgcgtgcgttggacgacggtgacctcgagcaggcgcgtgcgtggctcggctggctcgtgggtcgcgatcgcgacgggctggacgcgaccgagatcgcgcgcgcgaccatcgagtccgtggccgagaacacggtggatgccgtgctcggccccatggtctggcacgtcgcgctcggctcgatgggctcgatcgcgctgcgcgccgtcaacaccctcgatgcgatggtcggccatcggaacgctcggttcgagcggttcgggtggttcgcagcacgcctcgacgatctcgtcatggcgccgccacgccggctcgcgatcgcgctcgcggcgccgtcgcatcgccggctcctcccggcggctcggtcgcacccgagtccgaacgccgggcccatggaggcgctggtggcggccgcggtcggcgtgcgcctcggtggtgtcaaccgctacggggacgcggtcgtcgagctcccggtgctcgatggcggacccccgcccgacgccgcagccattcggcgggcggttcggtggtcgcgcagcgtgacacttggcacgctcgcctttctcgccgtggccgagcaggcggcgaacgcggcggtgggccgggccccgtagcgtggtggtgtgctggttcgtgaggtgcgtgtgcacacggggcgtcggctcgtcaccgacgtctccgccctcgtcgcagcgatcgtcgccgaccagggcgatggcctcgtcaactgcgtggtgccgcatgcgacggcaggtctttgcctgatggagatcggctcgggatcggaagacgacctcgccgtcatgctcgagcagctcgcgccgcgcacgacgccgtggcgccaccgacacggaactcccgggcacgggcgtgatcacgtcattccggcggtcgttgcgccctcggtggtgctgccggtgatcgacggtcgcctgctgctcggcacctggcagtcgctcgtcatcgtcgattcgaacgtcgacaaccccgagcggcggctcgtcgtcgccatgctggctgatggcaaatcccggggcgcgagcgcacccgaggagcgctcggatgcgggcgaacggcccggtcgggacgtgccttaggccgtgcgcagacgacctgagggccgccgctccggtgggacctgtgcgatgagtgggttcgtctggtcgcgctcggagatgacggggtcatcgagctgccagaggccgtggaacgtggggtcgttccagcggagtccgagttcgtcgtcggggttgtagtagccgtcgacgaggtaggtcagcgtcaggtccgtgagggcggcgaaaccgtgggcgaccccaggggggatgaagaggccgatcgggtcctcgtcgcccatcagcagggaccacgtcgtgccctcggtccgcgatccgtggcgaaagtcatagagcagcacctgtgccgtgccccgcacgacgtaccagtagtcggcctggtggaggtggtagtgcatgcccacgagcgagccagcgaccttgtcggagcgcgacccctgcaccatctcacgaccgagcgggaaccacgagcgacgataggtctcttggaacgcgccgcgcgcgtcggcgtggacggtcgggcggatgacgatcacgtcggcgatctctccgtgggccatggcaacctcctgactcgccggctcagtgtaggcccggccaagctaagtgggcggtggccgtgagtctctgagcgatcggcgacattcggtaggctatgagtggcacagttgcacgcacggtgcacgcaaggagctctatgaatgcagcgatcgtgatcgtcgcgctcttcgtggtggtcggcgtcgtggccatcgtctcgcttcgaggacgtacgcgcgaggtgcgcacggtcgatcaccatcagcgagcgctcgacacgctcgagcgcttcgccaaggagcgcggtgtgcaagccgaccatcgcgtcggcttgcccaagagcgagcaacgtcgagtcgccgccggatcggacgacgcgcccccggtgcggctcgacctcggtcggctcgccgacctcaccgacccggacatgatccgcatcgaggcggactacctggcgagtggcgccagcgccgagacatccgctcaggcgcccggtgacgaggaaccgacgaaggatgctgccgtggccgcatccacggaggacgaggcggtcgagcaggccccgccaccggcgacgaggccgatcgatcgggccgtggccgatcggaccacggcgatggcggcgatcacgcccgatcgagcgcccgaggaccgaaccgaactgctctcggcggtgggcccatcggccgccgtggccgccgacgatcgatcgcaccgcggtgacgacgctgtgcgcgagcaccgggtctaccagctccatcggcgtactcggctcccggccgtgatcggtggtgcgggaatcgcggcgatcgcgatcggtctcgtcgccttcgaactctcgagccaccatgcggcagcaccgacgtcgcagtccgcctcgagcccgacctcgtcggcgccctcgaccacgaagcagtcgtcgaacgcgaagacctcgacgacgtcggcgtcgaagaagacctcgacgacgtcgaagacgacgtcgtcggcgaagaaggccaagggttcggcgagcgctgggccggcggtcgcgctggtgagctccagcagtaccggcgcgacctacaacgtggtcggcggtgcccacaccgtcgttctgcaggtgtcgagcgcaccctgctgggtcgaggacgcccaggctcccggtggtcaggtgctctgggacgcgaccttgccggcgggtggcagctacacgatctcctggagcggtggaccgctgtggctccgcaccggcaactcgggcgtgctgtcggtgagcgtgaacggccatccggtgcacttcagcgcaccgccgggtccgttcgacctgctgttccagccggtgcgttagtcggtcgctggggtcagcgccgcttgcacgaaggcaaggacctgggcctcgtcgtgccaggcgtccttgcgcttcgtgggcccgaggtgaccttgttcgtcgtcgacacggatccacacccgtgcctcgggattgaccaaccggagcttggctacgtacttgagtggttcgaagaagccgacgcgcacgtcgttcagcccggtcgtgacgaggatcggcgggtaggtcccttcgtgcaggttgtcgtaggggctccatcgcgccatcgtctcggcgatgacgtcggattcgagcggattgccccactcctcccactccgtcacggtgagcggcagtgaggggtcggacatcgtcgtcaggcagtcgacgaaggggacctcgaggacggcggccgcgaagcgctctggcgcccgattgagggccgcaccgacggtgatgccgcccgcactggcaccacgaatggcgatcgcggagggatcggcgatgccctccgcaacgaggcctgccacgacgtcgagcaggtcgcgcacggtccgttccttgcgctcgagccgaccggcgtcgtaccacgatcggccgagttcgccgccgcctcgcacgtgagcgatggcgaacgtgatgcccgcgtccaagagtgagaggcgcgagatcgagaaggtcgggtcgatggcctcctcgtaggcgccgtaggcgtagacgagcacgggtcccggcgcaggtgcgctccggcggcgagcgatcgtgaccgggacgaggacgccgtcgtcggcggggagccacagccgtctcgtctcgtagtcgtcgaggtcgacgtcgccaccgacgcgctggcgccagcgctgcgtcgtcgtctcggtggtcggcatgtaggaccagatggtggcgggctcgacgagcgagaccgtctcgaagcgaacctcgtcgtcgtcgaggtcgaggttgccgaccagcgctgcggtcgagggctgctcgggatcgacgaggaggcgacgttcgctcgctggcgctccccaggggaggaacgacacgacgagcgaggcgcggcgtcgcgtctggatcgcaaggccgtggcgggtgatctcgaacccctccaggatctcgccgtcctcgagtaggtcgacctcggtgaggggttgctcggggtcggcggtgcggaagagacggaactcggcgtcgtcgcggctctcgatgaggtagaacccgtccgggccgtggtcgagctggtagagtcgaccctcctcgcgcggtgcgaagggccgagggggggtcgcgagtgggtcggtggcgtcgaggagccaccattggctcgtgcgcttggattcggcctggatggtcaagaaggcgcgatccttcgtccgtcccacgtcgaggaagtagtgggcatcgggttcttcgagcacgaggatgtcgtcggacgggtcgctgccgatgcggtgtgcccacacggacgcggggcgcagggtctcgtcggggcgcgtgtagaggagcgttcgcgagtcgttggagaggacgaagccgtagccggccggaaagatctcctcggctcgagtgatgatgccggcctccagccggccgacgacgaggcggagctgctcggagccgtcggtgtcgacgccgacgacgacggtgtgctcgtcgtcgccgatcaggagtccggcgagtgcgaagtaggcgtgaccgtcggcccaggcgttctcgtcgaggacgagctcgcgtggtccgcctgcgacgggctcgcggtagtgcaccggatagtcgaggtccggttcgatccggctgaggtagcgccatgacccgcgacggacggggtagctctcgtcgggttcgaccacgcgtgagcggatcgtcgcctcgatgcgtgttgcggcgggcgccaggcgttctgcgagtgctgcgaagctggtgcgagccgaggcgatcatgtgctgggtgcgcgggtcgtcgatcgagcgcagataccagtaggggtcgatccgtgtgcccgcccgccctcggagcgtgtgtggttcggggtcgggagcaccgagaggagcgaggtccctcgtgagggcatcgagcatcgtgcgcatggacgcgagtgtagggagcgccgttggctcgggccgttcggggcgatatagactaccgaggtagtgcaaatagggaggcccgatggcgaaggttgacctggccctcgatcgctacaagctcggctggtctgacgaagaggcctatgtcttcaagccccgcaagggcttgagccgcgagatcgtcgaggagatgtcgcgcatcaagggcgaacccgagtggatgcgccgattccgcctccgctcgctcgactacttcttccgtcggccgatggcgccgtggttcgcggtgaacatgcccgacctcgacttcgatgacatctactactacatcaagccgaccgatcgccaggtggaccagtgggaggcactccctgagaccatcaagcgaacctgggaccgcctcggcatccctgaggctgagcggaagtacctcgccggcgtcaccgcccagtacgagtccgaggtcgtctaccaccgcaaccgcgaggagctcgcccagcaaggggtcatcttcaccgacatggactcggccgtgcgcgagtaccccgacctcgtgcgccagtacttcggcaccgtgattcctccgaacgacaacaagttcgctgcgctcaactcagcggtgtggtcggggggttcgttcatctacgtgccgccaggggtcaaggtcgacatgcccctccaggcgtacttccgcatcaacgccgagaacatggggcagttcgagcggaccctgatcatcgcggacgagggcgcgcaggtccactacatcgaggggtgttcggcgccggtctactcgagcgactctctgcactcggccgtggtcgagctcatcgccaagcccggtgcgcgcatcacctacacgaccatccagaactggtcgtccaacgtctacaacttggtgacgaagcgtgctcgagcagaggccgaggctcgagtcgagtggatcgacggcaacatcggctcgaggctcacgatgaagtacccgtcggtgtatctcgtgggtccgaaggcgtccggtgaggtgctgtcggtggcctacgccggtgccggccaacaccaggacacgggcgcgaagatgatccatgctgctccggagaccacgtcgaccatcgtgtcgaagtcgatctcgaaggacgggggcaatgcgacctatcgcggactcgtccacgtcgacgatggcgccgagggcgcgcggagcttcgtgcgttgcgacgcgctgttgctcgacgaccattcggtgtcggagaccaagccctacatggaggtcgccgagcgcgcgtcgtggatcggtcatgaggcaacgatctccaaggtcagcgacgaccagctgttctatctgatgagccggggtctgtcggagtcgcaggcgatgagcatgatcgtgaacggcttcatcgagccggtgacgcgaaccctgccgatggagtatgccgtggagtggtcgcggctcatcgagctccagatggacggggcggtcggctaggtcgtcgtcgctgccgcgagcgcgcgctggttggcggggtcgtagccgagttcgcctcgaggtcgttccatggcggcgtcccggggcgcgcgggcatcgctcgccgacatgtctgctctttcgtagctcgtcgcatttgggagcttcgggggccgtggtcggtgtttggtctgcgaggcttctcggggagccatcggaggctcgtcgcacgcgcatccgggcgctggggcaacgatcgtcgtcgtgtcgcgacgtgcacgagccgctcgaccgtgcctcgccagattcaaggtctcgccgtgaggttcgccggctgagggtcgtgtgagcgcatcgcgatgcctgaagcgtacgccggctcgcagtcgcggcccgaactcagatggcctgcgccgttgtcggctgtgggcacgggggcgcgacagctgggcagcggcgccgtcgtgaggatcgaggacgatgcgcatcgaaggccggtggtacaatcggccggagagccattcggaggcgtcgtgctcacagtcgatcaagcgacctcccagaccaaggggaatcaggcgcgcccaacccggtcggtgccgcgtgtgttgcggtttgctcctccttcggtcctcaccccggacgaactcgtccggctgcagcgttcggtgggcaacgaggccgtcgagcagttgctcacccaacgcctcgatgcgcttgctcacaagaagcccatcgatttcacggcaccggtcacggtcgtggtggatgacggtgtgcccgacgttacgaaagggcagtcttctccagagccggatccatacgccaagacgccgggcaccgttgggaccggcaccgaactccagggccccggcaacgcaccagtcgggccgacgtcgccctggagccagggcaatcgcccctttggaccgcgtacgacgccgttgatcggccagcgggactcgaagtcgccggatccatacgccaattcgaagtcgccgagtccggtgtccggacctgcgagcaattcctggcagtggggattccgatcgcacgtgcctgcgaagctgagcgtccttggttctggccggcgaagcgatccgtacgctcggtcgcctggaagcctgcccgcacccacgacggctccaatggcacagggtccatcggtcacgcaggcactcgaggttacagggtctggctccggcgctcgggtgcccaagtcgctgaagacgacccagggctatctcaaactcaagtcccgtcgctccgaatttgaaaacgagttcacttcggtcagcgaatccatgaaacgggtcatgaagtttgtcgagtcggggttgcagcgtggagagttccccgacaccacggtcgagggtgtcctcatgcatgcctttggttggaccgaggatgattgcaagaaatatggtaagttcctcaaggatccgacgaagcagtacaagaaggaagagacccccgtcgtgactgctgtgcagccgaacgagcgctatcagtacgagctgcatttcggctcaaccatcacgcgaggaacatcgaccactccgtatgacaccacagcagagcggagtcagttcctcggcagtggttatgccatctacgtcatggaccagcaggggaagttctatgctggaaaccagaaggtcggtcttttccaccactcctcgctaatcggaggaggccaggtcgcaggcgcaggggagctgcaagtcaagaacggcgaactgaagttcttgagcaacgaaagcgggcactatcgtcccggcattgaacaatgtctccaagtgcttgaagagctacgatcgcagcggattgatctctccaaggtggagttcaagttcgtgtcatcgtgggatgaaccaaagatctggaatgccgaacagctctggaacgtgctctcgcattctcaggtaccgtcttaggcccggtcggaacgagggtctctggtgaccgaatgagtcgttcgcagcttggcgacgtcgtcgcggcgtatcttgtcaatcggccttggggtgttcaacaggtggccgacgccacctatgccatcgaagttcatggtgaacatgggcagtggcagtcatacctcacggttcgagaggacgagcagcaggtgctcgttcacgccatactgccctttcgcatcccgttcgaccgccgagccgaggtggcgttgtatctcactcgggccaactacggcctggtcatcggcaacttcgagtttgatctcgatgacggcgaggtccgtttcaagacggcgatcgatgtcgagggcgctgccttgaccgaggcactggtcgaccacctggtgatcgcaggagccgtgacgactgatcgctacctcccggggatccatgccgtggtcgaaggtgcgacggctcgcgaagccatcgccgtcgtcgagggcgagcagggccaagagttgtgagggtggtcaacgctccgctggaggcggagtgtcggaacggttgctcgacgcgcgaacttggtgcatctccgcggcgggaaccggcgagcctgtgagcaacggtcgagctgagctgctcgtgggtccgagccaccctcatcgtcatggcggcggtcggccttcgggatctcgtcaccagggagtcctcgtcgagtgcgcgcagagacggcagatcggaggcgacgttactcagttggtggtgagggaactcctcgaaacgagtgcgtagccgctcaggatcaggtcgcgctgctcgttgtcgagggacgaggatcctcgtcccatcagcgcccttcagcgcgtaggtcaagaccggaccatcggtctcacggaggagtcgcggggcgaccctgacctggagatcaggttggatcacgtcccgccgagtggtgtcaactcactccctggctggcctcagctcacgacggctggctcctcctcggcgggcgaggccagcacgcgagcagcgcggaggggccgagacgtcttcgaggtgcccgccgtctgtcgtcgcgcgtggcagtttcgagctcgaccatggactcctctgacaggtcgtgttgctcgaaagcgccccatttcccgtgttggccgagcacgatagcggtgacgaggcgcccgagagctgcgtcgttgccgaagaccccgacgacgttggtgcgccgctcgatctcatgatgggcccgaccagagcgggttcgtgaccagatcgtgcccgaggagctccccgggaagctctcgggacggtgcgcgacctcctctgtggcctcggcgaccatggcgcgagccgctgggagtgtcgtggcaagggagtcgatgacctcgtcgtcctgggtcgggagcgctgccggggaggcttccctctgtgtcaatcttgagtgagaccactctcccgaccccattgttgtatcgagagggcggctgaccaaggagatcctgaggaccatgacgaccgacgagaccgcgagcacgcaccagactggagccatgccccccacccctgacccagaccctgaggtcccggagcgagctcgaggaccaagacgcttctccgcggcctacaaggcacggatccttgccgagtatgacacgcttgcaaaggccgagaagggagccctgctccggagagagggcttgtactcctcactcatcaccgagtggcgacgccaactgagaccgtgccatcgaggaagcactcgcacgcccaccaggacgccaacccgctgatccccgcgaccaggagatcgcacgcctcgaggcgccgcgccgagcgcctcgaggccgacctcgccaaggcccgcaaggtgatcgaggtccagggaaaactctccgcgcgcctggagcacctcgccaccgacagcgcgcccgcgacccacggcgagaccacgtgatcgacgaagccatcggcgaactggcgccaactgtcggggtacgcgcagcctgcgccgcccttggagagccccgggcgcgctatggccttcccccctccaggttgacacctgctataggaggaagggatgagccagacaccgaacccaccaccgggcgacgggccagttcgtcgtcgacgaggtcgctacccgagccagttccgtaaggacgccgcagcgttggtcctcgatcagcggcgaaccatcgccgacgtcgcccgcgagctcgccttcaacgaacagacccttggcaactgggtccgtcaggaacgcatcgaccgcggcgagcgcgaaggtctcacgagcgccgagcgcgaggagctgacccggctgcgtcggcaggtcaagcagctcaccatggaacgtgagctgctcaaacgagcgatggccttctgggtgaaggagggcaaccagtgagccgctaccactggattgccaaccaggaggccgagggcgtcccggtaacggcggcgtgccgagtagcgagggtctcccgccaggcctactacgcctggcgacaccgcaacaaccgaggccctgacccagagcacctggtgctcgtcagcgaacttcgcaccatctggcaggcaagcgacggcacctacggcagccctcgcatcacccacgagctgcgacgacgcgggttctgcgtgaaccataagcgggtggagcgcatgatgcgcgagctggggatggcagcgtgcccaccccggcgcttcgtgcgtaccacgaggcgtggggaagacacgccgctcccagatctcgtctgtcaggacttcgcccctcgcgagccagcgcgccggtacgtgagcgacatcacctgcgtcagaagcgacgagtgtaggcaccgggcgttaactgaccctagaacaccggaacgatagtgacccaccctccagagtaggttgccctcaagaagtcaagaagggggcagcccgatgctgaagggcaggtcgttgatgaggctattcgaactgcaggcagaggggctcagctaccgcgagatctcacggcgcacgggccactcccggaacactcctacgtcgctacctgccagacggcgcaggcacgaggaaagtcacccgcccccgacggggctccaagctggacccctccaaggcgcaagatcgaccggctggtggccgaggggctcacctcggccccggccatcatggaacggatcgccaagctgggctatgagggcaaggtcaccatcgtgcgcgactctgtgcacaccatccgccatatggcacccccgaggccggtgcccatccgccgctacgagaccccgcctggccaccagctccaggtggagcgggggatcttctcctacgtggacgcccgaggcgaggagcggcgcatcccagggctcgtggccaccctcgggcactcgaggcgcactgcgccacgtttgccccgagcgccgacagcgacgggttcatcggtgcactgctggaggccttctgccacttcggagggctcacgaagtggtgctcaccgaccacgcaaagaccgtcgtgctcggcggggatggcgagagcggctacgagtaccaccctcgagctccttgacctcgctcgctacctcggcatctcgatctcgctgtgtcgggtccgccgacctcaagaccaagggcaaggtggagcgctccatccgctacgccaaggagcacatctcgccagcccgccagttcgtcgacctcgcggacttgaacgaccaggcccgtcggtggagcctcgagcgtgaccaccggctgcatccgagcctcggtaccacgccgatggaggtcttcgaccgcgccgagcgtgatgccttgcgtcccctgccgccacgcaccgagctcgatgcctttgtgcgccgtccgagacgggtgagcttggacggcctcgtctccttcggtggcatcaactacggggtgccgatcgcctatgtcaagcgcacggtgtgggtgctgccccgaggtcgcactctcgagatcactgacgcaaccgggaaggtgatcgccacccacccgctcgggttcaagacccgcacagtggtctacctgccccagcagtaccaggggatcgctgcctcagaacctgcgctcgcactccgaggcccccgagctcgccaactcgccgaggtcgatgtcgaggtgcgctcgctcgatgcctatgaggcgcttgtccatgcttgaggtcgccgaagcactccttggcgagctcggccttgcccgcagcgccgagctgctcgcttcgaccatcgaggcagccacccaacgcgaggcctcgtacgcggacttcctgatcacgctgctcggtgccgagcgcgacgagcgtcgccaccgtagctacgagactcgtctcaggctggcgggcctgccccatcgcaagggccttggcgagttcgacttcgacttcgccaccggggtggaccgctccctcgtcaacgagctcgcctcctcgcgccttcgtggtgaacgctgcgggcgtggtgctcctcggaccccctggggtgggcaagactcaccttgcggtgggactcgccctgtcggcgctcgaggccgggcactccgtctacttcgccaccatggcccgtatggtggcagacctcgagggcatggtgagcccgaggcgcttgcgcaaatacctcgcccccaaggtgctcgtcatcgatgagatcggcaccggacgctctcgcacggggcagcaggggtcttcttcgaggtgatctcggctcgctacgagaccgggagcatcatctgcacctcgaacaagggcttcggggagtggggcagcctggtgggggacccggtgctcgcaaccgccatcttggaccgcctgctccaccacgccacggtcctgaacatccgcggtgagagctaccgcttgaaggaccgcaccaagcaacggctacccggtgggctgctgtcccaggcggccgaggccatggcgaaaggaggtgatgccgaacaccacgatctggggagctatcccctatagttgtgtcgcgggtgggtcagttctgactggtgatatcgggtcaaaagaaggccggtgcctacaacgaggggttctgctatctcgcctcggtactcgaccttggctcgaggcgcgtcgtcggttggtcactcgagcgtcgcatgccaggagaacaggtggtcgaggcgatcgagggagccctttcgactcgggggagccttgctggggccatcttccacagcgatcgcgccaatcagtacctctcccggaaggttcgccagctgtgcaccacgctcgggcttcgccagtcggtgggcagggtcgctacctggtacgacaacgccgtggcggaggcgttcttcgggagtttgaagcgcgagctggtggctcgctaccgcttcgcgaacctcgccgaggcccgctcagccatcgcagcccggatccaccgctacaacaccgtccggctgcactcgagcctcgggtacggaccgccaatcgagtacgagctcacctgggcccgggaggaggcggccgtggcctaaattcagactgtcaagcaaatggggggcagcccagctcgctctggcgtcgctccctggatccaccctccaacacggtcggagtgcattccgagcctcgggtacgtgccgcccgtgaagtacgagctctcctggggggcgaggaggtggctgtggcgtaacttcagactgtcaagcaaaggggggaggcccagggtgcctcttctggctagctgctaactgacacaccagagatcgctcgggggcccgccctcctggagtgcgggccggccggatatgacaccacttggtgggacgccactcagtttcctaccctaggattggctcatggcagctacgaacatcccgcagtatcacgagctgatgtggccagtgctgactgctctcagggagctgggcgggtctgccacggtcagggaaatctacgaccgggtcgtcgaaaacgagcatttctccgaggaccagcaggctgaatcgaccaaggatggtcgtatgtctgagatcgagtaccgcctccattgggcgagaacccacctgaagggaatcggcgcgatcgagaacagctctcgtggtgtctggtcgttgaccgacaagggccggacgatcacgctggaccagatgaggaccgatacgaaggcgtatcgagacgaggtgcagcgtcgggcaagacagaagcaggctttgaacagcgcagccgtagaaactggtgatgaggagccggagacctggaagaatcaacttatcgatcggctcctcctcatcccgccggacggcttcgaacgactcgctcagcgactgcttcgtgaggccggatttgtgaacgtaacggttctcggcaagagcggggacggaggcatcgacggtgtcggtgtgtaccgactttccctcgtctcgtttcccgtctacttccagtgcaagcgctataaaggaaccgtgacggcaggtgcggtccgagactttcggggtgccatggcaggccgtggagagaagggtctcctgatcacgaccggctctttcaccaaggacgctcagaacgaggccagccgtgacggagcaccccctgtcgagctgatcgacggggatcggctctgcgacctcctccgtgactaccggctcggcgtggacgtccgggagcgcgtcgaccttgagattgcgctcgattcctcgttctttgacgagtatggctctaccgacgctaccagcccgacctccgcttgaagcccgctgccaaacgccccacccgattgtcccctcttccgaggcgaagcggctgtcgtggtggatgaacacagggaggagctggcacgtgcgggcctggctccttggacttcgcggttcgtgtccccgctcgaggctggcgacgcgtgagctgccgaggcacgagcagtcggctggccgcgtcaacaacaagcgcatccatcgcctgtgggttgcagcgaggcgctcaaggtgccgatgcaagcgccgcaagcagccgctccgcggtcttggcgtcgcaggaggcgccatgggcccgatcaagcctcacgtcgtgtctggcctgtgactttcagttcgatcagacgagcgacgccaaggagccaaagctcctcgacgtcatcgacgagttcatccgagaggcccttgccacctaggtggcacgggccatctgtgctgatggcgtcgttcgctgtgtggaccagatcgcgcttgcgcggggagtaccagcctctgtccttggaccacggactgcgagttcgtggcgcgaggcagtggcggactggtgcagctacaacgcagacggggaccgttgtcatcgacccaggctcgccgtggcagaacgcctggatcgaaagcttcaacgggaggatgcgcgatgggcacctgaacccaaaccgcttcgacagcctgctcgaggccacagtgctcaggccaagactggaggaacgacgacaactggaccaggcctcagagtgcgcatggctgggtcagtcccgcgcagttcgcaaaggcctggcgagagaagcatgagttacagccacagaggggctggactcggcaatgggaaccggtcaaagtctcgagccgccgagagcgcgagcgccggggcggtcagtagctcccgccttcccgacggtgggccaggctcccaaccggaggtggatcagaccccaccaaccggtgggggccgagcactcgcgtgggggccgtagcgagatgtctgtcgctgtcggaacccaccatgggtagtcctcgcatcgtgggaagtggactcgggcggcgagcgcgatgacgggcggggtgtgagcgatcctcaggagtgcacgggcaagagatacgctccgatggtgtcgtgcacgcgtgctgggcacgtggcacgtctggtccgggcgcgagtgaggggagccgggacgccacttggctgcagggccatcgcatcggcggcgtacgactggactgattgaatcggattcccaatgggccaggaagcccacgccccttcggggccatcggcgaggcggggctgagctatgcctgagtgcggaggaagggtgggcgctgtcgggcgaagttacgtcggcggcgcggtgcgtcatcgaccgcgtacgacgcgtaccgatccgaacgccgtgacgaccgtggccgagagggctcggccgtcgtgcatgggttcacggtgccgtcgacgcaagcgcgagccgacgatggtgacgccggtgagcgcgagccgatcatgggccgcgacgacgagcttggtggttccgaacaggttgacgatgactacgcgtcggggcgggggattggtggcagggaactccactcgaagtcggcccatcgcgttcacgatcacgttgacggatcgcttgagctggagaactcccgatccgaacgcattgaagccgatgccaaccccgggctcgtgtggcgcgggcagctcgagcggccggaggtcggcgaggagtcgagcgagctcactctgcctacgcgcggcgtaggcgccctcgatgcgctcggcggcctcgtcgacgtcgagctcgccggcggcgagcgcctgacgaaggcgctccgcggctgcctctcgttcggcgtccgagcagcggtgctcgcggtcgtccgccatcgatgctgagcctataggccttttgcgcgcgacgcgggcgatgaggggatctgagtggacgatgagggtgtggggccaacccggtcagacagacgactgggaggtgggagcatcactggtgcgcgacgggtgacggggtcggcgcaggttgtcgaggatgcggcggagctcgccggtggtcgtctgctcggtaccctcggcgggtggcgtggacggcgcttcgatcgagtcctcgagatcgaggcgtggcagatcgaaaccgaacgtcgtgcctcgccccaggccgtcggaacggacccaggccgttccaccgtgtgcatgcacgatcgcagcgacgagtgcgagtccgaggccggccccgccgctcgcgcgtgagcgtgactcctccgcgcggtagaagcgctcgaagacgtgctgggcaaccgctggtgtgagtcctggtccgctatcggcgacgctgacgcggaccttctcgtcccactcgagcatcgcgaccgtcgggtcaatcccgccgaagagatcgctcacctccgtgggcgtgatggccccagggggcagaggagcgctgcgcgccaaggcctcgaccgtgacgtggacggtcgtgccgggtggtgtgtgggttcgtacgttggcgagcaggttcgtgacgacttgggtgagccggttgtggtcggcgaggacgagcaagccgtcgggggcgtccacggtggtcggacggcgatcgtcgaccacgttggcgtcctcgacggcatggcggacgagactgccgacgtcgacgggcgccaactcgagcgggagggactggtccatgcgcgcgagtgacaggagatcctcgacgaggctgcgcatgcgctgactctgctcgagcgagcgctgcaccgccatctgcgcgatctccgggtcgtagcccgagcgatcgacgagctccaggtaaccctggatcgaggcgaggggcgtgcgcagctcgtgactcacgtcggcgatgaactggcgcagtcgctccctggaggtctccgaggtggcataggcgctctggagccgtccgagcatggtgttgagcgctcgagcgagcgcctcgacctcggccggaccggattcgtcgacgcgagcctgggtgtcgcccgcgctgatggcctgggcactgcggcgcatccgctcgagcgggctgagccccagttggatggatgcccagcccacgatgccgagcgtgatggtcacgccgagcgatacgagcagctcggcgagcgcgaggcggccgacggtgtcctgcacgctggtgagcggttctgcgacgaccatcgtgccgccgaactcggggatctgggccgcgaggacgcgataggtgatgtcgctcaaggggtcgtgcagcgacactggtcgtccgacgggcacggcgagctcggcccgtccgttgctgaagcgcgtgagtggcggtgcctgctgccccacgtagagggtggggctgagtggggtggtgatggtcgagccgttggcgtagacgaaggttccccacgatccgaacggcaggctgagatgcaggtcttggttcccgttcgggtgcaggaccacctcggccgctgcgggggcgatcgactcctcgagggtcgtgtcgatgcggttgatcaggaacgcgtgcagcgcggtgatggtcgcgagatcgatgaccgcaacgccgaccacgagggtcgcgagggtgatcgcgagcagacggagccgcagggtccgttggcggcccccgtggtcgctacgccgactccgccgcacggagggagtagccgacgccgcggacggtcttgatcatcggtggaccgtagccgtcgagcttcttgcgcagatacgagatgtaggtctccacgatgtttgcgtcgccgccgaagtcgtactgccagacgtggtcgaggatctgcgccttggagaccaccttgttcgcgttcagcatgaggtagcgcagcagcttgaactcggtcgccgtgagctcgatctcgtgtcccgctcgcagcacctggtgggcatcctcgtcgaggacgaggtcgccgacgacgatccgagtgggcgcacccgtcccctggccggagcgtcgcaggatcgcctcgacgcgcgccacgagctctgccaacgagaagggcttcgtgacgtagtcgtccgagccgagctggaggccctggacgcggtcctcgacggcgtccttcgcggtgagcaggagcacggggacgtcgttgcgctcttctcgcagacgacggagcagggtgaagccatccatccctggcatcatgacgtcgaggatgagcaggtctggcttcacggtccggagtacgtcgagagcctcgcggccggacgaagcgacgctcacgtcatagccttcgaaggtgagcgccatctgcaggagctcggtgatgggcagctcatcgtcgaccacgagcacgcgaacgcccttcgctggcttgcgcaaactgtccatctgcccacctcgctgtcgtgttgagtgtaggtccttaccaggggccgtgcatcaggccgccggcgaggtgccgagcgtcgccgtcagggattgctgggccccgctctgggtcacgatcgacaacgtgatctgttgccccggcgacttggcgtggatcgccgtggcgagtgcgttcgcggaggtgacggcctgtccatcgaccgcggtgatcacgtcacctggctggatgcctgcgttggccgcgccggagccgggatagacgtactcgacgagcacgccggtctgcgaggtcggcaagccgagctgtgagtcgagcgtgggcgtgagtgtctgtatcccgacgccgaggaatgctccggatcccgccgtcgtggtcgacggtgacgtcgaggaaccggtgtaggcggtcgggttctgttcgatggtcttcacgatgggcagcaccgagttgatcgactcggcaaagcccaggttctgcgccgaggtctgaccgctcgaggcgatgaccgccgtgttcatcccgaccacgtccccttgggcgtccacgagcgggccgcccgagttgccggagctgatgggggcgtcggtctggatcatgccgctgatggtctcggtggtcccgaggctgtccgtcgcggtgatcgtgcggttgagggccgacacgatgccttgggtcaccgttggcgtgccttggagcgccagggcgttgccgatcgcgaccactgggtcaccgaccaccagcgcggacgagtcgccgaacgtgacggtcgggaggttcgatgcgccctcgatctggagcagcgccacgtcgtgagccggatcggtgccgatgatcttcgccgggcgcgagctcgactgaccgtagagcgtgacgcgcacgttgctcgccccggccaccacgtggttgttcgtgagcacgagaccgttcgacgagatgatcatcccggtcccggcgtcttcgaactggctcacgccgaagccgttgctcgtcgtgccggtggcggtgatgtccacgacggcaggctcgaccttggcgaggatcgcggggatgttcagcccgccttggccgctgagtgcggcgggctgcgccttgacctggcggatgacgatcggtgtgcgcgagccgccgctcgactgtccggtgaggcggaccacggcgtagctcgtgcccgccgcgacgagggcagcgagcaccgcggcggtgccgacgacgacgccggggcgccggcgtggcttggtgcgggtgggctgggtcgatccgaagctcgtgatcggctcggcggtcgaggtccacgacggttccgcgtgggcccaggtgacggtgtcgtcctcggcccgcggtagctcgtcggcgccgacggtgggtacctcgtcggtcggacgctcgtcgtcacccgacggaggttcgctcacctcggcggggtcagcggacgcaggcgcctcatcctgcggtgattcggccgcgtcgtccggctctccggcgacgggcgtcgcgtcggtgtcgtcgatgctcatctgtcctccctcgtggagctgggagcgccgctgggggcgccacgcataccagcatgggttctccacctttgcgggagcttaggctcctgtgggaggttcgctggaggatgaccgagcgcgcatgagctggacgttcgcgagcgcggcttgcgcaagctcggcctccatgcgcgttcgtcgggcggcgatcacgaggcgcttcgtggcacgctgggcctcggtgggagcggcgagaaattgggcggccacggcatcgacgcgtcgggcgagctcggcgtcgtccgccacgacgtcgtcgaggatgccgtacgctcgcgcttcgttcgcgtcgagctcgcctgcccccagggcgagggcgagggcacggtgcgtaccgacgacctctgggagcaggctgagtcctccgagatcggcgacgataccgaagcgcacctccggcagtgagcaacgcacccaccgcgtcccgatgcgaacgtcgcacgcgagcgcgagctcgaggcccgcaccgatgcaggcgccgtcgatggcggcgatggtggggatctcaagcgtggcgagcgcgaggaacccgcgctggagcatgccgatcgtctcgggacttggggtagcgccgagacctcgaagcagatcgagatcgatccctgcggagaagtgcttgccgctcccgcgcacgacgacgcaggcggcggcggcatcggacccgatctcggccaggagatccgcgaggtcgccgaagtcctccatgccgagggcgttcgccttggtggggttcgcgatcgtgatggtgcgcagcggtcccgaggtctccatcgtcagcatggcccgaccgtagctgacccaggcgaccttctgggttcacctgggccctacgatggagaggaggtggccaagggaggcgagtcagcggtggtccgaatcttcgatcgcgaggtcgcctgggagctcccctcgcgcagcagcgcccacgcggacgtcgtcgcggcgctggagccggcgacggagaagctcgaggcgtggcgctacagcccgatcgatgacgtctctgtcgcgtcgtacgccgcggtggcgaccgagacgatcgacctcggtgctgcccgcgcgctgctcggcgccgcgggtcggtcggggggagcagatgtcgtcgtcgggccgcgaggtctcgtcgctgcgcatgaggtcgagggctccgccgtggcgggcgatcgtggggccgatgagctgatcacgctcgacgaggagcccttcgcgacgctcgcgaacctgttggccccggagcgagtcgagcttcgcctcgacggtgcagccgaggccgcactcatcgtgggcgggagcggtcaccagagcgcagcctttgcctggatcaagatccacatcaccgccccgacgaccttgtggctcgtggacggagctggcccggagacgctcgcgagcgcgctcgtcgaggtcgaggtcgccgacggggtgcacgcctcgctgcgtcatctctcgatggggggtgcgggcagcatcggtttcctccagctgcgtacgcgtcttggggccgacgccgatctcgtcgttgccgaggtcgctgcccaagggggctaccaccgcacgcgcagcgacgtccacctcaccggcgaacgcgcgcgcgtgcgcatccgctcggccttcgtcgctgggagcggtgaagtggaggagtttcggacgttcgtcgtccacgcagcgccgcgcaccgcgagcgacctgctctacaagggcgcactgaccggttctggaacctcggtgtactccggcctgatcacgatcgagcccgctggtcatggatccgatgcgttccagaccaaccgaaacctgttgctctcgcccgaggcgcgcgcagagtcggttccgaacctcgacatccaggtcagcgatgtgcgctgctcgcacgcctcgacggtgggtccgctcgaggccgagctcgtgttcgcactcgaggccaagggcatcgaccccgatcgggcgcagcggatcctcgccgacggcttcttcgccgacatcgcggatctgtcggagggcgagcgcgcactcgttcggcgagctttggaggaacgatggctgtcgtaggtcgtgtggaggacttcgtcgacgcgaagccgcgtgccgtcgaggtcgacggtcacccggtgtgtgtggtgaggatcggcgatcggttcttcgcggtcgacgacatctgctcccatgcgcactatcggctctccgagggcgatgtctacgaagaggagctcgagatcgagtgctggaagcacggctcgaccttctcgttgctcgacgggcggccccagtcactgccggcgacgcgaccgatcggggtccatcgcatcagcgttcgtgaggacggctcggtcgaggtcgaactcggaggggacaagtgaccacgcccgcactcgtcatcgaagacctggtcgtcgaggtcgccgaacgtgaggtgctccacggcgtgagcctggcggtggagcccggcacgacggtcgcgatcatgggtcccaacggatcgggcaagtcgacgctggtgcgcacgatcttcgggcgaccgggctacgtccggcgccgtggggtgatccgcgtcggcggggtcgacgtgagcgaggcgccgacgtacgagcgcgcacgagcgggtctcgcgctcatcgagcaagacccggtcgaggtccctggcgtcgcacccacgacggtcgtcgccgagggcctggccgctcgtggtgaggacgcggcgcgcgcggtcgccgtgctcgagcgcgaggccgaggcggtgtcgctggatcgtgcgctcctcgatcgttggtacaacgtggagctctccggcggcgagcagaagaagctcgagaccgcgatcgccgcgtcgctccccgggcacgtcgtggtcggcgacgagatcgactccgggctcgacgtggacgcgctgcgaacggtcgctcgccggctcgagagtctgcgctcagaggggcgaggcttgcttctcgtcacccactacccacggcttttgacgcacgtcgcccccgacgtggtgatcgtgcttgtccagggtcgcattgccgagacgggagggatggaactcgccgagcgcgtcgaggctgaaggctaccgcgcctacggggtcgaggagggtccgctcagctgagctcgagcgcacgctcgagctcgtgtcggcgctcgacgacgtcttcggcgacgtcgaggaggacgaatccctcgaggcgcccgtcgcgatagtacgcgaacgtcgagtccgagcgttgctcctcgtcggcgtccgctcccggggtgccgagcacttggatgaggtgtccgtgttggtcgctccagccgaacgggacgtctcgccacggctcgtggccaccgaggaggttgcgggcggcgagctgaccttgggtggccgcggtctcgaagtgctcgctccgcacggggcgcccccaccccgggtgatgccaggtcgcgacgtcgccggcggcggcgatgccgtcctcgatccgtccgtaggcgtcgcacacgaggccaagtcccgcgacggctgggacggcgtcgctgatccagtcggtggcggggcgcacccccaacccgacgaccaccgtgtcggcgccgatgcgcgtgccgtcgtcgagagcgaccccgtcgtcgtcgaccgcgagcgcccggtggccggtgacgacggtgacgccgttcgcctcgtgccacgcaaggaccgtggtggctgctcgcgggccgagggctcgagggaggatccgctcggctgcctccacgaccgtgacccgacagccgcgttcgcgggccgtcgcggcgagctcgagcccgatgaagccagcaccgagggtcacgagccggtgacctggtaccagacgatcgcgaagccggagggcgtcgtcgagtgtgcgcagggtgagcgcgttcgggtggcgcaggggcgctgggtggagtggtgccgcccccgtcgcgatgacgaggagatcgaagccgatcggtccggcggtcgtcgcgaccgtacgctcgtcgaggtcgatgccctcggcgcgcacactcggccggtgggtgtaggcccccgacggggtgcgcagccgggttcgctccggtgcgacgtgaccagcgaggagacccttcgacagcggagggcgttgatacggcgggtgcggttcgtcaccgatgaccacgatgtcgaggtccgcatcgcgacgtctggcctcgagggcagcgcgatggcccgcgagcgaggccccgacgacgacgagacgcgtcatcgtgatcgtcggtcctagtcgacgatcgtgatggcttgcgtggggcaggctcgagccgcctggtcgaccagcgcgcgcaggtcctcggacggtgtctcgtcgagcacgtagaggtaaccgtcgtcacggacctcgaagatcgcgggtgcgaccgcttggcacaccgcgttggactggcacttgtcgaagtcgacctcgatgcgcattggctagctccctccctcggcccttcccaggctaccgaccccgtgggcgctcgtgccctggcgatggccgagtttgtcctatctcgataggggaaagcgggccggctatgctgaatgcgtggcaactcctgtactcgaggtcgacgacctgtgggtcgaggctgaaggcaccccgatcctgcgtggtctgtcgctggtgatccgaccaggcgagctgcacgtgatcatggggccgaacggctcgggcaagtcgagcttcgcgaacgtgctgatgggcaatccggtctatcacatcaccaagggcacgattcgctatcaaggggtcgatgtgagcgagctccccgtcgacgagcgggccaaggccggcatcttcctcgccttccaagatcccgaggccatcagcggcgtgtcggtcgtgcagttcctgcgtcaagccttgagtgctcggcggggccgggaagtgtcggtcctcgaggttcgttttgcgctcgccgagtggctcgagcgcctcgggctcgacccgtcgttcgcgcagcgccatctcaacgagggattctccggtggtgagcgcaagcgcaacgaggtgatccagctcgccatgctcgagccggagctcgccgtgctcgacgagaccgactcggggctcgatgtcgacgcgttgcgcatcgtcgccgacggcatcacgttggtgcgacaccaacatcccgagatggcgacggtcatgatcacccactaccagcgcatcctctcgctgctcgagccgacccacacccacatcctcgtggacggtcgactggttgcctccggcggtcccgaactcgccgagcaggtcgagcgcgagggataccagcagttccgagaggcggaggcgcttcgatgacagcgacacgtggccttgggctcgacgtcgaggagctgcgtaaggacttcccgatcttcgccgagcgcggtgcgggcttccactacctcgactcggcggcctcggcccagaggccgagtgcggtgctcgaggcgatggacgcctactaccgttcccaccacgccaacgtccaccgcggcgtctacggcctcgccgaggacgccaccgatcgctacgagcgcgcacgccgagccatcggccgcttcgtcaacgcccccgacccggagcgcgaggtggtgttcacgaagaacgccaccgaagcgctcaatctcgtcgcgcagggtctcggccgggtgctcctcggacccggtcgcgccgtcgtcctgacggagatggagcaccatgccaacttggtcccgtggatgatcctgcaggagcagctcgggttcgagctgcgctacctgcccttcgatggtgacggccagctggtgctcgacgacgcggagcggatcctcgacggcgccgccatcctcagcgtcaccgcgatgtcgaacgtgctcgggacgctgaacccgatcccccatctcgccgagctcgcgcacggagcaggtgccgtcgtggtcgtggacgcagcgcagtatgcgccgcaccatccgatcgacgtgcaggcctggggcgtcgatctcgttgcgatgaccggacacaagatgctcggccctacgggcatcggcgcgctgtgggggcggctcgagctgctcgagcagatgacgccgttcctcggtggcggcgacatgatcctcgacgtgacgctggaggggttcgtgccgaacgaggtgccgtacaagttcgaggccggtacgcccccgatcgccgaggccatcgggtgggaggtcgccatcgactacctccgcgaccgtgtcgggttcgaggcactcgccgcccacgagcgctcgctgaccgcctatgccctcggtagcttggctgatggcctcggggagcgcattcggatcttcggcccccgcgacccggagcgtcgaggcggcgtgatctcgttcgagctccagggcgtgcatccccacgacgtcgcccaagtgctcgatcgtcacggagtgtgcgtgcgtgcgggacaccactgcgccaagcctctcatgcgagagatcggccaggccgcgaccgcccgtgcgtcgctgtatctctacaacgaccgtgctgacatcgacgctctcgtcatggcactccaagacgcctggcagcgcttcaacgactaggagacctcatggacgacctcgaggacctgtatcgagagatcatcctcgatcactacaagcacccacgcaaccagggcgtgctcgacgatcccgacgcgatccgagaggagggcttcaatccgctctgcggtgacgagatcaagctctcgatcctggtcaagggcgaccggctcgccgacatccgcgtcgatgggcatggctgttccatctcgcgctcgtcggcctcgctcatgagcgaggcggtcaaggggaaggacctcgccgaggtcgatcgcatcatcgagcgtttcaaggcgatggtcgtcggcggtgagggagctgctgaggggctcgattcgctgcgcacgctcggtgaactcgcggcgctccagggcgtcgtgaagttcccggtgcgtgtgaagtgcgcgacgttgccgtggaactcgctccagaacgcacttgccacggctcgagctcgcggaggcgagtagcacccccacgagctcgatgcggtggggaggtgcgccgtcgcgggccttcgcgatcggcatctcgaggacctgcgtcggcgtctgacgcttggtgcgagcctctccgtgtggccggctcacaatggctgtggcggagtcagacccgtacgagcttcgcgcgttggcgagccacccgaacgatccggcgggaacctcatcggaactgcccctgccctgccacgacgatgggccagggtgtgcgcggcgcgtgcgctcgtcgcgagttcgggagatgtcgatgtggccatgcggcggatcctcgtcggctggacccggatgtttgccgcggccgacgtctctcgcgcccagcgggacctgtcatcggtcgggcgaggaggtcgggctcggggtgacggtcgagtcggttgcggggcgggccggcggtcgggtgcgaaggtacgcgcggacgctctctcacagagcacgcagtgcggagtcccacgccgacgcccacgccttcttcgccgcgagccatcgctgcagcgctctggtatctggccgcgctcggccctcagacttcgagccctcgtcgtcacgtggcgtcgcgccggcgggaccctcgcccagctctggcgtcgtcgtggccccgtcctccgtgcgcgccagttcgagccatgcccgcttgcgtcgctcgcactcgtgccagaggtcgtgacactcgggtgcctggcagcgctcgcgatcgagcatgaggttcgcgaactcgtccctcactgcgcgcgtcagccgctccgggccgacagcgtcgatcaaggcttgccattccatggacgctgtgatgaccgcatcgatcgaggcgtcggctcccaggtccgtcgccacggccaccgctgcgtacgctcgcagccatgtctcacgccatcgggaggggagttccagcgacgatcgggacctccgcatctcagagcgtcgtaggagcatcgcgagcagctcgttcacggcttccctggggtcactgatgtctgtcactgcaaggtactgctcgatcgcatctcggcgaacacaggagggccaacgtcggttctcagctcgcacggtgcacctgcctgatggatcggtcggtcgctgcggtcgagcgtcgttccgtcacggtggctctctctgcacgagctcgcgagtcatcgacgaccacggctggaccgctcgtgacgcagcactcttcgtcgtgcgcccagcaggcatgcgcccggtcggctcggcctgcctcgacgaccacgggtgcccttgctgggcgtgatgacggcgtcgagatgcccgagcccggcgaggctgatcgtgcccaggaaaccatgctttctcgtcgggtggccaaacgccggcagcgctcgatcgggatgcgggcgttgaggacgccctcgcctatcagccgcctgatcggtacccggtctttcacgacgatcaccctccatggtcgggcgttcacctctcaccggtgaagtcgttcgctcgtcgaacggcgtcgaccccccgacgacctcgcgtcgtcgtccaaggaggacgggatctgtcgagccgtgcgtggcgcatccgctgcatcgacgttgcgacctccgctggagatgcgggtgctctggcatctggcgtttcctgtcgtgagtgcacgctctcacgccttcatggcgaccgagatcaaaggggggcgagctgggttcgcccgagcgggcgtgcccgtccttggctggcgagtcagggggccgtcagttgccaatggcgtcccccgtcggtcgtgtgcagcagcgtgctgcatccatcgtgacagtccagtgactgtagccagcccgtcgtgggcgagacgaacacggccgagaaaccctggtgcaagagggacgggatgggcacgcgctcgacggaaccggtcgtgcgatgcacccggacgaggaacgagaacgacggcgtggcataggggctgagtgtggcccagaccgtcgtgggcgacgcgtagtcgatcgcgtcgatgtcgttggcgccgacgctgaggttcgtccaggagttcccgtcgttgctggtgtaggcgagaacgtcatcggaaggcggggcgccggtcgccgcggttgcgccgaggggacgcgtcgagccgatccacacgctctgggcggagagcgggtcgatggcgagcgggatcgtggacccggtgtggtgtagcgcggtcggcctgatcgggtcggtgatgggggagagatacgtcgcaccggcaccgaacccggtcgcggctgtggtctcgagggcgactccggtcccgttggcgacgaccgcagcgactgcgttggcgatcgacgagggcaccatgagggatggtcgctcaccggcacgatcaactgtgacgagctgaaggactccttcgggcgtctgcactgcgatcacgagcgccctctgccgcgcggtcgtaccgatcacgtgagcgttcgggcttgcgaggagcttcgagagcgccggagaactccatctcgtcgatccgaccagcacctcgagctggccgcttggcccgaccccgacgataccgaggcttccttgcgcgttgaagagtgagctgaccatcacgtcgggaaacgatcgcgtccagccggttcctggactgtagcgatagatgcctcgctcggagaccgcgacgacgctgccgttcgagagcgtgcgaaagttgtcgaactcgacaccgtgtgtcatgaaccaatgcggctggttggagacgaacgacggtgtcggcgtcgtagcaaggagcgggggcgacgcagggaagttggctccaggggtcggctggaagccgacgacgaggctcgatccgacgacctggaggctatcgggaaagacgccatcgagctgagggcccgggctcgagattgcctggaaggtggccgatccctgcgtctgggcaaagtatgcagtttcgccctgcgaggggctcgtcaccaggagatacgagctctgccgaccgaagtcgaagctcgcggcggttccagggtatcgaagtgccagcgtctcgagcaggtgccaggtcctgccaccatcggtcgtggcctcgacggtggttccttgcgctgcgctgagcaccacgtagccccgcgctggcgtcacgaagccgacgccgatgatcgtcgggcctgacgagaagtgatggagcaggcgaaagcgcgttccctggtcgaccatcgcgtagagatcgccgctctgcagtgaggcgacgaagccgtcgttgcggtcgaggacgtcgaggagagggtctggccctggaagccgtgcgaggtaggagaacgcgccgtctcggtaccggagcagcaccgggttccctccagtggccgatgtcgaggccagatagacggtaccggtagcggtgatcgagctttggaggatgtcgagcggaagctgctcgacagccttggtggctgtggttttgctcgccaccgcgggtcgcgaagcgatcgcgccacagcccgcgagggcgagtgacagggcgagcagcgggaggatctccttccgcggccacgagcgggatgttcgccccatcgcgtctcgaccactcgttggggaactcatgggttcatggtagctcacagtgcactcccggattgggggtccgcgaccagcgatgctcggtcgagttggggttcaaggtcgcgctcggtcgtgcccggggagacgccatgagcgtgcggggctcggtgtccctggcggcggagcgcccgggtggccacaggcacgttcctccaagtgcggcaccagcgagcgccttctcgtgtgtcgtcgcgaacggcctcgacagcctcgtccaccgggtctgccgcttgatgaaaccgacaggacgatcccatcgtgctggtcaatgtggccacaagggtgttcgtgccagcgcgcgctggctgtcgagcgggtcgtcgtcggacctgccgtcgccagtgcaagaaccgcacgagcggccaacccacggtgagctgtgcgcatccacccgcggatctcgctgtagttgatgagatgcatatagtatatggttgacatggagcgcatcatgaacccgtacaccccgggtgctggggatcgcccaccggtgctcgtcggtcgtgagcgccagctcgccctcgcagaggccatgcgccagcgcatcgaacacggcttctcggcaccaccgacgttcttcgtgggtctccggggagtcggcaagacagtgctgctccgggagatcgctgaccagtttcgacggcatggctggctggttccctacgcggaggcccgccgaggtgcttcggtggctcggatgctggtgacctacgtgcacgaagccgagaactctgcgcccgtgaagggacgccttcgtgaggctctggcccagttggtgcgccgcggtggttcagtggaggctcttggcgtgggggcgacgctggggccagagaccgtcgactcgacgacacgcgctgcccaggatctcgagcacatgcttcgcagccttggtgaggcggccaagagcgacagggtgggcgtggccatgctcatcgacgaggtccagactctctcgtccgagaccgtccgggagctcatctgggtcgtccagaaacttcgccaggacctacccatcgctctcatcggcgcagggctcccgcaccttgccagcgtcctcgccagcgcggtcacctacgccgaccgcttccgctacgagagtacggacaacctcgatgacacggacgtacgagctgcggtgcgtgggcccgctcacgagcgcctggtcgagtggagcgacgacgcactcgacctgttgtgcacgatcgccaagggctacccgtacgccgtgcagctgtgtgcctacgaagcctgggagcaggcggctcgcccgggcgaccctcggcagtgggtcgcgatgccgttgtcggcccagtgggcggtctcggagttcggggagcgcgttggacccccgtcggtcgagggccagcaggtgcatgccatcactcgctcgcacctcgatgccgcgatgccgcgcatcatcgaccagatgcgcgcgggcctgttccgctcacgctatgacgggctgaccccgaagcagttcgcctacgtcgaggccatgcttgcggagctcgagcccgactcgacggctcccgtctcggccatcgcccagcgcctccgcgcgtcgctgagtgcgctgtctcccgtgcgcgatgccctcattaggaagggtgtcatctatgcgccggggcgcggccgggtcgcctttgccgtaccctggttcgcgagcttcctggcagaggagatcgttgcgaccgagccgagcagctatgaagcgatccttcccgggcttcgtgctcgcggcgtcgacctcgagcctccaggcggttccaccggtgcccctcgatcgccgactccacctctgcagtcctctgactaaggatccgtaccgctcgattcgacgggtgtcgcggccgcgcggaggcatctgtctcgttcggccttgcgatggtggtcgcgtacagtcgggagtcgagcaacagtggagagaacaggtgatcgatgccgagaccgggcggctcggccccgtacgggtcgtcgtcgctcccgacaagttccgtggttcgctgacggcggccgcagcagcgcgcgcgatgagcaagggcatccggagccagatccctgactgttccgtcgtcgaggtgccgatggccgacgggggtgagggcacgctcgaggccctcgaggcggcagggtttcgcgtgcgaggcccggtgctcgtccatggaccctacggtcgccgcgtgcaggctcggtgggtccggcgcggacccatcgccgtggtgcaagcagccgaggctgtgggtcgtcgggccgtagggtcggatcggctgcgagcccccgacgccacgacgcgtggcgtcggtgagctcatctcggccgctctcgaaccaggcgtgcgcgaggtcgtcgtgagcctgggcggctcggtcacgaccgacggcggcgccggcatgttggccgcgctcggcgtcgagatcgccgatgcgctggggagacctgttggcgatgggggcgcggcactcgagcatgcagcctcggtgtcggtcgctcgggtggacccgcgcctccgggcggtgcgcatcgtcggcgccgtcgatgtcacgaacccgctgctggggccagatggggcagcacgcctcttcgcgccgcagaagggagcctcgccggtcgaggtcgaccagctcgaacgcgccctctcgcacttcgcggacgtcgttgccggttccctcggacgcgacgctcgcgcgttggccggcgcaggcgctgccggcggtaccggctttgcgctcgctggcgtgctcgacgcgatgctggtgagcggcgcttcgctggtgggtgagctcacgggctgctggagcgcgctcgatggggcatcgctcgtcgtgaccggggagggttcgctcgacgcgcagtcgctgcttggcaaggtgccgatcgaggtggcgcgccgagcgcgagctgctcacgtgccctgtgtcgccatcgtcgggcgttgcgagctcgaagcagccgacctcgccgaggccgggctcggcgaggtggtggcactggtcgactgggccaacgatgccaccgaggcgcagcgccgagctgcggcgctcatcgcgatgctctcggcgcgcctcgctcgacgctggtgcgggtagctgcgcgttggcgcggccgcctcgtcactcgccgatgtagctcatgacgtgcttgatacgcgtatagtcctcgaagccgtacatcgacaggtccttgccgtagcccgagtgcttgaagcctccgtggggcatctcggccacgatcgggatgtgcgtgttgatccagaccgcgccgaagtcgaggtcgcgagcgacgcgcatggctcgagcatggtcgcgtgtccagacgctcgatgcgagcccgtactcgacgtcgttggcgaggcgcatggcttcggcctcgtcctggaagctctggaccgtgatgatggggccgaagcattccgaacgcaccagctcgtcctcttggcggaggccggcaaccacggtcggctcgaagaagaaccctggccggtcaacgcggttgccacccgtggtgatctgggcgtagctggggaggcgctccacgagcccgcggatgcgctcgagctggttggggttgttcagagggccgaagtagacgtcctcctcgtccggggcccccaccttggtcgcggcggcctgtgcggtgagggcggcgaggaaggcgtcgtgcgcgctcgcctcgacgaggacgcgcgcggcggcggtgcagtcttggcccgcattgaagtagccggctccggcgatgcccgccgcggccttctcgaggtctgcatccccgaagacgacgaccggcgcgttgccgccgagctcgaggtgcacccgcttgatgtcctgggcggccgcgagagcgacttcgcgcccagcgcgcaccgatcccgtgatcgcgaccagctggggggtcgggtgggcgacgaggcgtcggccagtgtcgcgatcgccgaggaccacgttgaagacccccggtgggaagatctcaccgatgagttcggcgaggagcgtcgtcgacgcgggcgtcgtgtcggatggcttgagcaccagggtgttgccggccgccagcgcagggccgatcttccagatcgccatcatcagcggatagttccacggtgtgaccgcggcgcagacgccgatgggctcgcggcggatgaaggaggtgtgatcggccatgtactcggccgccgaacgaccctcgaggttgcgcgcggccgcggcgaagaagcggatctggtcgacgctcggcgggatctcctcgctgagcgtcagcgctcgcggcttgccggtgttgcggacctctgcctcgacgaggtcgtcggcgtgcgcctcgatcgcatcggcgaggcggaacagcagcaaggaccgctcggacggcgtcgtgcggcgccacgtctcgaacgcgttggcagcggcgcgcatggcggtgtcgacatcgacctcgtcggacgcagggctgtgaccgtagacgagacccgtcgatggatcgacgatgtcgagcgtctggtcggcgtgggcgtcgacgaacttgccgtcgatgaagttgcggaacaccgtcgtcatggcatcctcctgggtgtcgatggtggctgtccagtgaggggacgcttctagtcaactacatctgagccgcgcttgcaaccgattgcgtcaactttccatggcaattctgcgctttctgttgacgaagccaccaaaatcggtaagaatggtggcgcacgtcggttcctgggtcgtaccgggtcggggagccgacgtgggtggcgttcgggttgcacccagcggtcgcacacgaacgaactcggaacggagggaggtccatggcgcagcgtcgtgagccgtctgtgcgggccttccccatgattcgtggccagggcttcctcactgccgatcgagccgagcgcaacggggatggggagcgggcgcccgtccagctcgatgccatctcgaagcagttgatctccctgctgcaggtggatggacgcgcgtcctatgcggcgctcgccaagcaggtcgggctcagcgaggctgcggttcgccagcgtgtccagcgtctcgtcgagtcccaggtcatgcagatcgtcgccgtcacggacccgaagatggtcgggtttcgtcgtcaggcgatggtgggcatccaggccgtcggcgatctcgaggcgttggcatcgcagttggcggcgattcccgaggtcatctacgtcgtgatcgcagccggcagcttcgacctgctggtcgaggtggtctgtgaggacgacgatcatctgctgcacctgttgaacaccgagattcgtccactcgagggcgtgcgatcgtcggaggtgttcgtgtatctccggctggagaagcagacctacagctggggaactcgctagggacggtgagtccgtgtccgtcgcgtcgaggcgcacaccatcgaggtcgacaatgaagttcgacggtacgcgagtcggagcaagaagggaaggaagaggatgagcgagcagcacgacctgtcggacgtggcccgtcggcacctgtggatgcacttcacccgcatggcgtcgtacgacgagcacgaggtgccggtgatggtccggggccagggcccctacgtgtgggattcgaagggcaagcgctacctcgatgggctcgctggcctgttcgtggtccaggtagggcacggtcgtaccgagcttgcggaggccgcctcgaagcaggcgagcgagcttgcctacttcccgttgtggagctacgcccaccagccagcggtcgaactcgccgagcgccttgcggcattggcccccggtgacatcaaccgcgtgttcttcacgaccggtggctctgaggccgtcgaatctgcatggaagctcgcgcggcagtacttcaagctcaccgggcagccgaccaagacgaaggtgatctcgcggaacctcgcctaccacggcacctcgatgggtgcgttgtcgatcaccggcctaccggggatcaagaccccgttcgagcccttggtccccgggtctatcaaggtggacaacaccaaccattaccgctgtgtgcactgcagtgcggccgagacctgttcgctcgcgtgtgctgacgacatcgagcagcgaatcctgatggagggccccgagaccgtcgcggcggtgttcctcgagcccgtccagaacgcgggcgggtgcttcacgccggcgccggggtacttcgagcgggttcgggagatctgcgaccgctacgacgtgttgctcgtctcggacgaggtcatcactgggttcggacgactcggcgagtggttcggcgcgatccgctacgactaccagcccgacatcatcacctgcgccaaggggatgacgtctgggtactccccgatcggggcgatgctcgtgtcggaccggttgatggagccgttcttgcatgacacgacgacgttcctccacgggatcacgttcgctggacatccggtctcggcggcggtcgggctcgccaacctcgacatcttcgagcgcgaaggtctcctcgaccacgtccgtcgcaacgagccgctgttccgggcacagctcgacaccctgctcgatctgccgatcgtcggtgagattcgcggtgctggttacttctacggcatcgaactcgtcaaggatcgcgccacgcgcgagaccttcgacgacgacgaatccgagcgactgctgcgtggtatcctcaccccgacgctcttcgagctcggcctcatctgtcgagcggacgatcggggcgatccggtcgtgcagctctcgccgccactcgttgcgggcccggagcagttcgaggagatcgtcgcgatcttgcgggaggcgttcgagcgcgcttgggctgcgctgtgatcgatggcccctcggtggcccaattgtgtggcgaccgaggggccgatgcgactcactgggattcgacggggtctcgcctactacgcacgtgctgagctcgcggatgagccgtacgcgccccgggcgttgctcgggagcggatggcgagagtatccgcacgcggcagcgctcgcgctcgacgagctggtgctcgaacccgccccgcgcacgctgatccacgcggtcgatctcaccatcgctgcccccaaggacgtctcggtcgtctggggtctcgccgccgagccctttgccgaggccgtggccgaggcccatcgaggcgcggtggccgacgtcgtcacgtggctcgagcgccttgacctcgcccgtgtggtggacggggaggcggtccccgccagcggcgtgcgcggggtcggcgcgcaccatcgcttgtcgcgcgctggtgagccccacctgcacacccacgtcgtcctcgccaacgcgatcgaggtcggcgggcaggtagcgcccctcgaccatgggcgcctgcggcgagtgttgccggccctcgagctcgggtatcgggtcgagcttgctgctcggttgcgtcgtctcggtctcgtcgtggacggcgatggcctcgggcgatgggcggtccgcggcctcgatcgtcgggtggccgatgccttctcgaccaggcgcagcgaggtgctcgcccaggcgggctcgaccgcctcggcccgagctcgtcaggtggcggcactcgcatctcgacgagggtgggccgagggacccgtcgacctagtgaacaggcgcgagcgatggcgcgaggcggcacgacgcgagcgtcgcgacgggcccggcgagcgcggtgcggtcgctgcgaccgcccaggccaaccgtcatggagagccgatccgtatcgccgacccgttcttcgcggagttctcctggcaggcccgcgctgtgctcgatgccggccagggcctcggcgacctggtggcagcgagcctccgagcggccgtcggaccggctcgggcgcgcgggttgctcatcggcgctcggatccgggctgcggggagcgagctcgccctcgatggttcgctcgtgcgtcgctacggagcgctgccgctggccgatcgactggcgctcgcgggcatcgacctcacgcgccccatcgtcgaggtgtcgagtcgcgatgccgtgcggatggcggacgagctgcggcgtgcgaccgggcgagagcacgtgcgcgtggtcgcacggagcgatgccgaggccgccctgctccagcgcctcggggcgttccgcgatggccgccatcccgcccgggtcgtcgtggatgccgtccatcgtgccccgagtgacctgcgtgccctcgtgacgagtccggaacggaaccttctcgtcgaggtgcgtcgtcggcccgtcgtgccgtctcgatcctccctgtcgctccagcgtgacggtcgtcgcatcgagctctgcgccgatctcgagaccgcgctcgaacgctgcggcgcctccgtcgccgaggtgcttgggcgcggtgaggacgtgtggccggtggcggtcgtcccggacactgcgtacgcacggcagctccgacgcgtggtggcacgtgcgttcggggtcgatccgcgctccccggttcctggagagccggtcctcgtgccacggactgggcgaggccgcgtcgtcgacgtgtcgcgcgatcgggtgacggtcgagacggggggcgcccggatcgacgtcgccgcgagcgaggtggtaccgctcgccatcgcgaccgaggggagggctccgatcgccttggggcccgacctccagcggggggtcgaggtgtctgtagtcgtggcgccggagctcgagcggttcgtcgcgacttgccgagcgctcgggatggatccgcggcggatcgaggctgctccgccacgcgaactgctgaccgatccgaccgcccgagcgctgtggcgtcaagcccgcgggttgcatcgctcactgctcgggcggctcgagctcggcgagcggactcgtgaggtcgatctcccgggtctcgaccggggccggtggcgttgaggagtcttgcgaggcccctgcgatggcggtagcctcgtctcagagccgttgctctggtgcctggggagaggtcgatggttggcgtcgtcaccgcgtcgtcattgctcgaggtgacaccgccctacggcggcgtcatcgtgctcatgctcggcgtgcttgcctattgggtcggggtgccgaggttggcgcgtacgttgagcatgtccccgaagcgggttcgtctccgcgacgtcgcgacgcggcggcagcgactcgcgtggagtgcggcgcttgcgatcgcgatcgtcgacgagtcctggcccgtgctcgagctcgccagacgcatctcgctggtggcctatctcctccacaacctggtcatcgtgctcgtggtcgtcccactggcgctgctcgggttgccggggtgggtcgtctttcgcctcactgagcgtcgatgggtggacgccgtcttgtcgctcattgcccgcccgctggtggcgaccgtgctgttctgtggcgtcacgatcctgtcgatgctctcgcccatcgttgaggcacaagcgcgatccctggtggtcttcgtctacctccaggtcgtgctcgtcatcgcgggtgtcgcgctgtgggtaccggccctgcgcctgcaaccgggcgtggagaagctgtcgaccggcggtcgggttctgttcctcttcgctcagagtctgattccgtcgttccccgccgtggcgctgatcttcgcgaagcactcgttctatccgttgttcgcacgcaacgtccacatcgtcttcggggtgtcgggcgtcggcgaccagcaacttgccggtgcgttgtcgaagatcctcaccctggggatcctttggaccacggccgttgttatattggcgagggcccagacccgcgaagatcgcggggacgacccggagcccatcacctggctcgacgtcgagcgagagctgcgccgtagctcgtccgggtagccctcgggccagaaccgtgaggagcacgcgtgcagcttcgcaacgtggcgatcatcgcccacgtcgaccatggcaagacgaccctcgtcgacgccctcttgcgccaggcgggagcgttccgcgagggcgccgagaccgaggagcgcatcctcgactccatggatctcgagcgcgagcgggggatcaccatcttgtcgaaggcgaccgcgatcccgttcggcgacgtcatcgtcaacctcgtcgacacgcccggtcacgcggacttcggtggtgaggtcgagcgagcgctctacctggccgacggcgcggtcctgttggtcgacgccgcggagggcccgctcccgcagacccgcttcgtcctggccaaggccatcgagcgcggcctcgcgctcgtcgtcgtgatcaacaaggtcgaccggcaggatgcgcgcccgcacgaggtgctcgacgaggtgctcgaactgttgctcgagctcggtggtcccgacgtggatctcgacgtcccggtggtctacgcctcgggacgcgcggggcgggccgacctcgagttgcccatgcggagcgaggacctcacgccgctcatcgagacgatcctcaagcacgtgccggctcccgatgccgatcccgacggcccgctgcgcgcccaggtgctcaacctcgacgcctcgacctatctcggcagactcgccctcgttcgcgtgcacgccggtcgactgcgccggggccaaagcgtggctcgggtcggcgtcgacgggcgcgtgagcactttgcgcctcggcgagctgttccggatgcacttcctcgagcgcgtgcccaccgacgaggtcatcgcgggcgacatcgccatcgtcgcaggtgtcgaggacatcggcatcggcgagtcgctgtgcgaccccaacgatccggagccgctcgcgccggtgcacgtcgacgagccggcgatcgccatgacgttcagcgtgaacacctcgccgctcgccggacgggagggcaccaagctcacggcgcgcctcttggcgcagcgcttggcacaggagatcgtgggcaacgtctcgatccaggttcgccagacggagcgcagtgatgcgttcgaggtccagggccggggggagctcgcgctcggggtcttgatcgagctgatgcggcgtgagggcttcgagctcaccatctcgaagccccgcgtcctcacgaagctggtcgacggcgaagtgtacgaaccctacgagcgcctcgaggtcgaggtgccagaggatctcttcggagcgctcacgcaggtcctctcaccgcgaagggccgaactcgtgacgctggagcactcccagagcggctgggtgcacacggtctattggatcccggccagaggcttgctcggcgcgcgaggcgagctgctcacgcagacacgcggccaagcggtcatccatcactccgccgatggctacggaccgtgggtcggcccgatccgcccccgggtcgcggggagcctcgtcgccgaccgggctggtgtggccacgacgtacgcgttgctgtcgttgcaggaccgtggcacgctgttcatcggcccgggtgacgaggtctacgagggcatggtcatcgggctcaacgcgcgtccaggtgacatggacgtgaatccgaccaaggagcgcaaggtgacgaacatgcgctcgtcgaccgccgaggaactcgtccgtctgaccccgccacgacgcttgacgctcgatagtgccttggagctcatcggcgacgacgagtgcgtcgaggtgacgccgaaggcggtgcgagtgcgcaaggtccagctcgtcgggagggagcgcgccaaggcgcgccgatcaggcgagatcggggggacggaggcgtcgtagcgggagctcccgcctggtgagtggccgggtggcccccaggcggtacacctcccggacgaggtgggcggaaggtccgggcacctcgaacagcacgacgcagtacggcgctcgtgacctgggcacaccgagggtcggcccgacacgaccgggcacctcggcgaggccgcggaagtgggccttcgctggtgcgtggacgagcgccgcctcgagtggacgcacacagttggccgcggacgtcccgccggcggagcgcgctccaccacaggcgcagagcgcggccgcgagcaccaggctcgtcacgagctcacgtcgtggcattggttggcctcctggcgatccagaagtaggccgcccatccgatcggcagccagatccagtagctggcgagtcgatagaggatgacggctgcgagcatgggcaccggcgctcctccgaaggccacgagcgcgacggtgatggatccctcgacgacgccgagcccgcctggcgtgatggggaggttcgtcgcgagggcaccgacgacgtaggcactggccgcggccgccacggacacgtgggcatcgacggcggcgagcgcgacgaggagcgcgccgaagtcgaaggcccagttgccagccccgaggccaatggaggcgccgagccggcgcggtgggatgcgcagcggctgcagacggcgtgcactcgcggcgaggcgtcgccatcgcacgcgggtggcgagacgggtgaggagctcggcgacccaggccgacaggcgctcgagctgccacagggcgagcgcggcggcgatgccgacggcgacgatcagcgcatcgtcgagcgacgagagcacgctggacgcgggtgcgtgcaccacgagcgcgagtgcgaacagggcgatcagggtacccatcgcgaccaggttggaggcggcgatgaccgaggcggcggcgaggacgtcgacgtcggcgtcgtggagctgggcgaccacccagacggcgctcacaccggcgccgaaggggatcgagttggtgatcgacagggctgcgagcgagatcgcgaggaaccggacccacccgagtcgcgttccgctcgggaggaggacgtaggtcatgagcgcccacgccgtgtcgctggccgcctccaggacgaacgcgatggcaccgaggacggcgttcgcgtggaggacgatggcgaccgatcccgagagctgggcgcgctgggaggcgagtgcccaggctgcgaccgcgatcccgacgagaccgaccaggagccgccagtggtggcgaacgcgcgccagtcgggccggtggagccatcgctcgcgcaggctagtgcggcgcaggctggccgtagacttggccggcggtgccggggcggcacctcgggcgttgggagggcggcacgagcgagttcgacgtcatcgtggtcggggctggcgctgccgggctggcagcggcgtcttacctgcactacgcaggcttcgaggtggtcgtggtcgaggccgaggcaacggcgggcggtcggctccgcaccgacaccgtcgacggctaccggctcgatcgtggcttccacgtcgtcctcgagggctacccggagcttcgccggctcctcgcgccagggaccaccggcctcgttgggctcttccccggtgtcgcactgctcgcgcccggcgcgccggttcgagtcctcgccgatccgcgccgcgtccccgcgaccgtcgcgactaccgcccgcgagctctggcatctgcgtgggatcccgcgcgctcgccggctcgtcgagctcgtcacgcgtgccgatccgtcggtcgcggatctcgtcggggcgctgcccgagccgctcggtcgtcggctcgccgggcccttcgctcgtggggtcctgctcgcacccgagctcgacgtgcccctgtggcgtgcaggcgaggtggtgcgtgggttctggcgtggccgtgtcggcctgccacaggggggcatcgccaccctcgcggacatcctcgctcgggacctcgagggtcggatcaggaccgcgtcgccggtcgccgccgtcgagtccggtggcgtcgtgctggagagcggggagcgtctcggggcaggcgaggtcatcgtggccgccggtcccgaggccagcgctcggctcctcggggcccccaggctcaccgatggccttcgttggcgagcccagggctatgcgcacctgcgggtcgcgggacccgtgctcgagctcccggtcgtcgggctcggtcccatggacgagccgatctggaccgtctgtgaggtgggggccgcggacccgctgcgagcgccgatggatcgggacgacacgctcgtgacggtgagcttcgacccgacgctcgatccggcggacgtgcagagggcggcggccacgttggtgcccgcgctcggatcggccgagctgctcgcgatcgacgtggtggctcaggcgctcccagcgcttcgacgtgcgcctgcggttcgcatcgcccggggcgtcacgctcgcgggcgactggaccgcatctccgagtctcgacggcgcactcggatccgggcggcgcgcggcggaggcagcggcccgtgcgctgcgaggagcggggagtgaggatcgatgatgcgtgaggtcgaggttcccatcgaggcggcgagttcgggctcggtcagtgcccggatgcgctaccgcgatggccgtcgcgtgatgtgggtcgcctcgcgtcccaccacgcgccgtggggcgctctctgagcgcgacggccatcggatcgcgcgcgcggccgacctcgcgaaccggctcgggatccccctcgtgctcgagctgtcgacctcgggagcgaagatcaccgacggggtctcggcgctgcacggatgggggatcgcggcgagcgcgttggcacgctgctccgggcgcatcccgatcctcgccggtctcgtggggcccgccgtctcgggaccggccctgctgctcggggtcgccgactgggtggtcgtcgcccccgatgccttcgcgttcttgtcgggaccccaagccgtccgcgaggtcaccggcctcgacgtgtcgaaccagacgctcggtggctcgcaggtgctcctcgcccggtctggggtcgccttcgaggctgccgacgatcgtcggggggtcgaagaggcgatctggagtgtgctcgactacctcccggactccaccgatgaggtagcccgacgcatccaccccatcgatcccgatccgatcgacctcgatcggctgattccggacacgccgacggcggcctacgacgtccgcgacgtggtgcggggcatcgtcgacgagggttcgttccacgagctgagacaggcgtgggcgaatcagctcgtcgtcgggttcggccgcatcgagggccgcgcggtggggatcgtcgcgaaccagcccatgatcatggccgggacgctcgacatccaggcggcccagaagggcgcccgtttcgttcgtctctgtgacagcttcaacctgcccgtcatcacgatcgtcgacacgccgggctttctcccgggcaaggacgtcgagtggcgggggatgattcgccacggtgcagaactggcgttctcgtacgcggcgtgccagacaccgcgggtgtgtctcatcgtgcgcaaggcctacggcggtgcctacatcgtgatggactccaaggggatgggcaacgacgtcaccctcgcgtggccgtcggcggagatcgcggtcatgggggcccaaggtgccgtggagatcttgcaccgtcgtgccgacgaggaagcgcgcgccgcggccaaggccgagtacgaggaggtctacctgaccccgtggatcgcggccgagcgaggctacgtcgatgaggtgatcgagccgtccgagactcgttcgcgcatcgctcgcgcagtcgagctcctcgtgaccaagcaggagcacctgcggcccgccaagcacgccaactcgcccctgtgagtcgccgtggtcgacgtcgcactcgagcgcctcgtgaacgtcgtcacgcttctcgcggagcaccccacgccgctcgagcgcgacgagatcgtccgcaccgtgccggggttcccggctagtgacgctgcgagcgcgcgcgcgttcgaacgcgtcaaggaaacggcgcgcagtctcggcatcgagatcgagaccgtcacgttgcccggacgcagtcgtgtgggctatcggctccggcccacgacctggcagctcgaactcgacgacgccgaggtggcggcgctcgaggcggccctgggtgcggtgtgggtcgccggcgtcgagcccggcctcgcccgcatcgggctcgcggtgggggcggtgcccgcgcgtgggcgacggtcctcgctgctcgatgcgcccccggccatcgtgaccgcgatcgccgagcgcgccgtcatcgagatcggctatcgcggtgagcgtcgtcgcctcgccccggtcggcatcggcgcgagatgggggcacgcctacctcgtcgccgccgacgacgacggggtgatcaagacctttcgcgtcgatcgcatcgacgagccgatcgtggtgctggaggcccaccacgagatcgcgccggtcccgatcgacgaggtgctgcctcggcaccctcgcgagctcgtcatcgaccgcccggtccaggtcaccgtccaaggtccgccggagaggctcgcggccgtgggtgccgacccggagacgggttcccttcgtgcggccaatctcgacgtggtcctggccgacgtgctcctgcacgacctcgcgttggtcgggccccaactggcgcgcgagcgcttggcggatcgcctcgcgacggccgagcgggcgctcgccgcgacgccgaccgcgaaggtgcctcgggccggcgtcgagcgcacgaacctcgcgactcgctacgccatgctccagaccatgctcagggtgctcggcgagcggggtcgagcaccgctgtcggagttggcggcggtggcgggcacgacgcgagagctcgccgccgaactgctcgagacggcctcgctgtgcgggttgccgccgtactcgccggacgtcttgctcgaggtcctcgtcgacgaccccgacggcgaggtcgaggcgcggctcgagcgaacgccgccacggggttcgctcgcgatcgaggaggccgtgagcgtgggggcgaccctcgaggcgcttcgtgaggcactcggcggcaccttgccgccggtgctcgatcggctgcgtgcgcgcatcgccgagggtctcggtgtcgtgccgcggctcgtcaccgagcctggcgagcgtgcgtcgctcgtgaccgtgcacgaggcgatcgtgctcggcgcgtgcctgcgctttcgctatgccccgatcggtgcgccgagtggcgagcgccgtgtgcgccctcgtgaggtccacgcgctcgatggcgtctggtacctcgacgcggtgacgagcgacgggaggatccgcacgttccgcctcgatcgcatgagcgagctcgtggtcgaggcgggttgtgacatcgaggagtcggatcgatcgcctgcgacgacgaccgtctcgttcgtcgtcgacgtgccacgagccctcgaaccgctcgcggagtacctcctcgggtccgctgccgaggcggttcagggcggcgtgctcgtgcgagcgcactcgatcggatgggccgcccgggtcgtggtcgcactcggcgccacgccggtcgctggacccgcgacgctcttcgacgaggcgcgcgccgtgctcgccgcggcgcggcgacggctcgaggccgaccgtgacgactgagcctgctcgtcgccccgacgctcgagcggcgctggcgcacggcgcgcgcgtggtcctctcgacgcgcgacgaggcgttcggggtgcatgcggtcctcgtcaacgccttcgtgatcggcggcgatcctctcgaggtcgccgtcctcgcgcgcacgacgtcgcgcaaggtcgcgaacctccgacgcgacgggcgctgcgcgctctgtctcgtcgaagggacgagctacgtcactctggtcgggttggcgcgcgtcgacgccgatccaggcgcggtgacgcgggccgagcgcgccttcgccgaggcgttcggccggccgccacggccagcacccgagggctcgcgcgtgctggtcgccgttcgggtccagcgcgtgctcgccgacggtcctcggcggccggttcccgaaggccggtaggctcatcctcggccgatgtcgtcgtgaggcgggaggtagcgtggccaggggcacgagctcgctcgagcaacggggcgacgcatcgtcgtctgcgtcgagagacctggcgctccgactgatcgcgagcctcctgccgatcaagagcgtgctcggcgggcgagccgccctcggcgactgcggggagcaggcagcggggctcaccccgcgccacgtccacctcttggtggaggtgctggtgcgcggtcccctcagcgtgagcagtctcgccgagatcgcaggcgccaatctcgcctcggcgtcggtcgcggccagccaactcgaagccgctggtctcgtcgtgcgtaccgaggatccggtcgatcatcgtcgcacgctcgtgcgggccctgccgggcgccgaggcgttcgtggcggcgttccttgccacacgcgctgctgcgctcgagcatgcgctcgcccaactcgagcctggccacgcggagcagctcgtcgaactcctcgacgagctcgccaaggcactacgggtttcgatccgcgaggctcgcacgcccctgtcggcgcgatcgccccaggtcgacgagtgaatggttactgaaacgaaacaaagtagggctcgacgggtacgcgcggcgggtggctagggtgcactcgacgatgccatgtcggaacatgtggatggcgcgcgcggttgggtcactcgcgcagagcttcgagccgttcggccatgagctggggaggacagcgtgagtcgcttctttgatgccttgggccactgggtggtcaagctccggtggttcatcgtggtcgcgtggatcgccgccctcgtcgcgtcggtgtcgttgttgccatcgctcggttcggtggtgcagaacaacttccagaacttcctcccagcccagtcgccctcgctgcgtgctgcggcgctcgccaatcgcatccagaacgtcaacgagtcgctcgtcgtcatcgtcgtcgatcggccgaccgcgccgctcacgagcaccgatgcgacgtacgtggcgcgtctcgtccatgaggtgcgacacgtgccgagggtgctgaccgtggcggtgggcgcgatctcgcccacccgacaggcggagcagatcgaggtgctctcgagtcgatcgcagttctccgacacgggcacgaaggcgttggtggacgccatcgacggcgtcatcgcctcgagtcatcctccggctggccttgcggtgcacccggccggtgcggtcgccacggcggtagcccaggcgggccagaacaacacgaacgcgtccaacacccagctgttctcggtgctcttcatcctcgtgctgctgttcctcgtctttcggtcggtcctcgcgccgttcatcaccctcatcccggcgttcctcgtctcggtgttggccggcccgatcgtcgctcgcttgacgagcgtgctccactaccaggtgtccaacatcacccagctcctcatgatcgtcttgatcctcggagccgggaccgactacgggctgttcctcgtgttccgtactcgcgaggagctccagcgcggcttctcgggtgccgaggcggtgcagcgggcgatcgcgcgcgtcggtgagtcggtgagcttctcagcgttcacggtgatcgcggcggtgctgtcgttgatcacggcgacgttcggcttctacaaggggctcgggtggccgctcgcgatcgccgtgttcatcatgctcctcgccggcctcacgctgcagccagcactgctcgccatcttcgggcgcgctgcgttctggccgagccggccgcatggtcggggggtccgcgtgggctggtgggggcgcgtcgcccagcgcgtggtccagcgcccggccctcaccctcatcgtgggcgtcgtgttcttcggagccctcgcggcttttgcgcctcagaatgccccgtcaggattcgcgaccaccaccaccgcgccggcgggaacgagtgccgcggcgggcaacgccgccttgagccgctacttcccgcacgccagctacaaccccacggagctcgtgttccgcttccgcacgcccatctgggaccacctctcgacgctcgagaccctccagagcgccgtgagccgctcgcccctcttcacgcaggtgacctcgccgctcgctccggctggcttcccgatctcggtgacggagctcagtgcactgcacgcccgcctcggcgatcccgccaagctcccaccgacgccgatcggcggcatctcgcccgtcgtgtactcgcagtatcggtcgctgaagaacctgatcggaccgactgggcgcaccgtcgtcgtcgaggcgagcctcacggctggcgcacccgggtcgacgcccgcgatcaacgcggttcccgcgattcgcaccttcaccacccagctcgcccatcgcgtcggtgcaacgacgagcggggtcgctggcgaggcgccggcgtcctacgacgtctcgagcgcgtcgaaccacgacctcacgcacatcgtgccgatcgtcatcgtcatcatcgcgctgctgctcgccctcgtgctgcgctcggtcgtggcgccgctgttcctcgtggtctcggtggcgctgtcctacttcgcagccctcggcctcgctgtgatcgtcttcatgaagttcgatcatcagagtggactcatcttcgtcctgccgttcatgctgttcttgttcttgctcgcgctaggggaggactacaacatcctcgtcatgacgaggatccgtgaggaggcgcacgatctgtcgatgcgcgaggcggtcgtgcgcgccatcggcgcgaccgggaccaccgtcacgtcggccggcgtcgtcctcgcgggaaccttcgcggtcctcgcctttgcgtcgctcgggcaggccgagatcgaggagatcggcttcgggctggcgctcggcgtgctcatggacacgttcctcgtccgcacgctcctcgtgccgagctccgtggtgctgatcggtcgactggcctggtggccatccaggctcgctcgttcgggtcacctcgaggtgccgccgccgcgtgacgaggtcgatcgggtcggcctcgaggctgaggtgcgtgggacgctcgagcacgacgacgcctgagcggggcactgtgggttgggttcacgcctcgatcgacgcacccaccggcgtcgcgagcatcgtgctggatcggccggagcgccgtaacgccctcaacctgacgctgtggcgccggctcgcagaggtggcgcgcgaggtcgcggccgaccccgccgtccgggtcgtcgtgatcgagggtgccgggggtcacttctgtgccggagccgacgtcagcgagttcggtgatgcgcgagtcggggaggccacgctgacctacgatgcggcgacggaggccgccgcggccgccatcgaggcgatctcggtgcccaccgtcgcgctggtcgagggggcctgcctgggtggaggggtgtcgatcgccctcgctgccgacgtcgtgctcgctgccgcgagcgctcggttcggcgtcccggcggcgtcgttgggcacgctgtatcccgagggggcgctgggtcggctcgtgcgtcgcgtcggcgatcgacgcgctcgctggttgctgctcggggccgagcgcatcggcgccgtggaggcggtcacgatcgggcttgccgagcgggtggtcgacgatcgcgcgagtgggtacgagctcgtcgtccagatggcaaccctgtcgtcgatgacgcagcaagcgaccaagcgggtgctcgccgatcagcgtgtgcacggggagcttgctcggatcgtgttcgctgcccaggactatgctgagggccgccgcgcctttggcgagcggcgagcgccgcgcttcatgagttcgtgggaggcacgtcgggcgctcgaggggggatcggggtctctcgaggacccgtgagagaggggggaccgtgcgggttccgttgaccatccgcgacttcttgcgtcgcgctgtcgaggtgttccccgagcgcgtcgcggtcatcgacgagccgggcgtggtcggatcgctcgggacgctcacctaccgcgagttcgacgcgcgcgtgcggggtcttgcgagcgcgctcgcggcccgggggatcggggtcggtgatcgtgtcgggatcgtctcgcccaatgcggcgaagttcctcatcgcctactggggcgtgtcgggctacggccgtgtcctcgtccccatcaactaccggctcagtcgggacgaggtcgcctacatcgtcgagcactccggcacctcgctcctgctcgtcgacccggagttcgccgagacgttcgctggcgtcggcggtgtcgagaccatcgtgctcgacggggtcgacgacgctgcgctcttcgcggcagcggcggcggatgagccggggcctgcgtgggagccggacgaggacgcgacggcgtcgatcaactacacctcgggcaccacgtcgcgtccgaagggcgtggagctcacgcaccgcaactgctgggtgaacgcgacggtgttcggttggcacctcggcgtcaacgatcgcgacgtgctcatgcataccctgcccatgttccacgcgaacgggtggggcatgccgtacgccgccaccggcatgggcgcgacgcacgtcgtcgtgcgcaagatcgtcggcgaggagatcctccagcgggtctcggagcacggtgtgacgctcgcgtgtggcgcaccggcggtctgggccgcggtcctcgatgccgctgccgtgcgacgtgaccgtggtgagtcggtccccggacgggaccaggtccgcatcgtggtcgcgggtgcgccgccgccctcgcgcacggtcgagcgggtcgagacggagctcggctggcagttcaaccagatctacggcctcacggagacctcccccgtgctcacggtgaatcgacgtccgaaggagtgggacgatctcccgatggcggaggtcgccaagcggctcgccaaggccgggacccctgcgatcggcgtcgagctgcgtactgacgccgacggcgaggtcctcgcgcgttccaacgtcgtcttcaagggctactggcgccaacctgaggagacggccgccgcactcgagggtggctggttccacaccggtgacggtggcgtcaaggccggtggttacctgacgatcatggatcgcaagaaggacgtcatcatctcgggcggcgagaacgtctcgtcgatcgaggtcgaagacgtgctcttccagcatccggcggtcgccgaggttgcggtcatcggggtaccggacgccaagtggggcgagaccgtgaaggcgctcgtggtcgtgaaggacggccagacggtcagtgccgaggagcttcgggagttctgtcgagagcggctcgcgcactacaagtgcccgaccagcgtggagttccgcagcgagctcccgcgaacggcgacgggcaagctgcagaagtacaagctgcgccagccctactgggaggggttcgagcggcaggtgaactagagatcgtcgaggagtcggaagtcctcgacgagcggtatagcggcatcgagccgctcggccgcgcgggacgccgcggtccgtaggcgcgcgacgagcgtcgccgtggggtcgtccgccgccgtgacgccgtaggtggtgcggtactggctctcgtggcacgcgaggagctcggccttgcgtgcgatggcctcgtcggtcgtgggttcggcgtgatccggcgctggcgactcgtacagggccaggtagcgcggtcggtgggccgcgtggaaccccggctgccacgtgggttcgcgggcgtcggcgagcgcctggaaggtcgcggttgcgaccgcgcgatggtccggatggaggcggcccgggtggtcgggatcgtggacgagcaccacgtcagggcggcaagcgcggatggcggcggcgatctgccacgcgaggagcgcgacgtcgcgaaggcgcccgtcggggtgaccgaggaggcggaggtctgcgccgaggagcgctgctgcacgtgccgcttcgcgggcccgggtcgctgcgagctcggcgccgtcgatcgtcgtgtcccaggtgccgtggcgtccgtcgcttgcaacgaggatggtgatcgcacagccgtcgtcggcccagcgcgccagggtcgcgcccgccccgagttcgacgtcgtcggggtgggcgccgatggcgagcgcacgagccggggtggcaaggggggcctcgtggcgcaggtgcgcgccttggagggctgcggtgacgccggcggcttggcgagccggggtcggttgctcgttcgtcgtcatggcgatggtgccttcgcgcggtcgatcggcgggcacggtgcgtccggccagtggagggctgggtcgagcgcggtgagggtccgggcgaggtcgaggtcgtcgtccgtgtcgatgtcgagcaggaagcgcgtgccgaggagctgcacgcgtccgtagcgctcccgtagcgcgctcatgtgtcggcggagggaatcggggccaaaggcgaaggggaacgcggccgctggctcggggagccacagcgccacggtcccggtgagatgatggtcgggtgcgacggcaccgacgtcgccgaggtcggtggggagtgcgaagaacgggaggtcggccgggaccacgaggacgcgaccgtcgaggcccgccacggtctcgccgatggcagcgttcagctcgcgaccacgttggtgctcgatcgcgagcccgaggtctgcggccagctcctcgacgctcgggtcttcggcgaggacgaggacggaggccggctgcgaggcgctcgcgatgtgcgtgacgcacgcgcgaacgaaggctctgcgctcgtcgcggctgagtgtgtcggcgaggcgggacttcgcccgctcgagggagcgctggatgacgacgacgaccgatggctgcactggtggccgagtgtaggctcgctcggcgcatgctccaccagccatcgggtgatcggctcgtcgggatcgacgaggtgggtcgcggtgcctgggccggtcccgtggtcgtcggtgccgcgcgtggatcggtggcagccgccgccgccatcctcgcgcatccgcgcgggggggtgcgcgattcgaaggccctctcgcctgcggcgcgcgaggcggcactcggcgcgctcgaggcggcgggtctcgagctcacggtgggttcggcgagtgctcgcgagatcgacaagctcggactcacgggggccttgcgtcttgctgcgcaccgtgcgctcggtgcagcgagcgagctcgaggtcctgctggatgggcgtgttccctacgtcgaggccggtcgtgtgcactgtatcgtcggaggggatcgccgccacccgctcatcgccgcagcctcgatcgtcgcgaaggtgcggcgtgacgcgttcatggtggcgctggacgagctcgctgctggctacggattcgcccgtcacaagggctatggcaccgccgagcatcggcgtgcgctctcagagcacggagtgacaccgtggcatcggcgcagcttcgggccgatcggtgggatggttgagcacgggtgatcggcccctggcggagcacgccgagggcgcgcgccggggtgtcgctggtgtgcgacgcgctccgctgtggcgatatctgcgagtctgggggcgggaagggcccgtcgtaggcagtcctgtcgcgtggtgcgggtgaagcggtcgatgtgaccttcccgttggcgacgagcggcgagagctcgcagatcgtggccttggagcatgccgtcgtcatggcccggccacccgaggcgccctcccgggacgcagcgcttggcccttccctgcgtggggttgttcgtgcacctcgaccgaggaccggagctacgagcgtgcgaccgacgaatccgccgctcgatgtcggggtgcgtcgtgcccatgtcccacaaggttgtcccggagcacagccggactggtcgctgtcgtccgggcgctggtgaccaccttggcgagtgtgctcgtcgtgcgcgcctgggctgcgcgaagaccgagagcccacagcgcatcgagctcacggatggccagatggcgcacagcgcacggacgtgccgcgctcggcttgctcgtgcggaactgtggcgacgaggtcctgatgccgccggtcggctctgggcagtcggaagctagatctacggcgatgcagtcagcctcccgcccgaggagtgcgtctcgtggagggagctccctgcgctgcaaggctcgctccgcaagcccctctggccgagatcctcgcagaacggaggactcctgccatgggccagccagtccagtcgcgtgggtgaggtgcttgtcctggagcctcctaggctcgcggggcgatggagcgccgcagcctcgccgccctcggggtgttgtcagtgatctggggctgctcgttcctgttcatcaaggtcggtcttgccacgttctcgccggacctgatcgcgttcgtgcgaacgacactcggcgcctcggtcgtcctcgcaacggcgcgccttcgtgggtgggcgcttcctcgaggatggcggctctgggccaagctcgcggtcgcggcgctcgtctcgaacaccttgccgttcatcctctttggctacggcgaacagcacgtgagcgcggtgctcgcaggattcatcaacgcgacgacgccgatgttcacgttcccgctcgccgtcgcgctcaaactcgagcgcgtgtcggtcgggcgtatcgcgggtcttgccgtcgggatcgtcggcgtcggtgcggtcgtcgggatcgggaccggggcgatcagcggcgcgtcaggtgtcggggtgctcgcctgtcttgctgcggctgcgctctatgcggtcggcttcgtctacgtccgcatgacactgggactgaccggcgccaatcgcaccggcctcgctggaggccagctcgccatggccgcgctcgagaccggcgtcgtggttctcgtcatgcggcagggcatcgggaccgtgcatccgctcgcgctcgccgccgtggcgaccttgggtgtcgctggtaccggcatcgcctacatcgtcaacttcgcgctgattcatcgatctggggtcgtcggcgcctcgctcacgaccctcacgatgaccgtcgtgtcgacggtcgccggcgtggtcgtgctcggagaaccgcttcgctggtaccaaccgatcggcgcactcgccatcctcgtcggtgcgtggctcgtccagggcgcgcgtcccgtctcgaccaggctggtgccggcgaccgagtgaccaggggaggtccgacgggagctcgtcgtgtgggaggcgggcacgtctcgaacctgggctgcggtggacgggagcgtagcggtcgatgacgatcgggcgctgatcgagtggcggcgagtcttcggcaggggcggtgtctaggagtggtgctctacgtagcgagcgatacgcaggtgggtcgcctggcgccgacgaccatcggccagcgacctcggtgagtatccagggaccggttgtcggtcggcgatcgcggcgaggcgagttcccgtgtccatcgcgtgctgccaagcccgagcctgaccgagtgcggtgtaggcgagcgcgacgccagcggcgagagcaacgacgacgagaccggtccgtaggagcgacccgctgcggcgggccagcgcgccgcggaggtcgtggcccgagctgtgcaacgagcgcttggagtaggcaaaggtatggatgaagaggagcaccagccagatcccggcgagcaggaagtgcgcaggcgcgaggaaggtgtcggagaacgacgtcggcccggcgaacgtgagctcggcacctgagaggacgacgagcacggtgaccacgacgagcaggggagcgagcaaccggagcgggagccacggtgcactgcgtacgtgcgccggcgagctcgagcggtagaaggaggcgaagcgccacgtcgcgagcccgagcttcagtacgagcatcgggatcaggacgaccccgatgacgatgtgccagaagagcgcgatgcgcaggtcgagcgctgtgaggacctcgagcgcgctcaggacgagcaatgcaacgccgccgagcgcaactcccctcgcgaccgcgatcgctcggggcgactcgcgcgctcgttcctcgtcgagacggtcgaacgacgcgtgatcgaagaggtgttcgaagagcgagttctcctcgctgtagagcacacgacctcccaggcacgaacgtcccagcggcgcgatcgagcgacagagacgtccttggttcaagtatacggtctgggcaggtgtcgcgtcgggatcaaccctcggcgggcggtcgcaggtcgatcgtgaaggtcaagatgccgtcctcaagcttggccgtggcgtcggcaagtagcgagaagtcgaagtagtcgagttcggcctgctcgcggaagcgacggcgctccgggccctcgacgggtgggagcggccgctgtcgtacggcttcggcgcgttggcgaaagcgttcgacgatcgcggtcggatcgaagctcgcggcctcgtcgctcggcatgagacctcctcgtggtcggtgtcgacacggctctggaccacggcagcgaacctgcgggcatgccgggccgtggtggcgcgttagaccagtctacgaggggcgctgcgaatcggaaggcagcggccctcgtggcctgcagagtagactggcgtgggcgcctgccgaggcagggccactgcacggctcgcgggcgagcacggtgccagcggccgaagggccgcgcgaggagagagcgggagtggctcgtgaagaaggggcgtcatcgccggtacgaggaggcccgcaaggccaagcgtgggcttgcggcgccgctggttcgttgtgacgagtgcggaggcgatgcggttcacggccacgcatcgtggtgccgggcctatctcctcgaggaggagctgttcgctggccacgtcgatgacgacggtgagccagagccgtcggcgtggatcgagggggagcgcggggccgagtgagcgagccgcacgcggttccacccgagtcgtcggagatcgtctattcactgatcgaagacatcgacggcattgagatcgcggcgcgctatcggcgcggcgacgatcccctccttgtgtatctccacggatggggtcggtcgttggcggacttcgcgccgtacctcggccgaggtccatggtcggccgtggcactcgacctgcctgggttcggtcgttcgacgccaccgcttcgaccgatgggcgcgcggggctacgcggagttgctccgagagccgctcgccagcttgcggcgacgcctgcaggcctcacgcatgatcctcgtgggccactcgttcggcggacggatcgcggccgagttcgccggactcgcgaccgacgcggacgccctggcaggcgtggtgatcgtggcgagtccactgctgcgccctcagggtggtcggcctgcgctcggctatcgcgtggtgcgatcgctgcacgctgcccatctcgtgcccgccacggcgctcgagtgggcacgcgggcgttggggatcgaccgactaccgccaggcgaccggggtcatgcgcgacgtgctcgttcggacggtgaacgagcaacaccttggtgcgctcgagcgtgctcgggttcccgtcgagttggtgtggggtgcgctcgatacggcgtgtccggttccgctcgccgagcgcgtcgcggcgcgcgtcgcgggagcgaacctcgacatccgagcgggcgtgggtcacgacgtcccgcgcgacgctccggaggccgtgtggggcgcgatccatcgactcctcgggcggatcgagcctcccgtcggctgcgaggagcagctcagtgagtagcgtcgccggcactctcggaatcgtcatcgggctcgcctcctgggtgggggcgctccggtggctccgcgtcgcccaacgcgagcactacatcccgggtcgcatctggctcttcgtgcgactgtggttgcgtgagtccccggcgtccatcgtcattgcggtggtcgggttctttggggcggtgtctgcgtggagctcggcactgccgcggatccctcacctcatcgcaggagcggtcgcggcggccgcgagcatcgcggcgccgatcggcctcggtcttcgcgggcgcacgagcccgttggccctcacctggcgcctgcgtcgactggcgctcgtcgtcgtgatggtcgatctcgtcgtggtcggcgtcggtatcgcggttggcgagccgctcggtgcggccgtgagcgccggctggctctcgccgctcctcgtggatctcgcactgcgcatcaccgcgccgctcgagcgcaggctgatgggccgcttcgtcgacgaggcgacgtctcggctcaggcgtgttcgcccgcgcgtcgtcggtatcaccggatcgttcggcaagaccacgacgaagggctacgttgcggccctcgtcgaggggacgtatcgcacgctcgcgacgcccgcgtcgttcaacaaccgcgggggtctcgctcgcgccatcaatgagcatctcacatccgacgtcgaggtcttcgttgccgagatgggcatgttcggacccggcgagatcgccgagctcgtctcgtgggtcaggccggagatcagtgtcatcaccgccatcggcccggtccacctcgaacggctcggatccgaggcggccatcgtgcgagcgaagctcgaaatcgtcgagacggctcgggtggtggtgctcaacgtggactatccgcgcttggcgctggctgcgaacgcgctggagcaggagggcgcgaggcgggtcgttcgggtgtcggcgatctcgctcgaggcggacgtcgcggtcaagcccaacgacgagggcgaggtcgtcgtctacgcgcacggcgcgaagatcgccaaggcggcgctcgccgacgtcgtggccggcaacctcgcctgcgcggtcgccgtcgcgctcgagctgggggtggcgccggaggacatcgccgagcggctcggacgcatcaagccagcgcccaaccggctcgtcgccggcgtctcgccgacctcgggcgtcgaggtcctcgacgacacctacaacgcgaacccgatgggtgcgcgccgggcactcgatgcgctcggcgcgcgccgtgacggtggagggcggcgcgtggtagtgacgccgggcatgatcgagctcgggcgccgtcagtacctggagaacttcaagttcgccaaggccgcggctcaggttgcttcgcacatcatcgtcgtcggacgcaccaatcgacgagccctcgaggccggtgccgacgaggggcgggacgaacccggctcgacgctccaggagctacgatgggctcccgatcgggagcatgcggtcgcgctggtccgcgagatgctggagccgggcgacgtcgtcctgtacgagaacgaccttcccgaccactacccgtagagcgagcgcgggagcgctcacggctgacgagcagaaggaggcaacgtggccacgacgcgcgtcggcgtctgcttcggcggcccaagtcccgagcatgacatctccatcctcaccgggctgcaggcgctccgcgcgctggccgagagcggtgggtcaccggtcgcgatctactggtcgaaggaggggtcgttctaccgcgtcgagccctccctcgaggccgaggcctacgcgggcggggtcccggcgggggcgagaccgctcgagctcgtcgtcgggcgcgacggcggcttcgtcgagccgaggggcggcctgcgaccaaagcgcgagctgctcgagctcgacgtggtggtgaactgctgtcacggcggtccgggcgaggacggggcgctccagggggcgctcgatcttgcgggcgtgcgctacaccggccccagtgctcggaccgccgcactcgggatggacaaactcgcgttcgcgagcctgttgcgccaccacggcatcgcgtgcttgccgcgcgaggacgggcgccgcgtgaccttcgacggaccctacatcgccaagccgcgcttcggcggctcgtcgatcggtatcgaggtcctcgaggatcgggcccagctcgaggcacgcatgcagcgctcggagcatttccgcgacggcatggtcgtcgagccctatcgccccgacctcatggatgtacaggtagccctccggcgtttcccgaccccgaccctgtcggcgatcgagcgtccactgcgcagcgccccgggcgagcccatcctcacctatcgagagaagtaccagcccatcgggggcatggcgacggccccacgggagttgccggctgcgatcgctcccgagctcgccgagaccattcgctcccttgccctcagcgtgggcgaactcctcgattcgcggggagtcatgcgggtggattttctcgccagcaccgagggcgagtgctacgtcaacgaggtcaacaccatcccagggagcctgtcgcactacctgttcgtcgagccgaagatcccctttgcggcccagctcgaggccgacatccgcgaggcactcgagcgagcgacctatcggccgaacgtggccggggccgacggctcggtcctgcgctcggcggggtccatcgcggccaagctcgcctgaggaacacgacccctcgtcacgagtagggtgggccgctgtggcgaggggtcatccgacgaccggtctgcgggatcaacgcccgagcgtgcagcggcgcgtcgcggcgttgctcgtgtcgaacgagcgcctcgagcacgtcttccatccccactggtggcgactcatcgaggcgagcggcggtgggctcgtcgggctcgtcgtcgcggcgctcgtggctggcgtcggattcggaccatcgttgctcatcgcggccccggtcgcggtgggctcggtcctgtggatcgtgatcggggtagtgcgctggcggtccgaactcctgttgctcacggatcgccgggtcgtgttcacccgaggagtcttcgcccgccgcacgagcgagatcccactgaagcacgtgaacgacgtctccaccgagcaggggctcatcgggaggttgctcgacttcggcagggttcgtatcgtctcgggcaacgccaacggacaagaggtcgtgacctacctccacgggccggcgcgccttcgccaggagatttcgcgactgactcaagcgagcgagtcgacgccgactccaacggcgacatcgaccggggggagcctcgtcgagcagatccagatgctcgcgttcttgcatcgcatgggcgagatcagcgacgacgagttccagcgcgccaaggagcaggtgctctggggcgacggcgcgcgagagtccgaaggggacgtcgaaggaggaccgtgaccatactcgacccgatcgaggcgcgatggcgccgcaaccttgctgcgtgggccatcccacccgagatcgcgcgccacggcgacgcgtcgccgtggcggctcgatccggcgatgttcctgcccgatcccgacgcaccgctctcgccgtcgcatcgggcgacgcgtgcgttgctcgagcgcgccgatgaggggagcctgctcgacgtgggctccggggcgggagccgccttctggccggtcgtcgagtccgcgcggcgggtgatcgccctcgacgagcacgctggcatgatcgaggccctgctcgccgaggcgaggcgccacccgaccgtcctcgtcgagacccgggtgggacggctcgaggagctgttgccgaccatggagtccgtcgacgtcgtcacgtcacaccacgtcgcctacaacgtcgccgacctcggcctctaccttggcgagttggtgcggatcgctcacgtcgggatggtcctcgaactcaccttgcaccatccccactacggctcggccgccatgttcgaggcgctctggggcgttgcgcgcccgagcgagccgagcgcagccgacgtcatcgaggccttgtgggcgctgggcctcgagcctacggtcgaggtccactcgggcacacgacgccgagacgaccccgcggcgcgtcgtgaggcgctccggcgacgcctctgcctcggcgagcaggaggtcgcgcgcctcgacgagctgcttcgcgatccgggcgagctcgccaatccgtcggtgacgatcgtggtggacctcgatgagcgcaccgcttgagctctggtgggagcgcacggggcacggcgaacggggcgacgccgtcttgctccacggcctggccggttcgagcgacgacttcccggccgagctcgatgcaaggctcgggcgtctcgggttcgggacggtgcgcatcgatcttcgtgacagcggccggtctcctcggctcgacgccgacggtctgccgcgtgtgttcgagctgctcgccggtgatcgcgacgccgcgccgtaccggctcgtcgacatggcccgcgacgtggtgcaggtgctcgagcgagcgagcgtgtcacgcgcgttgctcgtcggcgtctccttgggtggcatggtggctcagcacgtcacggtgatcgcgccggagcgcgccgcgggtctgtgtctcgtctcgagcgcgagccagcccgacctcgcgagcctcgtcgatcccacggttctcgcacccctccttcgcgcgggtctcgcggccctcgatgccggtgacggcgactcgaggggcggtgccggcgctcttcgacagctcggcgcggtcgtcgccagcgacccgtggcgtgaggcgatcgcgcagtgcgcgccggcgacgctgatcgtccacggtgccgccgatccgctcatcggggttcgtgctgcctttgacacgtgggccgagctcgagcgggcacggctcgtcgtgatcgccgagcgcggacacgaatggacgacgtcggcgtgggaccttgtgtggccgcacctggctcgcttcggtcggagcgttcgatgagtgggccgctcgctggcgttcgggtcctcgagctcggggggatcggcccggtcccctttgccggcatggtgctcggcgacctcggcgcgacggtggtacggatcgagccaccgagcggggccggactcggtgccgatgcgttggcacgaggcaagcacgtcattcgcatcgatgccaaggaccccgagggcagggcgctcatccgtgagctcgcgagccgtgcggacgtcttcgtggaggggtttcggccaggggtggtcgagcggctcggcatcggtcctggcgagttgtgcgctgcgaacgaccgcttgatctacgttcgcacgacggggttcggccagagcgggccgctcgcggagcgggcggggcacgacatcacctacctcgccatcgggggcgccctcggagcgacgggatcggcggatgcgccgccgctgcctccgctcaatctgctggccgacttcgggagcgggggcatgctgagcgtcgtcggggcgctcgccggcctcatcgagcgcgagcgcagcggtcgggggcgtgtggtggatgcggcgatggtcgacggggtcctcctcaccgagaccatggtgctcgccatgatgagagagggtgcctggcggcccatgcgggaggcgaacctgctcgacggcggggcaccgttctaccggacctaccgctgcgccgatgggcgctggatcgccgtcggcgcgctcgagccgcagttctttcacaccctgctccgcgagctcggcctcatcgagcgcttcgacccggccgcccagtacgagcgcgctcgctggggcgagctcgcgtcgctgctcgcggatgcctttggctctgcaccacgagccgtgtgggaggagcgcttcgccggtctcgatgcctgcgtcgccccggtgctcggcctcgacgagctcgcgagtgctccccagcacgtcgagcgacgctcgttcgtcgaggtcgacggccatctcgagccggcgccggctccccgattcgatggcgaagcggtcgagagtcgtccggggccctcgcgcgacgcggtcgccgcgctcgtcgcagcagggctcgagccggagcgggcgcgcgctgtcgtggggctcggcctcgtggtgtgagatgttctacctcggctatcgcgacgagcggccggtgttcgcggccccgaccagccacgtgctcgtgctcggcccgcctcgctccggcaagaccacgcggttggtcgtgccgaacgcccgtgccttccctggtgaggtggtcgtcacctcgaccaaggccgacgtcatcgaaccactcgtcgtctcgggccggaccgtgttgctctgggaccccgagggcgacgccgtcgaggcggccggcttgcggcgcgtcgcgtggagcctcgtggacgcggccaagcgctacgaagacgcggtactcggtgtcgacgcctacgtcgaggcggcactcggtcgcgcgagcggtgccgagcgccattggcacgaccgcgcccgtgcgctgctcgcacccctcgtgcgggcagcggcgaccctgggtgggaccatcgacgacgtggtcgcctgggtggaggcgcgcgacgtctccgaggcgctcggcgaactcgacctccagggggagcgtcgggcgctgagcggacttgcgagcgtgctcgcctcggaggagcgcgagcgctcggccatcttctcgacggcccacgccgcactcgctgcgtaccgactcggagaggcgcccgcgcccgagcgtttcgaccccgaacgcttcgtcgggtccggtgccgccctcgtgctggtcgccccgagtgcgagtcagcggatcctcgccccgatcgtcgtcgcgctcctcgagcagctacgacgggtgtactacgcgcgcgctcgtcgcggggaaccagggcgactcgggctcgtgctcgacgagctcgccaacgtggcacccatcccgtcgctcggctccatcctgtccgaaggggtctcgcaggggatctggctgctcgctgcggtgcaagatctcgcgcaggttcgcgagcgctggccggccctcgagcgcggactgctcacgctgttcggtaccgtggcggtgctcggcggtgtcggcgacgcggggaccctcgcggtgctgagcacgctcctcggcagcgaggacgtgctcgaggtcgcggtccacgagggcgccaggggtcgctcgaggacggttcggcgaacgcggcaagcgagactcgaaccggccgcgctccgcagcttgccccgtgggtcggcgctgatcgtggagttggcgggatcgagcgggatggtcgcgttgcgaggtgacccgccgctctgaggggctactcggccgggggcggatcgaggacctccgggaagtcgcgctaccatgccttcgtgccgttcttgctgcggatcctcggtcgggtccgcgcgtctcaggcgcggctgctcgccacgctggccgtcgcgagcgtgctcgctggggcggtagcgttctcgctcgccgagcacgtctcgctggggatcggcctctactgggcgatcacgacggcgacgacggtgggctatggggacgtcacgccccacaacaccgcggggcgcatcatcgccgtcgcggtgatgctcacggcgatcccgctcgcgggcggcgtgttcgccgtcgtcgcggcccagatcaccgcgagtcgcctgggtaggctgctcaccgtgaccattgcggagtcggatacgggattcgtcgcgctcgtcggttcgcaccgagccctcggccgtatcgccgaagagctggttcgagcgggcgagcgggttcgcatcgtcgcctcccagccgatcgcgggtctcgggatccgcgccgagcagatccaggccgatccgaccgacgagggatcgctccggcgtgtccacctcgagcgagcatcgcgcatcatcgtcgcaggcagcgacgacgccgagtcgctgctcgtcgcggtcctcgtccgcgagctcgcgccgacggtgccggtgctcgtcgcggcggcatcggccaaggtccgcgaggcgctcggtgggctcggcgtccaagcgagcatcgcggtcgatgagctgctcgcccacacgctggccaaaggggccgagacgccgcacgccgggaacctgctgctcgagctcgtggcgagcgagcgcgtgcggctcgtcgaactcccggtgaccgatgcgctggtggggatgaccctcgacgacgcgggcgatcgactgggggggctcgtcatcggtcgcgtacgcggcgatcgggtcgagctcgccgtcgggatcggctccgagtcgcttgccgctggcgatcgcgtcgtggtggtgagcgagcgtcagccctccgctccgagcgaacctggcgcgtagaagcgctgccagttcgccgtcgagggcgcgacgagaccggtggggccttcaccgaagaggcgcaagatgttgcgcgtcatggtggtgaggatcggagcgggacagccgctcgtgtccgccccacacggagcgagcgctgggatccagttgttcgtgccgctctcgaagacccccgccttcgaggtggggctcgtcacgtaggtcgtgtcggcgtagtaatgcgccccggagaagccgatcacgaccggtgagtgggcgaggatctcgacgcccggtgggttcggccgcgcagggatgtagccgtcgaagtcggtgaagagcacgttgggcaccgtggcaccgttcgtgaggccggtgcccgcatacagccacgacgatgcgtccgtcacgacgagcgggaaatgctgggtgttgttgaaaccgatgtaggagtccccgacgatctcggaggccggtgcgtccgccggggcttgtccccaccagttctgggtgacacgggcgttgtcgacgccatagagcgggtcctcctgcgggtcgcgatagttgacgacctcgaggttgggtccgagcgggctcgcggcgaggcggaccttgcggaggatggggctcgccccgaagaacaccaggttgacccctcgtccctcggcctggagcaccgcctcgcgcatgcgcagcgaccactcctcgtcgtggccgagcgagaggagaacgcgatggttggtgagcagggctccgtgggtggccagggtgatgtcggtccagtaggtcacgtcgaggccgtggcgctccatgagctcgatgagggggagttcgttggtgatgaaggtcgccgcgccgttgccgtagccgtagggccggtcgaacgagactacgcgtgagcgatcaggaggggggtagcccggcgcggtcgacgcgccctgctggtagaggtcgtagccaccgaaggggttgaagacctgccaggtgaagaccgcgttcatgaccacgtaggcggccttcgacgatggatcccagaccgtgagggggacgtagctcgcagctccgttggaggcgaccagcttgaggaggtagtcgccctgcacgaaggcgggggtgatcgcgaactgggtcgctcgttgccaggagcactgcaccatgtagaggggcgcactcacgggacaggcgggctcgacgtggccggcgaggaccccagagtgccacaccaggcgagcgccggtcccgtggtaccagcccatccggaacgcctcgacggtgaacgtgggcgcgttcgtcgacacgtacaggtcgaccatttggccgagacgggcttggggacggttggagtagccctcgatgaaggtgttggcgggttggaggccgatccgccacgccgtggtaccgggcttgtcgttctcctggatcacccagcgagcctcgacgccccaggggccgaggaaggtggccggctgcgcatgtcgtcggcgatgtggcgtggtcggcgtggtgtggggggccgtccgtggatgggcaacgagcgcgatcgcgccaccgacgagcgccgcgatgaccacgacgatcgtcgcgatgacgaacggattgcgccctgctgatcgcgggcgtcgatccgagcggctgtgcatcccaggcatgcaacctccccggggctcccctggggggccaaggctagccgagccaacctgtggggccctcggcgcctcaggtggcgggtatggccatgagtcgcttgaggacctcgggcccgagaccggtgacgatgatcgaggggtcgtcctcgacgtcgccgcgctcgagccggtagtgcacgaggaggcgttcgcgcccctcgacgagggcgatgctggtgccgacctcccgatagccgaccttctcgctcacgcgacggctcgcgaggttgtcggcgtgggcggtggtctcggcccgagcggcgccgaggtggcgaaaggcgagcgtgagcaccgcgcggcgcatccaggtgccgatgccgcgtccctgcgcagctgcggtgagccatgagcccgtcgagacggtggcaaggctcggccaccctcgggcgaggacgaggtcctggacgccgatcggcccctcggtcgggtggaaaacgacgaagggcagcgttgcgatcggcgtcgcctcgttcgcaccgacggtccggagccagtggcgaacgacacggctcgccacttcgtcagcgctgccccgggtccacgcggtcgagaagggcatggcgtcaggtgcgtggatgccctcaccggctcgctcggcgaggcgggcgagttcgtccatggtgggggatgcgagtgtgacgacgggggtgcggatcgccacgccgagctccggcgcgaagtgcaccaggggatggttcggatcgatgggcacgtcgccagcctagggtacggctaggttgaggctcgggaggaggcgacatgctcatcggagtcactgccggcctgatcggtgaggcaaagccgcgctacgtcggtctgcacgacggctatctccgtggcctcgcgcgagcaggcgcggccgcggtcgtgtggccgagcacgctcggggtcggcgatccggccgacgtggcggcacgggccaaggagctcgtccagagcgtcgcagggatcgtgctcaccggtggcggcgacgtcgggcccgagcgctatggcgagtctgcgcgcaccgagcggctctacggcgtcgagccggcgcgtgacgagctcgagatcgcgttggtccacgcggcgctcgatgcgggtgtcgcgctgctcgcggtgtgtcggggagtgcagatcctgaacgtggccctcggcggcacgctggtccaggacctcgaggaggcgggctatcgtcgccacagcgtgcccgagcacgagtacgacgtcgcccacgacgtgctcgtcgagccagacagcgtgctcgcgagcctggtcggaacgcactacggcgtcaactcgctccaccaccaagcggtggagcgtccggccgaaggggcccgcgtcgtcgctcgctccgaggacggggtcatcgaggcgctcgagggacgggggttcctcgcggtccagtggcatccggagcgcatgctcgacagcgatgagcgggctcaaggcttgttcgagtggctggtcgctcacgggagccggtcatgagtctgcgagccgtgatcttcgacgtcgacggtacgctcgccgagaccgaacgcgacgggcatcgagtcgcctacaaccaggcgttcgcgcagttcggtctcgacattcactggagcgtcgaggagtacgggcggtggctccaggtcgctggcggcaaggagcgggtcgaggcctacctcgccgagcatcccgacgccgctcccaacggggtcgatctcgatgcgctccacgaggccaagaacgccgcctacgccgcgatcgtcgccgctggcggcatctcgttgcggcctggagtgcgtcgactgctcgacgagctcgcgagcgcgaaggtcgccgtggcggcggcgtcgacgacgacgttccccagcctcgacgcgctgttacgagccgagctcgggccggactggcaggatcgtttcgccgcgctcgccctcggcgacgtggtggtgcgcaagaagcccgatccggggatctaccactgggcgctcggtgcgctcgggtcaagctacgacacggtcgtcgcgatcgaggacaaccgtaacggtttgctcgccgccaagggtgcgggccttgcggtggtggtgacccgatctctctatgcgaaggacgaggatctgcacgaggcggacgtgctcgccagctcgctcggagagccagcgtcccccgcaacgatcgttgtcgacggcgccccgcacgagggtgtcgtggacctcgcactgctggagcgactcgtcgagcgtgggtaggtgcgcagcgcgcgagcagcgcgcgtggctgctcgggtcgtgaggggccggctgcggatcgctggatgcctgggtgtctcacccaggcggtgtgcgtgccgactgcaagggtggcacgggctcgtgggccttgtcatgctggctgttctcgtggtcgggtggatgctccggcctcggcgcgtcgtggtcgacggcctctccatgcgcccggccctcgaacctggcgatcgtctcgtcgtggggcccgggcgcgctcgggtggggaggatcgtcgtcgtcgacttaggcggtggacggcccctcgccgtcaagcgcgttgcggctcgagtacgaggtgccgtgtgggtggtcggggacgatctcgctcactcgaccgattcgcggagcctcggatggatcgcacgaggacgcatccacggcgtggtctggtggcgctacgggccgagcgatcggcggggccgggtcgcgcctgcgccatccagcgactccacagctgggctaccaaccatccccagcacgattacctaaggtgaagatcaccaaccccccacacccatccaacgaggcccgcagctgcgggcctcgttggcgttgcgggccagcgtggatgcccgactcctacgcactccacaggttccgtgcctgccatccccagagcacgggcctaggttgaccattacaacccccccacacccacccgaggaggcccgcagctgcgggcctcctcggcgtctggcgacgatgtctcctggcgacgatgctgcgtgcgggtgtgactgttgtgaccagatcggactcttgacggctcgggcgagtagctgactcgcaggtggcgtccgagcggagagagcccctcgatcaccccgatcgtcgcctctcgaggaggttgtggacgagagcgccggcgagtccggcgccggcgaaggcgcccgcggctccgatgacgagcaggagtggcccggcgccggctccgagcccagcgatggcggcgctgacgcgagctgcgccaaggaccggtccgttggtggcgacgacggcgaggtccacgagccagccgatgagccccgcaagaccggcgagccacccgcccaccacgaggccgagggcagccccgacgacgatcgagagccaccacgcgccgacgaggttgccgagggcacagatgacgatgcccgcagcgaagatgacgatgcccgcagcgaaggggagggggcgacgcgtcatcgcaggcccaccaaggtccaggtcgcgatgggatgggtcaggctcgcggtggtgaagctgaggtagcgaccgttccaccacagcgggatcaggttctcgtaccacgcagacagggggttctcgctctcgccaccagggaggatgccgagcgacgctcgtccgaaggcgacgatcatcctccagctcggtccttgctccgacaagagcccgccgtcggcggcgttgacggtccaggcgtcgccggacgatccgcgtggcccgtaggcgagcgaggccacgcccgtcagcgaggggaactcgcggcggtggatgcgacgccactgccaatggccgacgctcccgaggtggctggtgagccaggtcgcggtctgggcgagggcggccgtggcgatcgcagagggtgaggggtgaggatcgccgggcgtcgcgatcgcggtgggtgtcatggtcccggtgtcgatcgcctggaggtcctcgagcagtggatcgttgagctggttgatgacaaggatgctgcccgtgggttggtcgagccgagcgctgcgccagagcggaccgaacaggtcacggatgtcatagccgagccaggtccaccagacgctcgccgcttgcgacgaggctcccatctggtcgttccaggaggcgaggaggtggagcgccgcggctgcactcgtgccaggcgcggcgtgggcgtggtgcacgatccacggtacgagctgggtggcgaggtagtccgtgaccgaggtttgcaggtgctcgaccgcacgcacaccgagatgcggggtagtcgagagtacatgggcgatctcgtcggctcgaaagccgttcgcgtagaagtcggcactcgtgccgaggtagtaggggtagccaggacccacggggcgctggttcgccgagaagacgaagcctcgtgccgggttgttggactccgggacggcatcgaaggggatggcaccgatgggctgttcggtgccgttgccgttcatcacgagccaggggatggcgcgacggaactggaggtattccccggctgcgatgatgccgatctgcccttgggcatcggcgaaggcgaagttctgcgcgggtgccttccatccgcgaagtgcctgttcgaactcgccgagcgtctgcgccttgatggccttgaggagggccgggaagtccagcgagacctggtcgccgagccagtccaccgcgacgggggtgccgcggagcgagatcactgggccatcgacggtgaccggcaccgtgatggtcaccggctggcctccgtggatggcgatggtgtagtgccggtaggtgtaggggcgccacgtgccgtcgaagcgataggcgccggggtgtgagggggaggtggtcatgcggtagaagtacgtcgcctgtgtctcggcgtcggtgaggctccacgcggtcgtcggggtgcgcccgatcaggacgatgggcaggcctggcgccgcgacccctgcgaagtggtagccaggtgcattggcactcagccagagccagatcgacgggagtgtctggggcaggtgcgggtcgccagcgaggatcggcgcgccggtcgtggtgtgcgtggctgcgatggcccagttgttcgagtcaccggcttggtggcgggcccacgcgggcacgccgctccaggcccgctcgatgctgccaagggccgatgtgagttggtgtgagacggggaccggcgggtcgagcggcgtgatgccgcttgccggatagggcccggtgtcgaaggggctctggggatcggcggcgagcgtggggaacaatgccttcacgcgagcgagcccgaggcgcgcgaccgcacgcgtgaggtcgacgggctgctgggtgtagtcgagctcttcggcgaggaactcttggacgagcatgctgtcgacgggctgccagggcgctggcgtcgtaccgaggaggaggtagggcgtcgacagggcatgatgggcgatctcccagctgcgtgcggcgttcacgccggccgtgaactcgtcgaggatcgcgcgatcggcgggaggcagcgccgcgaggttcgcctcggccgcggctcgcaccccgaggcgtagctggaactcgtccgatgcaaggtaggtgtgtccgagcagcgctgcgagcgtgccgcccgcctctcgtcgcagcaggtccatctcgaacaggcgtgtacgaccctcggcataccccatcgcgtaccagaggctcgcatcgctcgtggcactgaccccgatgaaacccgtcgacgtaaagccgatccgcgcggtgcccgggaccgccatctggaacgaggccgacgtgggcatccctgcccgtgtggcgagggcgagtacccctgtcgagggatcgagcacgctgccgagcgcgggaacgcccgcgaccccaaccgcctcgatgccgacgaccccagcgagcacgaccgctgccgcaacgacgcgtccgatccgcacgtgacctccccccgcgtgcgacagtagcagtcgaacgccaagggggctcgtcagctcacgagctcggtagcaggggtcccgacgccgcgttcgggtgtgcgcattcttgctggagggctcggacgaggtggtcctcgctcacccgtcccacctcgccgagggtcgcagcgagcggctgataaccgctgttcgcgccggccgcgatgttggcgaggggttcggcacgttcgaggagcacctcggcttgcgaggcgagcgcgctgcgcgtcgcacccgaggccgtgttcgcccgttgccagagggcgatggaggagcgcacgagtcggcacgccgctgtcgcgttcgatccggcgctcgcgccgcaggccgcaaggagcgctccaccggcgaccgcgaccgccgctaggcgcagtgccttggtgggtcccacgagcccagcctaccgagacctgctggcggtgctgggccccgggtaggctcggacccatggcgaccctgttcggtccttcatcggcggtgtgggtgctccatggtgatgctgccggcctgatcgggggtttgcgcgcactcgcggtccaagcgctcgagcctcgagcactcgcgggcgtcgatcagttctcgaggttccagaacgatcccgatcgccgactggccgagaccgtcgacttcgtcgacgtcatcacctacggcacgctcgaggaggtcgacgccgccatcgagagggtccgacggctccatgagggggtgcgcggcgtcgaccctgtctcggggatgcccttcgacgcgaacgaccccgagcttctcgccttcgtgcacgattcgctcgtcgcctcggtcagcgtggcgtatcgaaccttgcaccctggcgctccgacgtcactgctggatacctacaccaccgagatgcggcgcttcgccgagcgcatgggcgcggacctcggtctcgtgccagccgacttcgcggggtgcgtccgtctcgtcgagtcgtggccgaccctgaccgtgtcgcccgccttccgccgcgcgttcgaggtcctcgaggcgctgcacgtcgaggggcccgtgcagatggtgtggccagccgtgatgcactgggttcgccactcgctgcccacgtgggtgcgggtcgcgctcgaggtggaggaggatccggtcggtgatgcggtcgcgtgggtcctgctcgagctcgccacgcggatcgggcgggtgatcgtgccgccgtcgcctcggcgtctcgcggcgctcggggtcgcctaggtggacgacgccctcttcgcgacggacttcgacggcacgctcctcgactcgaccggcgagccggtccgacggagcgcggacgccttcgccgcggcccgacgcgggggcctcgccgtcgtcccggtcacggcgcgagggccgcggtcgtcgctcgcgatcgcgcggacgttgcacctcgggcctgtgtgcgtctgttcgaacggcgtgctggggctcgacgtgcgcacgggtgacgtcatctggcgccacggtctcccgccgggcagcgtcgccgagatcatctctgcggtggcgagggagatccccgaggctcggttcgccgtcgagacgcgggagcagttcctcgtggaaccggcgttcttcgagccgcagtggcgacggttcgcggtcgcgacggtcgtcgctcggcggggcctcgccgccgccgaggtcctcaaggtcgtcgtgcgcgcgccccaccggcgtggggacgagctgcagggtcaactgcgtggcgtccttggaggcctgtcgctgatcccgggctccagcgactggctcgacatcatcgcccatggggtgtcgaagggctcaggcatcggtctcggtgccgaggtcctcggcgtcgacctcgagcgggtgggtgctgtcggcgaccatctcaacgacgtcgcgatgttccatacggtgggccgcgcttacgcggtcgccgacggtcatccgcgcgccttggaagcggcggatgagatcgtgtccgcctgtggtgacggtggggccggcgaggcgctcaggcgcttcgttgacaccattgacctgccaatgtctcagcgccttccaaggcgcgaacggtagcgtgacgccgaacaggagggtgttcgggtgctgtcgcgcatgatcgatacgatgctcgccgatcgctcaccggctgaggagtacggcgcatcgcggcgagtgcgggccgtggcgcgcatcatgtcgctgctcggggtcgtcctcttcgtcggcctcgccatcgagggtgtcaccattctcttcatcggtcagctgatctccatccacatcctgatcggcatggtgctcatcccggtgatgggctacaagatcatcgtcgccacgtatcgttttgcgatgtactacctgggtgtgagcgatttcaagcgcgccggacctcccgagccgctgcttcgtgccatcgggccgttcgtggtgctctcgacgatcgtgctgatggggtcgggtgtggtgctcgcgctgctgcctcctcagtcggtcgaggtcgcgacgtggcgagcactacatcaagagtccttcatcgtgtggtttgcgttgatgaccatccacgtgctcgcctatgcgcgacgagccttcgggaccgcgaaggacgacgtaacggagcggcgctatcggtcgctcgtgggtcggcgagggcggctcgtgagcgtcgtcatcgcgctcgcgctcggcgtcgtgcttgccgtcgtgatgatccctgcgatcggcccgtggtcgcactacctcgcatcgttgggcgttcgctgagcggcgcctagcgtggagacgtgccagaagccgctggtggtgtcgaccaactcctgacgctcgcgagggaaaccgccgaggcctgtctcgcaagtgtcgaggcgacctcgaccgactggtcgtccacgggggatcgtcggggacagcatcgcggtgacgtcgttgcggaccaggcagcgctcgaactgctcgatcgcccctggctcaacgtcgtttcggaggagtcgggggtgctcgatcgaggagccgcgctgacggcgatcgtcgatcccatcgatggctcgaccaacgcgtcgcggggtctcttcccgtgggcgagttcggttgcgatcgcggacgacaagggccctctggtgggggtcgtgagcctgtgccgaggcggcgggacctactgggccgtgcgcggggcgggagctcgcagggatcggcggccggtcagctcgagtgccgcatcgagcgtgcgcggcaagctcgtcgcctgcaacgggacgccacgggcgtggctcgggtggggacagttgcgcgcgtttggctcggcagcctctgagctggccttcgtcgcagaaggcagtatcgacgctctggtggacttctcggaagggcttgcgatctgggacatcgcagctggcgtcctcatcgcgcgtgaggccggcgcggctgtcgtgagggcgaacggtaacgaggtggacctcagcccgacggcgccgcgacagcgaatcgtcgctggagcgtcgacttcgctcgcgaccgagcttgtcgccgcccttgctggggtcggcttggagcggcgatgacgctggcatgggtcgatcgggacgacgatctcgccctcgcgctcgacgcgatccgtcgttatcaggccgaacttggcgaggacctgtgcttccaagcacctgacgacacgatcgaagctctgcgtgggcattacggtcctcctggcggtgtggcgctgtggttcgacgggggacgggcggtcggcgtggtgtgcgtgcgcaagctcgacgagcatcgagccgagctgaagcggctgtgggtcgtgcccgagtatcggggtcgcggttggggccgagcgctcgtggaggcggcgctcgagcgcgcgcgggcagctggctttcgcgagatcgtcctcgattcgctcgatcgtttgcagcctgcactcgagctctatcgaagccttggattcgtctcggtcgagccgtacacgaccaatccgcttcccggagccgtcttcctcggccgtacgcttttcgagcgctagggtgaccaagccgagctcgtgcgaagacgttgcggctggctctctcctcgcaaccaggtcaacaggccgagatgttgggcggatccgaccggtgccgcgtggcggacaagggaccgacttcttgggcgaagcgtggagcgctccgcgcgcgaatcgagcgatgcgtcgtcgatcggcgtgagctcaggtcgcttcgtgagcgcagctggctctcggaggacgtcgaggaggaccgtcggagcgaggctgaggtggctgatgaggatgtcatccgcacgcgcgagctctgcttcgaggaccgtcagtgttcgtcgtgcgaggcgtgcgcagggcgccgttcgcgccaccggaactgatgccgtgtctccagctgggcttggcaggagggttcacgtgactggcgccccaatggggagctggcgatggacgctcattgtcggagcgtgtcgcgcactcggtcgaggcgatgcgcggcggtggagactggcggcacgacggacgcacctgccaacgattcctcgagtgcatccggggagcgtggcaccgacggtgtgccaatacgaatccatcatgaactgagcccttccatgtccacgatgttcgtgctcgcgagcggcgagtgcttacgacgaaggttcttcgagtagttgttgtacgtctcggctctgccattcgccgtaggtgatgcccagtccctcaactttccagctggtgcgtccattgtcagcgcggcccgctaccatcgatgatgctgccgaaggggaggaaaacacgcagttacgggtgaaggtacgagtcgtgccgtcggggctcagcgccagtgttccatcgtccacgagcctctggtgcagcggcttgtaggagctatcgtctgcgccttgccaatccttccgcgcggtcgagccagccaggaccgtgaactcgccgtcgatctcctgcgcggtcgcactgatacccgcgcgcttcagggtgtagtgcaacaatggcgatgccgggtagggcgcttcgatcgtcgcctgaccggcatgatcggctgccgccatgaccgaacggctcgcagttgatcggaggaggttgactccgaggaccggcagcacgatcatggcttgggctatgaagtactccatgtccgagacatcggcttcgggtagttggggcggtggcggcgcggtggcattgtccaaagctgctcgatgtgcctgttgagcgagcgtgatcagtcgtgactcgaggtagcgggcgtgagccttcgtgaggtttgtgtccttgctcgtcaggacgatgactcggtcccagaagtccttgccgccttggctctcggggcgagcatgttgggcgagccgcttgctgacgtcgtcgccctcgccgatgtaggcgacggtgcctccgagacgcttgggatcgtcccccagcaagatgtagatgccggttcgccccgtctcgggtcggcgaagaaggttcgccaggtccgagcggggtgcagcgacgacgtgccccgtccagttcatgatctcggcggtgagtaaccctcctggcgtcccgtcggccaagaagatgcgaatcgacttcccggcggtcacgtgagggcctcgtgtgctggttgtcgagtacgtcgtgcaagcagtgtctgggcgaacacgaccggtagcgtagcattcctcgcgctctgtgaggaggtggcgtgatcggctgagatggtgagcaatgacgccgtgtcggtgcgtgcgatacggccgctcgtggttcactgtggcatggccggcgaccggtgcggtgcgtgcggtgggtatcgcgcgtgcgcagcgtcgcagtgcatgaggggcccgacgacgacatcgcggcgtcgcccaggagtcagaagttctccgcgctcagcctcatcagcgctcgacgggaccagcgagcagtagcgtgaggaggtcgggtctcacgttgagggtgggctcggtttctttgtccggccagagcctgtcgagcaaacgaggcaagcccgtagggctgagatccgcgagaaggagctcaggtggacgaatcaatctttgtcattggatcagacggtaggctcacttcaatccagaagaatacctatgaacgtgaggctgaactccagcagcttatcaaggatcatccggaactcatacctgcgatgggtggtagcggagaaggcgaacccatccgctggctactggtgcgacgggaagcggggataccgcgagaggatggcggctcagattggtgggccatcgaccacatcctcgttgatcaattcgcaatcccaaccttcgtcgaggtgaagcgagcaagcgacacgagggttcgtcgtgaggttgtagctcagatgctcgactacgttgccaatgctaccgtttattggcagcccggcaccctcgaggggtggttcaatgctcagcatgacgatcccgagcagcggctcttggatttcttggacggatcggaactcagctccggcaagttctggtcgagagtcgacgacaacctccggtctggtcgagtaaggtgtgtcttcgtcgccgattctgttccagactcactgattcgtctcgtcgagttcttgaacgaacacctgcgacgtaccgaggtgtacgccgtcgagttgcctcagtatgtaagcaccgaccaactccctggagtgagggtcattgtcccaagggtgatcggcgataccgtccgtgcgagtgcgaacaagcgggagggacaatcggttccgaagcggcagtgggatgaggagagtttccttgccgccctccgagagcgtagcgatgcggccagcgtgacactctctcgtgagatcctcgaatgggcacgcgcccatggtgtccgagtgatctacggtaatggcaaggttgatgcttcaatgatgctcgtcgtcggacccaagccgaacgggtatgtctttgcgacggtctggagttatggctcgatcgagatcgatctccagtacatgaggcgttcgccagcgtttcgggaagacgagagtcgacgagaggtgatccgcagactgaatcacattccaggtgtcgcgatcgacgagttccgttactcccggcgtccgaatgttccgctaactgtgttcgctggggatccggcgcgaaacgagctcttcgatatcctctcttggatcgtggagcagctgagatctcctcttctgtagagacgcgccgtcgcgagctgtcaggtagtgaggcgagccacccttgtgtggtggtttgatggcaagtgttctgcagggcgggtcacgtcgggtccgttgcttgcggatcaaggcaagccggctgcctcgataggacggcggatggctcggactttcgctctggcgggcgctgccgtcggagatcccagaacgggccgacataggagcgaacccgtacgcaggtcgacgtggtgagggtccgaggaagaggacagagctctgtggtgggcgctaagggactcgaacccctgacctgctggttgtaagccagctgctctgaccacctgagctaagcgcccgagagacgtcagcgtagcgggcgttcgggttcggaggcggagtgccgggggcggtgtcccacccgagtgagcgccgtggcgatcacgctcgcgacgacgagggcgacgccgatgcccatcgatagcgaagccactgcgagtccgagcgccaccgagaccaccgccgcaaccaccggctccaaggtcccgatgatgttcgcctggagcgcgacgacgcggtcgagcgcggtgagatacagggcgaagggcagtgcggtcccagcgatcgcgacgaatgcgacctctgcccagccggtcccatcgagcgagcgaggccacgccatgatcaggaccggggccatggggatcgcgccgagcacgaacgcccgtgtcacgacgcgcggggccggctcggctctatacaggggcgctggcgcgaggttgtagagcgcggtgaccactgcggaagcaagcccccatgcgatggcggtgagaccgacgtgctcacccgggctgatgccgacgaccaagccgaccccgccgacggcggcgatcacgatcacgacctcgatcaggctgggtcgttgccaggcgcggagggttccccagagcaggatcaacacggggctcgtgaactgcagcagcgtcgcggtcacggccgagccggtcgcgaccgcgaggaagtaggtcgcttggacgccgagcaggccgaccagcgcgaacacgaggagccgacctcggagcgctcgggggccgaggctgaagctgtgccggatcgggtcgtgacggagggcctgccaggcgaccagcaacgctgccgagacgatgatcctgctcgcgaccagccacagcgcggtgacgtcggtcgtgtcgaacaggcgctgcgcgacgacaccggagatcccccacagcgtcgcggcagcgaccacgctggccagcgctcgacggtcttcggtcgtcacgaccccaaggctaggtcgtgggtatggacgcttgcctcgcgtgccgtacgatagggcgagccggacgaggaggaaggatgccccaaccgagcgcgtcgttctcggtgacggtgcgagtcgagctcgacgatcctcgagggatcgccgaggtgacccgcgttctcaccgagcgtggtgcggtgatcactgcgctcgacacgatcgagtcgcgcgcgggccacctcgtggtcgacgtgacctgcaacgcggtcgacgaggtccatgccgacgaactccacaaggcgctcgatgccctcgagggtacgagggtgcgcgcgatgagcgatcgcaccctcctgctccacctcggtggcgtcctccaagtggcctcgaaagtcccgcttcgcacgcgtgacgacctgtcgatggcctacaccccgggcgtggctcgagtctcggaggcgattcgcaacgatcctgctgccgcgcgcaacctcaccattcggcgtaacgccgtcgcggtcgtcacggacggatcggcggtcctcgggctcggcaacattggtccggcggctgcgttgccggtgatggaaggcaaggcgatcctgttcaagcgcttcgccgacgtcgacgcttggccgctctgtctcgcgacacaggatccggacgagatcgtgcgggccgtcgagatcatcgccccggtcttcggcggcatcaacctcgaggacatcgccgctccgcgatgcttcgagatcgagcgccggcttcgcgagcggctcgatatcccagtgttccacgacgaccagcacggtacggcgatcgtggtgctcgcggcactgctgaacgcgttgcgcgtcgtgggcaagcggctcgaggacgtgcggatcgtcatcgtcggactcggtgcggcgggggtggcgatcgcccgactgctgctggccgagggcgtgcgcgatctcatcgccgtcgacgtcgacggcatcgtgactccagacgatcccggcctcgatccggctcgacgtgagatcgccgaggcctcgaatcctcgcaacatccgtggtgacctccctgaggcgatggagggtgccgacgccgtgatcggagtctcacgacgcggcgtgctgaaggcggagcacctcgagcgcatggcgccgcgttcggtcgtgttcgccctcgccaaccctgaaccagaggtggatccagagatcgcgcgccgcttcgccgaggtcgtcgcgaccggtcggagcgacgagccgaaccagatcaacaatgtgctcgtgttccctggcttcttccgcggcctcctcgacgcgaacgcgcgcgagatcacgctcgccatggagcgagccgccgcgcacgcgctggcggccatcgtggcgcccgacgagctctcaccggcctacatcgtcccaacggtgttcaacccgagggtggcccccgccatcgcgaaggcggtggccggggcgatcacggacagctaaagcgttcgacgcccttcgatgccgcgaaggcgagccgtggcgtgccgttcgtgagtcgaaagcccagcgacaccatctcgctgggcggattgtcggaggcctggaggttcggatcagtgaggccgacgaccgtgaagccctggttcggggacgtaaaggtcgggttggagctctcgcatccgaccgtcgcgatgaccgggcctgcgatggtgtacggcgtactcgtggtcgtcccgggcggactcgggatcgcctcggcgtggcggaggccgctcagcaccgtctcgaagtagaagatggtgttcggcggatccttgacgagcggtgatggcggcaccgaggcgaggatcgcgacgagctggggcccggccgtacctggtttgaaggcgtacacgccgttcgggacgttgccgaccatgttggcacacgacgccgaaacgatggcgagtggtgtcgtgccggtcacgtagccgacgaccgttccctgctgcgtgggcgggccgctcaatgggtggcagtgcggggccaaccccgggtaggtgagcttcgaccacgctacgtctgcgaacgcagcctcggccgctcggtcggacggtgtgaggacgaccggggcctcgcgaggggcgcgaggggtgggacgtgcgctgatgccgacgctcgactggccacaggccgcgagcgccacactcgtgcctaggaggctgatcaccgctcggctcctgcgtcgattcatggtgcatgtcagcgtagtcaacgggtgctgagcgagcgcgaggctcccgggtgcgcgacccgaccatgggcctggctcggctaccgggcgaattggaggggagtgcctgcgacaggtgccgatcggcggtagcctgggcccagatggttgtgcctgcaccagagacacgagcgagaggctggagtccgagcgagccgcggtggcggatcgacgagttcctcgccgagaacgtgcagcttcgacccgcgacgaggcgacgctaccgcgtcgtcctttccaacatccaggctcgagcggcgtcgctcggggcggcatcgccggctcagctggacgctcacgtgttgcggcggctccttgccgctcctgggtcgaacgggccgtacgcgccggcgactcgcgatctcgagcgggtcgtgctgcggcgctacctcgtttgggagggaagtgaaggggcactcgctctcgcggcgcagctcgctgcgtttgccaggcggcgcccacggcccttgccgcgcggcatcgacgagacgacgctcggatcgaccctcgacggtctcgatgctcgggcggatgcgcgtgcgatggcgatcctcgagctggcctatgcgacggggttgcgggcgagcgaactgtgtgcgctcgatcggagcgacctcggtccgggcgaccggtggctggtcgtgcgggccggcaagggaggtcggacccgccgggttccgatcggcgaggctgcccggacggcgctccgggcctacctcgccacgcgcgacgacgatgccccggcactgttgctcggagcccgcggggctcgactctcgccgcgggggctacagcggttgacccggcgctatctcgatgtccacccgcaccagctgcgccatgccttcgccacgcacctgctcgatcacggcgccgatgtgcgatcgatccaggagctgctggggcatgcgcgactggcgactacggagatctacacccacgtgtcgcgcgagacgctgacgcgcgtctacgatgcgacgcaccctcgagcagggcgaggagaggcatgagcgacgacgaggtgatcgagtcggcgtggcgccgcttcaagcacgacggtgacctcgaggcgcgcaatcgcctgctcgagcactacgcgtccctcgttcgcttcgtcgcctcgcgcgtcgcggtcgggttaccggcgagcgtcgaccccaacgacctcgccagctacggcaccttcgggctgatcgacgcgctcgagaagttcgagccggagcggggcatcaagttcgagacctatgccatcacacggatcaagggcgccatcatcgacgagcttcgcgcgatcgactgggtgccgcggtcggtgcgggccaaggcgaagtcggtcgagcaggcctacgccgcgctcgaggcacggctgcatcggccccccaccgatgccgaggtcgccagcgagctcggcatgagcgaggacgaactgctggcgatctactccaagatctcgttcctcggactcgtcggtctcgacgaggtggtgatgtcgggcgagcgcggtgagggtatgacgctcggggacacgcttgccgatcgtcgtcaatcggccggtggcgcattcgaggagcaggagcgccgtcgcatgctcgccgattccatcaatcagctggccgatcgcgagaagaccgtcctcgtgctctactactacgaaggtttcaccctggcggagatcggccggatcctcggcgtgaccgagagtcggatctgtcagatccactccaaggccgttctggctctgcgaggcaagctcggcgacctgatcggctagggagccttgccgaggcgcctaagctgtggggccgcacgttcgtcgtcgatactcgggcactcgaacccacggtcggccacctgagccgcatggagtgcccgctgatccaaccgttgggaggttgaaccgtggctgagcgcccgttggtaacgatgtcgcagctgctcgaggccggtgtccacttcggtcaccaaactcgtcgctggaacccgaagatgcgtgagcacatctacgagcggcgtgggggcatccacctcatcgacctacgtcacaccctggagggcatcgatcgctcgttccgcttcgttcgcgatctcagtgctcgtggcggcaccatcttgttcgtcggtacgaagaagcaagcccaagacgccgtgagtcagtacgcgcgccttgctggggttccctacgtgagccaccgctggctcggcgggatgctgacgaacttcggcacgatctcgcggcgcgtcgcgaagatggcagagtacgagcgcatgcgtgaccagggcgacttcgaggcgatgccgaagaaggaggcgcttctcttgtcgcgcgagctcgccaagctggagctcaaccttggaggcattcgcaacctgacgcgcttgcccgatgcgatcttcgtgatcgatacgcccaaggagcacatcgcggtcaccgaggcgaatcggctcggaatcccggtggtggccgtggtggacaccaacgccgaccccgacctcgtgacctacccgatgcccgggaacgacgacgcgatccgcgcgtgcgagctgttcacccgcttgatggcgaccgccgtcatcgaaggccggcagcgtcagcaggccaagccggctgcctagagaccgcggccacgaacgaaggaggagaccaggtggtcagtgcgagcgatgtgcaggccctgcgccgtgcgacgggcgcaggcatgctcgatgccaagaaggcgctcgaggaggccgatggcgacgtcgagcgagcgacgcgcctgttgcgagaacgaggcctcgcctcggctgccaagcgcgtcgatcgagacaacgccgagggagcggttgcgctgtcgctgctcgaggaccgggcgggtgcgatcgtcgagcttcgctgcgagacggatttcgtcgccaaggcgcaggatttcgtcaacaccgccaacgagctggcggcgaccgtcgcgaccgatggggagcaggccgttgccaagttcgagagcatcatcgaagacttgcgcctgagcctcaaggagaacattgcgctcggtcgggtggtgcacttcgcggccggtgacggcgacgtcgtctcgggttatctccacgtccaggcagaccgcggcgtgaacgccgtgctcgttcagctgcacggcggcacggccgagctcgcccacgacatcgcactgcacatcgccttcgcccggccgcggtacctgtcgcgcgccgacgtcccagccgaggaggtcgagcgcgagcgtgagaccttcgaggtgcaggcgcgcaacagtggcaagcccgaggctgcgctcgccaagatcgtcgagggtcgcctcgacggcttcttcaaggagatctgcctgctcgaccaggccttcgtgaaggacgagaagcgcaagatccacgacgtgctcgcaggtgcgtcagtcgttcggtttgcgcaggtggagatcggtcgctgatcgtgggggcctcctggcgacgggtgctgctgaagatctccggcgagtcgctggccggcgaggatcgagctcaatcgatcgacccggcgatcttgcagcagctcgccgaggaactcgtcgagctgcgcacggtgcacggcgtcgaggtcgccgtcgtcgtcggcggcgggaacttgtggcgcgggaccgacggtacccagatcggcatcgatccgccgacgtcggacaacatgggcatgctcgccacggtgatgaacgcgcttgcgctgcagagcgcgatcgagcggctcggtcagccggtgcggctccagagcgccatcacgatggccgagctcgcagagccctacattcgccgtcgggcggtgcggcacctcgagaaggggcgcatcgtcgtgttcgccgccggcaccggcaatccgttcttcaccactgacaccgcagccgcgctgcgggccgccgagatcggcgcgagcgtcgtgctgaagggcacgcactcgggtgtgagcgggatttattcgtccgatccccgggtcgacccgtcggcggtgcagctggagcgggtcggctacatggaggtcatcgagcgcaacctcgccgtgatggacatgaccgctatcaccttgtgcaaggagcgggccatcaaggtcgtcgtcttcgacgtctcgttgcggggtaacatcacgaaggcctggcgtggccagatcggaacgttggtggagtaatggctgatccagtcgatatcgatgcggagcttgcggccttcgaggatcgcatggccaaggcagtgcgccacaccgaggaggagttcgcgaccgtccgtacgggtcgggcgcaggcggccctgctcgatgggatcgtcgtcgagtactacggcgagcgcgttccgttgcggcagttggcgtcggtgacgacgcccgatccccacagcctgctcatcgcgccctatgaccgcaacgcgatgggcgccatggagcgagccattcgcgattcagacctcggcgtcaacccgacgaacgatggctcggtgatccgtatcgcgatcgcgccgctcacggaggagcgtcgtcgagagctcgtcaaggtggtgcgcaagcgcgccgaggaggggcgggtggcgatccgaggcgtgcgccggcaggccaagcagcacttcgagtcgctccagcgccaaggctcgctcacgacggacgacctcgccgacatcgagcgcagtctcgatcgcctgacggcccgctttgtgggcgagctggatcgagcgctcgaggtcaaggagcacgacctcctcgaggtctaggccggccggtgagcgaacacgacgaccgggccccgcagtcggagcctacgagcgagcctcgaggcctgtcgcccgagcccgaacgacagcgagagcgcggggcccacgcagggcctgagaacggtacgcctcgcgagggcgcgagttcgacggatgcgggcgtgacagaacccctcgcatccgcggtgccacctggccccgttcggtcgtcgggccgtgacgaggggagcgacgacgacaccgtggccctccccgattggcgagagccaccgaccggtgacgttcctcgggtcctcgaagaactctcgggcatcccggtgcgcgatctcggaggacctcgtaccggtgagttgccctcgatcgacgacgaaacagttccgtggtcgccaccgtcctcgacccaaggtgagcgatccaagctcgacgacgacgcgcgtccacgccgagaaccgtccgaggctgcgactccccgagcgcctcgccatcatcggcgcaggcgcgatggcggcgagggcgaggccacgactcaggacgcgggcgtcgagcggcgcacggcggccggctcgcgtcgtcgagggggcgttcgcggcgcgacgcccggcgacgagcgatcccacggcggccccgcccggtccaaggcgctcagcaccctcaccggcattgcgctcgctgcgatcgtggtcgtagccctcgtcctggggcggatcccgttgctcgtcgtcgtcgcgctcgcgctcgagctggctgcttcggaggccttcagcgtgctgcaccgcggcgggctcctcgaggcgcgcttcctcgggctcgccggggtcggggcactcatcggagtcgcttacgcctacggtccggccggtgatggcggcgtcgtcgttgcagctttcgtcctgggcgcagcgtggtatgtcctcggaccactgcggcgtcctgcctacgaggggctctcgcacacgctgggcgtggttgtgtgggtcgggctccttggctcctatgcagcggtcctgctccgaccggcgacgttccacgggcacggcgagctcgtcctcgtcgtcgccatcgcgacgacggtggccgacgacaccgcggctttcttcgtcggatcggtgctcggtcgccatcggctggcgccgcggatctcgcccaacaagacgatcgaagggcttatcggcggtacggtcgcagccatcgtggccggcgcgctgctcgggatgatcgccccgctcagcgtcgtggaaggagcgatactcggactggtcgtcgcggtggtggctccgctcggcgatctgctcgagagtgccttcaagcgccagtttcatgtcaaggactcgggggcgctgctgcctggccacggaggggttctcgatcgcatcgacgcgatgctcgtcgtgctcccagccagctactacctcttcgcggtgatgcatctcaggtagcctgcctaggctgactgtcgtgccgagcgtcgccatcgccggggtcaccggttccgtcggccgccaagccggtgcggtcgtctctcgcgacccggaacgttttcatgtcgagaccatcgtcgctgggagcgatgcgggcgggctcatcgagctcgccaaggagctacgccctcgggtcgtcggtctcgcggtcggtggtgaccgcgagcgagtgcgccagagcctcgatgcgtccgtggaggtggtcgtcggtcgcgaagcgctcgaggcgagcgcagcggccgacatcgtcgtgaacgccgtgagcggcttcgcgggtctcgccgtgactcgagctgcgctgctcgctggacgcaggctcgcgctggcgaacaaggagtcgctggttgcagcgggggaccttgtggccggatggctcgacggtggcgacggcgaactcgtgccggtggactccgagcactctgccatcttccagtgcctcggaggctcgcgcgatggcgcagaccgtgtcgcgtcgctggtgctcacgagctctggcggacccttccgtacgcgatcggcggaggcgctgcgtgacgtgagcctggaggaggcgctcgcccacccgacgtggtcgatggggccgaagatcaccgtggactcgtcgaccctgttcaacaagggcctcgaggtcatcgaggcacactacctcttcgaggttccctacgaccgaatcgaggtggtggtgcatcccgagagtgtcgtgcactcgatggtgcgctttcgggacgggtcggtgatcgcgcagctgtcggagccgaccatggagttgcccgtggcggtggcgctctatcaccccgagcgcgcgccgtacgcgatcggctcgctcgatctcacccgacctcggtcgttcggcttcgagcccgtcgacgacgctcggttccccgcgttgcgcctcgcctatgacgccggtcgactcggaggggccgcaccgtgttggttgaacgcagcgaacgaggtcgcggtggccgcgtttctcggaggtgcgctgcgctggatcgacatctatcgcgtggtcgcctcgacgctggagcggttcgagccgacgacgttcgcatccgaggaggacgtcatcgaggccgatgcgaccgcgcgtgaccacgctcgacgcatcgtggaggaggtaactcgtggctgaggagatggaggcgccaaccctccaggaggctcgaagcttctccggtcgcaggctcgccgagctcgtcgtcgtgctcgtcgccatcatcgcgatcgcccagcacgcccatgcactcggcaccctcgccgtcgtggcggcgatcgtcgcgatggtcgtgctgcacgaacttgggcactacctggtcgcgcggtggtcgcgcatggaggtgaccgagttcttcgtcgggttcgggccgcggatcttctcgtggcaccgcaaggggatcgagtacggcctgaaggcgatcctcgtcggtggctacgtccgcatcaccggcatgacgagcgcggaagaggtcccgcccgagcgtgaggcgcgcacctatcgctcgtcgaccttcccccgacgagtcgcggtcagcgtggcgggctcggtcatgcacttcgtcgtggcatttggcatgctgtggtacctgttcagtggggtcgggacctacgcgagtcggggcgtggtcatcgagggggtcgcacacatcccaggggtggtgaccccggccgagcggatcggactgcgtgctggcgatacgatcctcgccgtcgacgggcatcggaaccctacccttgctgccttcgcgtcgtcgatctctcaccatcccggcacccctgtgcgcctcgttgtcgagacgcccggcggtcgagtcgtctcgcgcacggcggtgccgatccccgcgaccatggtggcgagatacgatgcggcctatcactccctgggttcccaaggcgtgctcggcgtggtggttgcgcctccagtcgaacgatccagtctcgtcggtggggtcgtgccgtcggcgcgcgcgctctggtcgctcgctggtgcgagcgtgagtgggctcgtgtcgcacttcacgccccatgggatcgcgacctacgtgtcggaggtgacgcacccctcggcgaaccccacctcggcaaagtccgcgtctcgcttcgagtcccccgtggggatcgtgcagctcgcgtccgacgcggtcgcggccggaaccggcgccgtgctcgagctcctcgtgctgatcaacgtcttcgtcgggatcttcaacatggtgccgttgctgccgctcgacggcggacacgtcgccatcgcgatctacgaacgcatccgatcgcggcgaggtcgtgcgtaccacgccgatgtcctcaagctgatgccgatcacctacgctgtgatagcggtgatcctctttctgggtgtcaccgcgctgtatctggacatcacgcatccggtgcccaacccgttctcgtagcgaggaggagagcaatggcgcgtcctcagatcgccctcgccccacgacggcccacccgccaggtcatggttgggtcggtacctgtcggcggaggggcgcccatctcggtgcagtcgatgacgaccacccagaccgccgacgtcgagggcaccctgacgcagatctacgccctcgccgctgctggcgcagacatcgttcgggtgacgtgcaacacccgtgacgcagccgatgggctcgcgcgcatcgtgccccgctcgcccgtgccgatcgtcgcggacatccacttccacgtggagatggccctcgcggcactcgatgcaggggtggccgccctcaggctcaaccccggcaacctgcgcaagcgcgaggagatccagctggtggcgcgcgaggcgaaggatcgcgccatcccgatccgcatcggcgtcaacgccggttcgttgcacccggagtttgcggagcgcttcgggggcgcaactccggaggcactcgtggagagcgcgctctacgagctcgcgctcttcgaggaggtcggtttcgacgacgtcgcgttctcggtgaaggcctccaacgtgccgctgatgatcgcggcctatcggctgctcgccgagcgtaccgatcatcccttgcaccttggcgtgaccgaggccgggccgccgccggcggggctcgtgaaggccaccgccggcatcgcgacgctgctcgccgagggcatcggtgacacgattcgctactcgctcaccgctgaccccgtcgaggaggcgcgggcaggacggcagttgctcgaggcactcggcctgcgagaacgcaagaacctcgacctcatcgcgtgtccgagctgcgggcgcgcccaggtggacgtgatcgggatcgccaaggacgcccaggcacggctcgaggagctcggcctgccgatccaggtggccgtcatgggttgcgtggtgaatggtccgggagaagccagggaggcggatctcggtattgcgggcggtcggcacaagggacatctgttcatccgtgggcagatcgtgcgggtggtccccgagcaggagatggttgacgcgctcgtcgaggaagccaagcgactcgttgccgagggcgtcgaggcacggctcgcggccgcagctcccggagcggccgaggaggcagcccgcgatcgcatggccgaactcggtggcgaggagggctcggccaagcgctagccttgggcgccatgcgcgcctccgacctcgtcttcgccacccaacgggaggacccacgcgacgccgaggtcgcctcgcaccgtctgctcgtacgcggtggctacatgcgggcgctggcgagtggggtctggagcctgttgcccctcggctttcgggtcctcgagcgcatcggcgcgatcgtggccgaggagttcgaccgcgcgggcggcaaccagctgctccttccggcgctgcacccggtggagctctggcaggagaccggtcgcaacgtcaccatggacgacgtgctcatgcgggtggattcgaagctcggctccttggtgctcggtccgacgcacgaggaggcggtcatcgccgccgtcgggccggacctcgcgagctaccggagcctgccagccttcgtctaccagatccagaccaagttccgtgacgagccgagagcgcggttcggcttgatgcgcacccgtgagttcgtcatggccgacggctacacgttcgatgtggaccgcgagcacatgcgtgtctcctaccagcgcgtctacgaggcttacctgcgcgtgtatcgccgactgggcttgaaggccgtgccggtcgaggcggacgcgggcgcgatcggcggggacgtgaaccacgagttcatggtgccctcggccatcggggaggatcacttcgcgtcctgtcgtgcgtgcgggtaccaggccaacgtggaggcggctcggcgtggccgggggcccgatcgagtgctgccccccatcgagcagccgagggtgtatgcgacgccgggggctccaggggtgcgcgaggcgatcgcggcactgcgcgccgagggggcacccgtcgacgatgacgggatgctcaagtgcatggtcgcctacgacgacgcgggccggacgacgctcgtgctcgtgcccgggcagcgcagcgtgaggctgccacggggttggcggcttgccggtgaggaagcgttccggcccgaaggtccgttcttcctcggctacgtggggccggtcgggatgcgagaagccggcgtgcggatcgtcgccgacccgatgatccgagagcgtccgtggtgggcgaccggtaacaacgccgagggcgagcacgtcgtcggtgtgcgcgtcggcgtggacttcgaggtcgacgactggatcgaggtggtcgaggtcgtcgacggggatccctgcccgcgctgtggcgctcccctggcgctggttcgcgcggtcgaggtggggcacaccttccaactcgggcagctctattcgtcgcgcatgagccgggggaccttcgtcggcgaggacggggcgacccatccgttctggatgggctgctacggcatcggcgtgagtcgtctcatcgccgtcatcgccgaggagtaccagcgagacggtggcctggcgtggccgctcgagatcgccccgttccaggtcgccgtcgtgcctgccggcagcagtgacgacgtcgcggcgaccgctgcgaacatcgccgaagagctcgaacggatggggcgccgggtgctgctcgaggatcgggggctgagcttcggcgtggcggccagggatcaagaactcgtcggtgcgcccctgtgggtggtcgtcggtgcgcgttcgctggcgcgtggcgaggtcgagcttcgcaaccgcgtcgatgggcggacgctcaccgttcagcttcgcgatgtggcccaggcggtcgacgccgaggccggtcgcatcggcgagcgcgccgactgagcgctatactccctccgggctcgttgcaggggccggggtgacgtgggcttcggcccacgttttttcgtcacctgcgcggctcgctcggcgaggggaggggacatggcggacagccacgcactatggacggcgctcgacgagcgactcgccggtgcggcgctccaggtcgccgacctcgtggtgcggccaggttccgtcgcggtcttcgtcgaacacgacgatgcgagcgcgccgagcctggacgaactcgagcaggtgtcacgggacgtggtcaccgtcgttcgctccgagcttggagacgtggcggtcgaggtgtcgagcccgggcctggaacggcgactgcgcaggatcgagcaggcgcgtgccgtgctcggccgaagcgtcgcgatccgacgcgagggcggtcggctcgggggtgtgctcgtgggggtcgagggcgacgagctgatcgtcgaggtcgacggcgagccgcagcgcatcgcgtggggcgaggtgcgcgaggcccagacgacgtggtcgttggggaccgatggtgcagacgagctggatccggagcgcagcgggaggaacgatggccgttgagaacccagaggtgatggacgcgctcgaggtgatcgctcgggagaagggcctgtcggtcgagacgctcctcgagtcgctcgccaacgcgctcgctgccgcctacaagcggcggcccggcgctgccgaggaggcctacgtcgagatcgatcccgcgagcgggacgatccgggtgatctgccaggagctcgacgagaacggtaccgtcgttcgcgagtgggaggacacgcctcgcgacttcgggcgcatcgcggcccaggctgccaagcaggtcatgctgcagaagatccgcgaggccgaacgcgagcagaagtacgaggagtacgccgggcgcgagggggacgtggtcacggggatcgtgtcccagatcgacccgcggttcacgctgctcgacctcggcaagatcgaggcgatcatgccgcactccgagagcccgtcgaacgagcgctactcggtgaaccagcgtttgaaggcctacatcgtcgaggtgcgacggtccatcaagggtccacagatcgtcgtgtcgagaacgcaccccggcttggtccggcgcctcttcgaggtggaggtgcccgagatcgcgagtggtgtcgtcgaggtcaaggccatcgcgcgcgagcctggtcatcggaccaagatcgcggtgtggtcgaacgatcgctcggtcgatccggtcggagcctgtgtcggtgctcggggatcacgcgtccacaccgtggtgaacgagctcttgggggagaaggtcgacatcgtcccgttctccgaggatctcgcggagttcgtcgagcgggcgatcgtaccagcgcacgccctctctgcgaccgtcgagggtcgcgatgcgctcgtggtcgtgcctgacgatcagctgtcgctcgccatcggccgcgagggccagaacgcgcgccttgccgctcgtctcaccggcacccacctcgagattcggccccagagcgaggtcgagggccgccaggagggtcagccatagcgcccccgcaacggatgtgcgtgggttgtcgggcccggcgttctgcgtcggacctcgtgcgggtgcacgtggtggaggggcgcctcgcggtcggggcggggcctgggcgcggtgcgtggatctgtccgcgggaggcgtgcctcgagcgcgcgctcgcgcatggacggctccgacgagcgctgcgactcgccccgtcggacggcgagctcgtcgacgagggcgtgcgccaggcctggcgagcggcgatcgctgggcacggcgcgtcgagcgcctaggctcgaagtgactcacgtagtgctgtcggcgctcgtgggcagacaggtgcgcgggcgtgggtccgcatcggttcggaggcaagggcaaccagttggcgcgcaagctcagagtgtacgaaatcgcgaaggaactcggtctctccaacaaggaggcgctggatctgtgcctcgcgttgggcgtggacgtgaagaaccactcctcgagcgtcgaggaggcccatgcagaccggatccgacgtcgcgcgcagcgagatcatctcggcatctacgccgaggcaacgaccccccaggtggccccgccgagcgcgccgaccacgccaccgagcgttcgtgagcccgagccggtggcggctcccgagatatcggagccggtcgtggcgagcgcacccgagcggcgccccgacctcgccgcggtgatcgccgaagaggcggccaagcgcgaagaggccgagcaggctgccatcgagaacgcgggtcgagcgccggagcaggcggcgccgcgacgtcagggcccgctctcgccatcggggaatccgatcccaccacccccgggcgggcgaccgctgtcgccgtcgggtaagccgatccctccgccaccacgtccacaaggtccacgcgacggacgcggccgaccggctcgcgaggggtccgggcgccctgtgggcgggtcgcgtccgggtgccgggcgccccggaaccggtggcgggcgccccccgatggggggtgggatccggccgccggcccgcggtggcggcggcgtcagcacgccccgattcgggggcgcagccggtgcgttcgctggccgtcccggtggcggtcggggccgtggcgtgcgtccgaacaagagtcggcggcgcatctcgcgcaaggagttcgaggagctcgagccgacccgagcgacggcctatgtcccgtcgaacgatccggtccctgactacgaggtcatcatcgagcggggctcgacggcccaagaggttgcccccaagctcaaccgctcgccgggcgacctcgtgcgcttcttgctcatgcagggcgagatggtcacggcgacccagagcctcaccgacgagatgatcgagctgtacgcggcggagctgggcgcgaaggtgcgcctcgtcgatcccgggcaagagcaagaagcgcagctcgccgccaagtatctcgatgtcgatgagaccctcgatccgacggccgaggtggtccgccctcccgtcgtcacggtcatggggcacgtcgaccacggcaagacgttgctgctcgatcgcattcgccacacgaacgtcgtggcgggcgaggccggtggcatcacccagcacatcggtgcctaccaggtcgatgtcgaggggggtcgcatcaccttcatcgacacccctggtcacgaggccttcacggcgatgcgtgcgcgtggcgcgagcgtcacggacatcgtcatcttggtcgtcgcggccgacgacggtgtcatgccccagaccgtggaggccatcaaccacgccaaggcggcgggcgtgccgatcatcgtcgcgatcaacaagatcgaccgtcctgacgcggatccgaatcgggtcatgcagcagctctccgagcacggcctcgtgcccgaggcctggggtggcgacaccatcacggtgcaggtgtcggcgctgcagagtctcgggatcgacgagctgctcgagcaggtgctcgtgctggccgaggtcctcgagctgcgtgccaacccgacgggtcgggctcgcggtgtggtgctcgagggacacctcgacgtcggtcgtggtccggtcgcaaccgtgttggtgcagggcggcaccctgcacgtcggtgatcccgtggtcgccggccaggcatggggcaaggccaaggcgctcatcagcgatcggggagagaaggtctccgatgccggcccgtcgacgccggtccaggtcctcgggttctcggaggtgccgagcgcgggtgatccgttccgcgtgacggccgagatctcgcacgccagggagatcggcgaagcgcgcgagcagcggctgcggttggcggcgaacgccaaccgggcggtcggcgcacagggcgtgcggctcgaggacatcttcgaacagatccaacaaggcgaggtccctaccctcaacctcatcgtcaaggccgacgtccagggcagcctcgaggcgctctcggatgcgctcgcgaagctctcgcgcgacgaggtgcgactcgagatcatccacaaggccgtcggtgggatcaccgagaacgacgtcacgctcgcggcggcgtcgcacgcactcatcatcgggttcaacgtccggccggatcgccgagcgcgtgaggccgccgaggtccgtcacgtggagatccgtacctacgagatcatctaccaggtgatcgaggacatcgaggcggccgtggtcggcatgctcaagccggagttcgaggaggtggtcgtcggcgaggccgaggttcgcgaggtcttccggatcccgcgcgtcggtgccgtcgcagggtgctacgtgcgcaacggaaccttgacccgtggtggccgcgtgcgattcctccgagacggggtcgtgctgtggaaggggacgatctcctcgctgcgccgcttcaaggaggacgtgcgcgaggtccaggccgggttcgagtgcggcgttgggctctccgatttccaggacctccatgcaggcgacatcatcgaggcgttcgagctgcgtgaaatcccgcgggggtgagcgtgggcagacgcgcaacccatccgtacgcgcggaccgaacgggtcgccgccgtcctccaagaggtgatcgctgaggcgctggagcgcctcgtcgatcgcgacgagcggctcgccttcgtcacggtgacccacgtcgtcgtgagcagcgatctgcgccacgccgacgtgctgatcgcgtcgggaacggcggagacgctcgaggcgctggacgacgctcgcggagagctccagcgtgcggtggcacgggaggtgcgcctcaagcgcacgcccgccctgcgcttcggccttgacgcgcaacttgccgccgtcgaggagctcgaggcggtgttccgccgcgtccacgaggcagcgacggatgatccagggcatctacctcgtcgataagccgagcggcccgacctcccacgacgtcgtggctcgagctcggcgtgcgttcggcacgcggcgcgtcggtcacgccgggacgctcgatccgatggcgagcggactgctcgtgctcggtgtcgatcgcgcgacccggctgctccgctacctcgaggcccagacgaagcgctatcgggccgtcgcgctcctcggcgttgcgaccgataccgacgatctcgacggtgtcgtcgtcgatcggcgaccggtcgaggagccgacccgcgaggccgtggtgacggcgtgccgtcgcttcgtgccgggttacgaccaggtgccaccggcctacagcgcgctgcacctcgacggcgagcgtgcctacgtgcgggctcgccggggtgaggacgtcacgttgcctcgtcggcgggttcgcatcgacgagatcgaggtgggtgcgatctggcgcgatggcggcccaggggagccccagggcgttcgcgtcgagctcaccgtcacctgtggccccggaacctacctccgctcgctggtacgtgacctcggtgaggcgctcggcacgcccgcgacgctcgcgtcgcttcggcgcgagcgtgtcggtcggctggaggtcgcccaggcggtggggctcgaggacctcgagcgagcgacaccggtcccgcttccgctggcgctcgctggtctcggccgtgtcgaactcgacggggtcgacgccacgaggttcctccatggtcagcgcatcgaggcgccgtcgggtctcgacgagggcgacgtgctcgtcggtgccgagggttcgtggttgggggtggcgagctgtgacggccacgtgctcgcaccgcgcgtggtgctcgtcgatgcgggagttgcgcgggcatgatcgtggttcgagagctcgatgaccctgccttcgtcgtccccagttccgtcgtgaccatcgggaccttcgatggtctgcacctcggacaccagcgactcatccgcgtcgcacgcgacgtcgcgcgtcgagcacgcctgcccttggtcgtggtgagtttcgatcgccaccccctgcgcttgctcgcacccgagcgagtgccgccgctcatcatgacgccactgcagcgcgatcgtgtgctcgcgtctcagggcgtcggcgtgctgtatctgctgcacttcggacccgaacgcgctcagcaggcgcccgcgtccttcgccgccgaggtgctcgcgtccaggctcggtgcgacccacgtcgtcgtcggcgccaacttcaccttcggtgcccgaggggcgggtcgccctgccgacctcgtcgccatgggtcgcgacctcggcttctcggtcgacgtcgaggagttggtcgacgacgacggcgaggtggtgtcctcgagtcggatccgtgcgacggtcgcctcgggggacctcgtcgaggcctcgcgcctgctgggccgtgcttacgcggtcgaaggtgtcgtcgtcgcgggggatggccgcggtcgagaactcggcttcccgacggccaacgtcgtcgtctcttcgtcctatgcgagtccgcccgatggcgtctatgccggatgggcgtggaacgactcgggtcgctgggctgctgcgatctcgctcgggacgaggccgacgttctacccgaccgacggcctccggctcctcgaggtccacctgctggacgccgacgtcgacctctatggtcagtcgttggaggtggcgttcgactcccggctccgagggcaagtcgccttcgcgggtgtggaggagctgatcgcgcagatgcacgccgacgtcgccgaggtccgtgtgcgcgtgggagacctcgagggcaggtaggctactgcctggctgtagcatcatcacgtacgcctggagcgtccaggcacgacacacgaagggacagtgaccaacccatgggttccaaggcggagacgatcgcgaagttcgggcgcagcgagcacgacaccggttcaccggaggttcaagtcgcgctgctgaccgagcgcatcgcccacctgaccgagcatctgaaggttcacaagggtgatcaccacacccgtcgcggcctcatgatgatgatcggtcgccgccgccgactgctcaactacctgcgttcgcaggacgtcgagcggtatcggaccctgatcgcggaactcggcatccgccgctaggcgccgcacgagcgacgaggcgactgcagccggtccctgtctctcccacaaggagcatccatgtcattcatctcggttgagcgtcagctgaccggggtaccctcgccgttgcgcttcgagacgggcaagcttgccctccaggccaacggagctgtggtcgcgcgcctcggcggcaccaccgtgctcgtgaccgccactggggccaagcacgtgcgcgagggtatcgacttctttccgttgaccgtcgacgtcgaagagcgcatgtacgccgcgggcaagatccccggttcgttcttccgccgcgagggtcgtgccacggaccaggcgatcctgacggcacgcctcatcgaccgtccactgcgaccatcgttcgccgatggctttcgcaacgaggtgcacgtggtggcgaccgtgctcggtgccgacctcgtcaatccacacgacgtgctcgccatcaacgcggcctcggccgcgctcatggtgtcggggctgcccttcgaggggccgatcggcgcggtgcgcgtcgcgctcgcagccgatgggagctggattccgttcccgacgttccagcagggcgatgcctcgagcttcgagctcgtcgtcgccgggcgcaagacctcggacggtaccgacatcgcgatcatgatggtcgaggcgggtggcaccgaggcgacctggggcgcattcgaggcgaacgccgccatcccgaccgaagcgacggtcgcggaggggctcgtcgctgcgaagcagtggatccgcgagagcatcgagctgcaagaggagctggtcgccaagctcgatcatcggccgacctttgcgtggacgccgatgcgcgactacgaagaggacgtgctcgtccgcgtgaacgaggtcggtcgcgagcgactggccgcggccaacgcgcacaccgacaaggtgacgcgccaagatgccctcgacgccgctggcgatgccatctgggctgaactcgccgacgagttccccgagcgcgagcgagaggtgcgggctgcgatccgtcgggtcaccaaggagatcgtgcgcgagcgcatcacgcgcgagggcgtgcggatcgacggacgcgacacgacgaccatccgtccgctcctcatcgaagtgggactcatcccgacggcgcatggttcgggcctcttccagcggggcgagacccaagtgctcaacatctgcacgctcggcatgccgcgcatgaaccagcaactcgacaccctcggggtcgacgaggaaaagcgctacatgcaccactacaacatgccgccgtttgcgaccggcgagacgggcttcatgcgaggacccaagcgtcgcgagatcggtcatggcctgctcgccgagcgcgcgctcgtgccggtgctgccgccggagtccgagttcccgtatgcccttcgcctcgtgtcggaggtgctgagttccaacggttcgacctccatggcgtccgtgtgcggctcgacgttgtcgctgatggacgcgggcgtgccgatccgggcggccgtggggggcatcgcgatgggcctcatcgcccacgacggtgtctacacgaccctgacggacattctgggtgccgaggatgccttcggtgacatggacttcaaggtggcaggtacccgggagttcgtgaccgcactgcagctcgacaccaagatcgacgggatcccctcggaggtgctcgcggccgccctcgagcaggcgcgccaggcccgcgtgtcgatcctcgatcagatgctcgccgtcatcccggcgccgcgttcggaggtggccgagaccgctccgcggctcatcaccttccaggtgccgctcgacaaggtcggtgagatcatcggcccgaagggcaagaccatcaacacgctgcagcaagagacgggtgccgacgtctcgatcgacgacgacggcgtggtcggaaccgtggtcatcggtgcgcgtgacatcgaggcagcgcgcgaggcggagcggcggatccagctgatcctcaacccgccgcaggccaccctcggcgaggtctacgagggcaaggtcgtcggcatgaccaagttcggcgccttcgtcaacgtcctccccggcaaggatggcctcgtgcacatctcgaagctcggacgcggcaagcgcgtcgagcgcgtcgaagacgtcctcgagatgggccaggtgctcaaggtgcgcgtcgacgacatcgatccgtcgggcaagctctcgctctcgatcgtcgacgacgagaacggtgagactccagcccacgctggcgcgtcccatgccggctcgtcgcacgccggcgcgtcgcggacctcggggcgtgagggctccgatcgtcgccatcggcgtgacgagcgccccggcaacgaccgtcgtggatcgtcgtcggctccggccaacgccgtgtcgttcgaggaccgcttcgagtcggagatccagcgcgaactcggcgacctccagtaggtgagccccttcggggcgactcgtcgtgtgtccgagcgccggccagcagcagctggccggcgctctggcgtctgggggcgccatcggcggcagtaccgatcatgacgttctcgcggagggcagcgactggggtgtgggacgggcacggtcctctcgggtgggtccgctagggtccagcccatggcccctcccatcgaccacccggttctcgacgtcgccctcgccgcgctcgatgcggggaggcaggccctgtggcgcacggattcgcgagcggtgctggcgacgaagtcgagccggtcggacccggtgaccgcgacggatcgagcgatcgagcgcgccgtgcgagatgccatcctcggcgtgcgtccccacgatctcgtcgtcggcgaggagttcggttcggccggtgagccggggcggctcaggtggctcgtcgacccgatcgacggcacggtcaacttcacctacgcgatcccgtatgcagccatctcgatcgccgcgctcgacgcatccggcgcactggtgggggtggtgtgggaccttgggtcagacgagacgttcatcgcggttcgcgggcagggcgcctggctcggcgacacacgcctcgccgtgcgaccatcggtgccgctggccgacgccctcgtcggcaccggcttcgcctacgacgcttcggtccgcgccgtccagggccgagtgctggcggcgatgatcgatcaggtgcgcgacgtgcgccgcttcggggcggctgcgctcgatctgtgctggacggcggctggcaggttggatgcctacttcgagaccggcttgaagccatgggacgaggctgccggtgctttggtggtgcgcgaggcgggaggcctcgtggcgaccgacctcgtgggcatcggcgacgacgcgctgaccgttgcgggtccgccagggctgttcgaagagctcagcgagcgcctcggcgaggttctcgccgacgtcagagggccggtcggggacgtgtccgcctcctaggctttgcgccatgcgtgtcggggtcctcggtgctggcggtcgagtcggtcaggtgctgtgtcgggagattctggaccagccggacctcgagctcgccgtcgccgtcgatccgaggttggccggcatcgacctcggtcaggtgatcggtcggccggccggtggcttggtggtcgtgggcgacctcgaggcgtgcctgcgtgctggggtggacgccgtcgtggacttctcggtcgcggaggctgcgcgacccgcactcgtgcgcctggccgaggccgccatcccggctgtggtcgggacgaccggcttcacgcccgaggacatcgaggtcatcggtcgggcgtacgaggcgtccggagccggctgcatcatcgcggccaatttctcgatcggtgccgtcctgctcgagcgctgcgtgcgcctcgtggcaccgtacgtggactcgatcgagatcgtcgaggcgcaccacagtgccaagcgcgacgctccttcgggaacctcccgcgagctcgctcgggtggctcgtgaggctcgcgaggcagccgaggcggggcccctcgtcgcggatccgaccacgcacgaggtcctcgctggcgcacgaggtgcgctcgggcctggcgacatccgcatccatgcgctgcgcgtcgagggtgcgatcgcccatcacgaggtgatcttcggccttcgcggacaaacgctggccgtgcgtcacgatacgctggatcgcagttcgttcgtccccggtgtgctgctcgcgctgcgccgtgtcggtgaggttcgggggctggtgctcgggatcgacgagctgctctgagaggaacgggaggttggccgtggcaccaacggtggcgttcggaccggagatcacggcgatggcgacgccatttggcaccgatggcgcgctcgacctcgcggccgcagagcgcgttgccagatggctcgtggaccagggatcgagcgcgatcgtcgtgaccggctcgacgggtgagtcggcaacgctcagcgacgacgaacgggccacgctgtggcgggtggttgcagccgcggtcgacgtgccggtcatcgcgggggcgaccaccaacgacacggcgcactcgctccggctcgtcgacgccgccgagcgggccggggccaagggaatccttgccgtcgttccctactacaaccgtcctccccaggccggtctcgtgcgtcacttcggccagatcgcccgagcgacgagcttgcccgtgctgctctacgacgtgcccgcgcgcaccgggcgtcgactcgagcccgagacgacgcgtgagctcgctcggacgtcgacgaacgtggtcggcctgaaggatgcctccggcgacctcgcggcagctgccgcactggtggccgaggcgcccgatgggttcgtgctctactgcggcgacgatgccctcgtcttgccctacctcgcgatcggggcggtgggcgtggtctcggttgcgggtcactgggccggcccgctccagcgggtgatgatcgaggctgcgcgctcgggggactgggagcgagcccggcggctgaacgcggcgctcgaggcgtcctatcgcttcgagaaccagctcgcctacccgaaccccatcccgaccaaggcgatgctcgccgcattgggtcttgccgagccggtctgtcgatcgccgctcatcgatccgacgcccacgctgatcgacgaggcgcgcagcgtcctcgccgatctccacgcacaggccgacaaggaaggcatcgagcttcgtgtcaaggcctgagctgcacattcgcttcctcggagggctgggtgagatcggccgcaacgccgcactcgtgagtgtggacggacggggggtgctcatcgacttcggcgtgatgttccccaaggccgacatgccgggggtcgacctcgtgctgccgaacctcgcgggcctcgacgacgtcgagctcgaggcggtgatcgtcacccacggtcacgaggatcacatcggcggcttgcccttcttgctcgccgagcatcgtgtgccggtgtggggctccgaggtgaccctgggcttcgttcgcaatcgactgcgcgagcacgacctcggggatgtggaccttcgcatcctcgccgatggggcgcgcgtgtcggtggggtccttcgaggccgaagccatcccggtgacccactcgatccctggtgccgtcgccgtcgcgctcacgacgccagccggggtcgtgctccataccggggacttcaagatcgaccacaccccgctcgatggtcgtcacatggggctcgctcgtatcgcggcgctcggttctgatcctgggatccgcgtgctgctgtcggactcgacgaacgccgacgaagacgggtatgcccgttcggagcgagcggtcggaccggcgctcgaggacctgttcaaccgccacggcgcggctcgtgtgatcgtggcctgcttctcgtcgcacctgcaccgtatccagcaggtcgccacgctggcacgcgagcatggtcgacggctcgtgctgctcggtcgctcactccagcgcaacgtccagctcggcatcgatctcggtctgctcgatgcccgactcttcgagcgcacgctcgatccgcgcgaggtgcgcgagctcgaccccgcgagcgtggcggtgatcgcgaccggatcgcagggggagcgcatggcggcgctccaccacctcgcgttcgatcccgctcgctggttcgccgtcggtggcgacgacgtggtcgtgttctcctccgacgtgatcccgggcaacgaggcagccgtcaacttgctcgtgaaccagttcacgaggctcggcgcaaccgtcgtcacctcggcacgcgagctcgtgcacgcgaccggtcacgccaagcaggaggagctcgccctcgtcgtcgagctcgcccgccccgactacttcgtgccggtgcacggcgagtatcggcacctctccgctcacgcggcgctcgcgcaacgcaccggtgccgtcggtcgtggggtgatcctcgcccgggacggggccgaggtcgtcatcggcgacgacggtgccgagctggctgacaccccatggggcgagtacctctacgtcgacggtgtcgtcggggacgtctcgcgcggggtgctccgtgagcggcgcaacctgtcggaggagggcgtcgtgatcgtcggggtgacgctcggccccgacggggtcgcgctcggtgagcccgagctgacctcggtcgggtggatccacgacgagcgcgaggaggagctcctcgcggaggttcgggcgatgctggtcggagcgctcggtgacgagaagccgcgttccgaggacgcggtcgccgagctcatccgcacccgggtccgcgcactcgtgcgcgagcgcacgcggcgacgccccctcgtggtgcccatggtgacgaggatcgacgagggctagggcgtggctcctcgatcgcggcgcccctcatccaccaagggccgttcccatggcgcgggtgctcgtggctccggcgcgcgtgcgcgggacgcgaaggcgactcggcgacgtacgagtcccgaggcactcgcgctcggggcggtcgtcgtgggtctcgcgggcctcgtcgtcggctactcggggctcttcggggtcgtcggcacgggcgtcttcctcgcgggccgagcggcactcggtcgcgcggcgtggcttggttggctcgcggtgatcgtggcaggcctgcgcgtgctcgtgcggcgcgagcggccgagacggcgtgcgggcgtcggcctcgccctggtcgtggttgcggtcgcagcgctggttggcgaggcgatgcgggtccaccccgaagcgtctcgggcaggtgggctgttcggcggcgtggtcgctcgagccctcatggcgctcgagggtcgcaccggggcgatcgtgacgacgctcgtcgtcatggccgctggtgccgccctcgccggtgagctccgctggcacgtggtcgccgagcgggtcgccgagcgtctgcgccacgtgcccgacgaggagccgtcgaggaccacccgtgtggctcgtcagcgacccgagcgtgccgcgggctccgtcatcgaagccaccttctcggagctaccctccgatcccgtcgaagccgtccccgagcgccaccccgacctcgacgaggatgcggggatcgctgtggctgatgcgtcgtcgtccgcatcgctcggtgaacccgaagcgttcggctcgccggacgacacggcgacaccgacaccgatcgagctcgtggcgccgcgggcttcggcctgggagcgtcctcggcgatccatcctgcgccgaggcgcgcgcgccaacctcgaccgcggtgagctcatccggggaggccaagtcctccagagcgcactggccagccacggcgtcgcggtgagcgtggtcggtatgaccacgggtccgacggtgacacgctacgagctcgagttggccgagggcgtcaaggtggcgagagtgcttgccctccagcgcgacatcgcctacgccatggcctcggctgacgtgcgcatcctcgcgccgattccggggcgcagcgccatcggtatcgaagtcccgaaccgggtacgcgaagtggtgaccctcggcgacgtcctcggtgacgtgccctcgagtgctccggtgctcgccgtgccgctcggtcgcgacatcgccggtcgcagcgaggtggtcgaccttgcccgcatgccgcatctgttgatcgcgggcacgacgggttcgggcaagtcgtcgctcgtgaactcgttgctcgtctccttgctcatgcgcgacacacccgacgatctgcgcctcatcttgatcgatccgaagcgggtggagctctcgcagtacgcgggcctcccgcacctgctcacccaggtcgtggtggatcctcggcgcgcggcagccgcgttgtcgtgggcggtggccgagatggagcgacgctacgacgtgctcgcgcactggggggtgcgcgacctcgatggctatcgcgatctcgtggctcgcgtccaggggaacgccgaggccgtcggggacgatgaggacgcgcccgcgccgctgccctacatcctcgtcgtcatcgacgagctgaacgacctcatgatggctgcgccgagggaggtcgaggacgcgatctgtcggatcgcgcagaaggcgagggcggtcgggatccacctcgtggtcgcgacccagcggccctccgtggacgtcatcaccggggtgatcaagaccaacatcccgtcgcgcatcgcctttgcggtggcatcccagacggattctcgtgtcatcctcgaccagccaggtgccgagaagctcgtgggcaagggcgacctgctcctcgtcacggccgacagttcgcaaccgcaccggctccaggctccctgggtgtccgagaccgagatcgctcacgtcgtcggggcctggcgccgccaggggcgccccgagctggtgggcgagctcgagcagggcacccccggcagtcgtgagagcgtcgtcggcgacgaggacgtgctcttgcccgaggcgatccgtctcgtcgtggagtcccagagcggctcgacgtcgatgctccagcggcgactcaaggtcggcttcgcgcgcgctggtcgtctgatggacctcctcgaggcgaggggcatcgtcgggccggccgaagggtcgaaggcgcgccaggtcttggtcgggttggacgagctcgacgcgaccgccggccgcgtcgacgaccccacctctcaggttccacctagcccaccacggtaggctgctcagcatccccgctacgtgcgcgctcgtgctgtgcgcgcgtgagtggcgggtctggctgagagcggaggacagcggatggcgtcgcggaatcggaggaggctcggagcccgcagtcgaggttacggtcgacggcggagcgtgcgcctcggacgcgtcctcatcgtggtcgtggtcgtgattgtgctcgccggggtggtgcagatcgtgcgtggggtcccacagccgagctacagcgccgtggtgccggcgacggcgaccatccccggctccgcaccgaacgtgccgtggccgagcggcggcgaggcggcggcggagatcgttggcgtcggcaggatcggcacctacgggccgacgaccccgcagacgatcgcgtcggtggccaagatgatgacggccctcttgacgatccgtgatcacccgctctccctcgggcagcaagggccctccatcacgatcacgcccgaggactaccagatctacctcacggacaaggcccagaacgactcggtgatggccgtcgcgccgggcgagcagctcagcgagtaccaggccctcgaggcgctcctcatcccctcggccgacaacatggccacggtgcttgcgacgtgggacgccgggagtgagtcggccttcgtggcccagatgaaccacgaagccaaggtgctcggtctcaccgatacgcactatggcgatccgagcggtctgtcggcggcgacgtactcgaacgccagctcgcagctgcgtgtcgcgaggctcgtcatggcgaacccggtgctcgcgagcatcgtgtccaagccccaggcgacgctgccggttgcgggtgtggtctacaacgtcaatggcgaggtgacccaccacgggatcatcggcgtcaagacgggctccatcttgacgggaaacttcgcgatggcctgtgcggtgcacgtagggacatcgacctacaccgggctcggtgtcgtgctcgaccaaggcggcgtcgcaccacttgagaccgcgctccacaacggcgtgcggctcgccgagttcgaggagcagctcctccggccggtcacggtgctcagggccggtgaggaggtcgggtcgctcgcggtccccggtcacggctccgtggccgtgacggcgactcgaggggtgacgctggtcgggtggccaggcctgctcgtgcaggtcacggtccatctccaccagcacctctacggcgcggccgcgcacgccgtggtcggcagtgcaacggtcaccttgggtgaacagcgcatgacggtcccgttggtggcgagttcggcggtggcgtcgccgtcgctcctgtggcgcctgacgcatctgtaatggtcgcaccccatggcccgtggcgcttcgcacgggcgcccggctcgaccgccaacctgggccccgggttcgacgcgctcggactcgcgatcccgttcgagactcgtgtctgggcgcggccgaactcgcgcttcgtcgttcgactcgccggtaccggagggagcgagcggctcgacagcggtcacctgatcgcgcgggcactgtcgcaggtcgcccgcgagccggtggagctcgtcgtcgcctccgacatcccgctcgcacgcggcctcggctcgtcgggatcgctcgcgctcgccctcgcggccgcgctcggtgcgaccgatccgctcgccgcggcgatcgtgctcgaggggcacccggagaatgcggcggcctccgccctcgggggcgcggtggtggcggtcggagggggtggggacgagctcgtgctccggcgtgtggcgctcgatgctcggctgcggctcgtgctcgtcgtgcctgagcgtcgcctcgcgaccgccgaggcgagagcggtcgtggcgcgcaccctctcgctcgaggacgccgtcttcaacctgcagcgcgtcgccgctctcgtcgcgagcctcggtgatgtggaggcgctcgcgccgttgctcttcgaggatcgactccaccagccctggcgcgagcggctcttcccggaagccgtggtggtccgcgacgcgctcatcgaggcgggttgtcgcggtgcggcctggtctggggctgggccgagcctcgtggggttcgtcgaggaggagcgagccccccaggccgccgaggccgtccgggcttcgttggtgcgcgtcgcgatcggcgccagcgtgcacgtggtcgcccccgatctccggggcctcgtcgtcgggagcgagccgccgccaccggcactcgcggaagggcctgcggtacccttcgaggcttccggactcggctagcatggactcgatgtcctctcctcagcgcgtggccgtctatggtccgagtgcgctcgcaacaccagcgaacgcggtcagcgtggtgcggttgctgctcgccccggtcatcgtggtcgtgctgctcggggcaccggacggctgggttccgctcgcgctgtgggctggggtcgccttgtcggacaaggtcgatggcgtcctcgcacggcgccagggcgtgacccgagcgggcgcgttcctcgacccactcgccgacaaggtgctggtgttctcggtgctcggtgcgctgtggctcctccatcgggtgccggcgctgcccatcgtcatcatgggcacgcgcgagatcgccgtgagcgtctatcggacccaggtactcgccgggggccagagtctgccggctcggttgccgggcaagctgaagatgctggtgcaggtgatcgcggttggcgtggcgctcgtacccgggtttgcgctgcacgacgagagcgtggtcacgaccctgttgtggggcgccacggttctcgccgtggtgagcggcgtgcagtacttcgtcgacgcccgctcgatccagtcctgagcgcgggtcccgtggacgtctgtatcgtctcgatcggcacggagctcttgctcgggcagatcacggacacgaacgcccggctgctcgcggagcgactcgcttctgcaggacatacgagccgcctacgtgtgaccgtcggcgacaaccatgcccagatcgtgtgggcgctcgcggagggacttgcgcgggccgacgccgtcatcacgacgggtggtctcgggccgacccaggacgacatcactcgcgaggcggtggctgcggtcgcgggggtgccgctcgagcgcgacgagcgcgtcgcggcgaggatcgaggcgatctttcgcgatcgagggcgtcccatgcccgagaacaactaccgccaagcgctggtgccacgtggcgcccaggtcatcgagcagcgcaagggaaccgcccctggtctcgtcgtccccgtgggatccaagctcatcgcgtgcgtccctggcgttccctacgaggcggaggacatggtcgacgaggtgctcgccgccttcgccgctcacgatccgagcccgggcgtgctcgcatcgcgcgtgctgcggacctggggtctcggtgagtcgcgcttggccgagctcgtggccccacggttcgatgcgctgtgggggacgcccacgacgctcgcgtttctcgcctcgggcatcgagggtatcaaggtgcgtatcaccacacgcggcagcgaccccgacggcgtcagggcgaccctcgatgccgaggagcgtaccctcagagcgatcctcggcgactacgtgttcggtgtcgacgacgactcgctcgagcgggtcgtcgcgcgtgcggtcaccggccgacaggcccgagtcgcggttgccgagtccctgaccggagggatgctcgcgagtcggctggtctcggtccctggtgcctcggcgtggtttcgcggtggtgtggtcgcctacgattccgccatcaagcacgaggtgctcggggtccgggccgaacgtgtggtgagcgaggctgcggccgtcgagatggcgctcggtgcggcgcgggtgctcggcgccgacatcggggtggcgacgacgggcgtcgccgggccggatccgctcgagggcgagcccccgggaacggtctggatcggggttgcgatcgggcagcgtgccgcggcgcgtcaggtccgtctgctcggcgaccgcgagcgggtgcggacgtatgcggtcgcgagcgcgttggacctcgtgcggctcacgctggaggggtcgccccgaggtctgtcgctggaggagcactcggcatagccgatcatgcgttcgcatgtcgtcggctcgtgctacgctacgcatgtatccacgaggggaggccgtatggatcgcgacaaggcgctcgagaccgccatcgcacagatcgagaagcagttcggcaagggctccatcatgcgcatgggggagcaccccgagatggcgatcgagtccatcccgaccggcgcgatggcgctcgacctcgcgctcggcgtgggcggactgccccgtggccggatcgtcgagatctacgggccggagagctcgggcaagtcgaccctcgcactccacgtcgtcgccgaagcgcagcgtcagggaggtcggtgcgcctacatcgacgcggagcacgcactcgacccggtctatgcccaggccatcggtgtcgacgtcgaccagctgctcatcagccagcccgactacggtgagcaggccctcgagatcgcggacctgttgatccgttcgggttcgatcgacgtcgtcatcgtcgactcggtcgccgctctgacgcccaaggccgagatcgagggcgatatcggcgattcgcacgtcgggctccaggcgcgactcatgtcgcaggcgctccgcaagctcaccgccaacctctcgaagaccaacacgctcgcggtcttcatcaaccagctgcgcgagaagatcggtgtgatgtacggctcgcccgaggtcaccccgggtggtcgtgcgctcaagttctacagctcggtgcggctcgacatccggcgtgtggagtccatcaaggacggcgcggagatcgtcggctcccgtgcgcgggtgaaggtggtcaagaacaagtgtgcgccgccgttccgccaggcggagttcgacatcgcctacggcaaggggatctcgcgcgagggatcgctgctggacgttgcggtcgagatggggctcgtgaagaaggccggagcctggtacacctacgacggtgagcagctcggccaggggcgcgagaacgtcaaggccttcctcgctgcgaacccgcagctcatggccgaactcgacgtcaaggtgcgcgagcgggtggctgtggaccgtggagtcgccctgacgcacggcatcgtcgccgaggccgaggcgatcatcgaggactagcccctcctggggcggtggtcgggcgcgtagactcgtccccgcgatgccaagcagctacgtagtgcgcaccttcgggtgccagatgaacgagcacgactccgagcgcattgcgggcgtgctcgaggggctcgggctgacgcgtggcgacgatcccgcggacgcctcggtcgtggtcttcaacacctgcaccattcgggccaacgccgacgagcgtttcttcggtcaggtgaaccagctgcgagaggcacgtcgtcgcaatccgtcgatgcgcatcgtggtcgccgggtgcttggcgcaaggagaaggcgcaggactgctggagcgcgcgccccacgtcgacgtgatcgtcggcacgcaccaggttggccgcctcgctgagctcctcggtgcagccgatggggcggaggcggtggtggacgtccgtgagcccgagccgggcagcgtcggtctcgacgaccccacgccgtggggcgaggcggtgagcgaggagccctggcgagcgtgggtcacgatccaggtggggtgcgacaatcgctgcgcgttctgcatcgtgccgagggtgcgcggaccggaggcctcacgcccattcgatgcgatcgtcgccgaggtgcgcgaactggccgcacggggcgtgagcgaggtcaccttgctgggtcagaacgtgaactcgtacgggcgcgatctcgtgctcgcgatgcgtcgggccgaggacgagcgcgagcgggctcaggttgcgagtcgttcgggggtcgccttcctcggccagggcgtgcccagggtgcgtccgctgttcgcggatctcgtgcgcgcggtcggggcggtgccagggattcggcgggttcggttcacgtcgccgcaccccaaggacatgcgtaccgagaccttccaggccatggccgagaccccgacggtgtgcgagagcctgcactttccgctccagtcggggtcggatcggatccttgccgccatgcaccgcggctacagtgcggatcgcttcctcgccaagctcgccgaggctcgtgccacgatcgacgatctcgccgtctcgaccgacatcatcgtcggctttccgggcgagacagacgccgacttcgaggcgacgctcgaggtcgcggccgaggcggcgttcgatctcgcctacacgttcatctactctccccgcccgggtaccgaggcagcggccctcgtcgatcggttcgtcgacccggacgtggtgcacgagcgcttcgaccgcttggtgcgcgtcacggagcgctcggcggcagcggcccatcgtgccagggtcgggcgagacgaagagatcctcatcgaaggtccgagccgcaaggatccccggacggccaccgcgaggacgcgtcagcacaagctcgtccacattccggggctcgatgcgcgcgcgctcggggggcgctatgggcgcgcgaggatcgtcgacgcgcgggcacactatctgatcggcgagatcatcgacgtcgagcccggggagtcatcgctcgtcgtgccgtgagcgaaggtccgctcgaagaggagttcgccgcgtaccaggtctcgaccgatcccagcctcggtccacagccggaaggcaccatcggtagcctcgagtggcgtcgtgggctcgtcggcgccgtagtgcgacgagggtgcgagatcgcctggtcgatcgacgccaggcaggcttgccagggcgacggcgtgagctcggccgaccgcggtctcgtacatgccgccgaccagggcgtcgagtccttccgagcgggccctggcgaggatggcgagcgtcggctcccaaccgccgaggcgcgcgagcttgagattgagcgtcacccgtgcgccgagcgcgagcatcgtcgtgaggtcgcccggcccccgcagcgactcgtccaggcacaccggcgtgagggccgagcgagcgaactgggccaccgcgaccggatcgtcagggtcgatgggctgttcgagcagactgaagccgagccgatcgatggccgagagcgtgggatccgaggggtcgtcgaaggcaccgttcgcatcggcgacgaggtcgatcgtggtcggggtgagggtacgcgcctcggcgagcaggccgagcgacgtgtcgcgctcgatcttgagcttgatgcgccgatagccggcggcgatggcgcgctcgatcgcgccgaggacggcgtcgggctcgtcgatcccgagcgcgatccccgtcgggacggggtcgtctcggccgccgagcagcgcccagagcgggcggccggctcgacgagccgcgaggtcgtgggccgcttgcgacagggcggcgcgagccgcgcgatgcccgcgaatggtgtgcacgctccgtgcgaccgcctccggccggactctctcgaggcggggggcgagaaagcgctcgagcgcgaggagctcggtggcgagcgtctcggagtcgtaggttggctcctcgagcgcggcgagctcgccgagaccgtggacaccctcgtcgtcgacgagctcgaccagcacgcgcgccccgacgtggacgaccccatgggcgctgcggtgggggtcgcgttccagggagacgcgccagatgcgcagtccttcgctcatgcccggagcctacgtggccgacgtggctagcctgacaggagtgccgggacgtctcgcgatcgtcggcccgaccgggtcgggcaagaccagcctcgtcacgcgtgcggttcgtgacggactgctgcgcggtgtcgccgtcgtgtcggccgacgcgttcgccgtgtatcgaggactcgagatcacggcctgggctccgggtgacgatgaccgcgctgggatcgactaccacctcctcggcacggtcgacgtcgccgaggaggtctcgctcgcgtggttcctcggtgcactcagtgtgatcgaggccgagcgggccggtggcggggtccttctcgtcggcgggacgtcgctgtgggtccggagcgcggtgaacggcctcgcaccgccgccccaggcgcctggtcttcggcggtggttggaggctcgcgcgaccgatccccacggcgtcgccgcgctcgtgtccttgctcagagtcgtcgatcccgccgcggcctcggggatcgacggacccaacgcacgccgtgtggtccgcgcgctcgaggtggcgctcgcgagcggcggtgcgcgcagcgtggctggagaggcgctccgcgccacggcgccggcgcgctacgtgcagatcgggcttcgccgtggcgaagcagcgctgcgtcgggccatcgaggctcgtgtggaggcccagctcgccgcgggctggctggccgagatcgaacggatcgggccgatcgcctcgcgcacggctcgtcaggcgatcggcgttcgcgagctcaccgaggtcatcgagggccgacggacgctcgctgaagctcgagcggccatcgtccgacgcacctggcggctcgtacgacgtcagcgggcctggctcgagcgcgatccgcgcattcgctgggccgacagcgtcgacgaggccctctcggcgatcgcgggagcggtggaggaggcggcgtgaggctgaccaagctcgtcggggcgggcaacgacttcctcgtgaccaccgatccggacgagacggcgcggctcgagccgagcgtcgtcgtggccctgtgcgatcgccgcaacggcgtcggtgccgacggggtgattggtctggatgcgcacgacgccatggtgctctacaacgccgatgggtcgagggccgagatgagcgggaacggcctgcgctgtctcgggcacctcgtcaccgaggagcgaggcgtgggcgaggtggcgttcgagaccgacgctggccggcggatctatcggcgcgtcgggcgtgagggaggcagcgtcctcggggcgaccaccatgggtccggtcagcgtgcgggcgaacgagcgcggttggttcgtcgacgccggcaacccgcacgaggtgcgccagctcgcgagcccgcaggagcttgcgagcctcgacgtggcgagcctcggtcgttgcgcccaggcgcactaccctcagggggtgaacgtggagtgggccgtggtgctcgcgccggacgaggtggtgatgcgggtgttcgagcgtggcgtcggtgagacggaggcctgtggtaccggatcgacggccgtcgcggtggcgctcgcgtccgcagggctcgtcgagcgcacgtcggtgcgggtgcgcaacccgggcggggcactcacggtcgaggtcaccgagccagagcctgtcctcgtgggtccgagccgcctcgtcgcctccgtcgacgtcgacgtggaggcgcttcgcgcgtgacgctgatcgagcgctcgttccgcgagcgcatcttgctcgtcggcgtcgtccaccatggcgagcgtcgcgaagcggtcgaggactcccttgccgagctcgccgcgttggtcgacaccgcgggcgctgacgtcgtggatcgagagctcgtgcgtcgtgacgcggtggatccggcgacctacgtgggctcgggcaaggctgctgaactcgcggagcgctccgaggccctcgacgtcgacaccgtcgtctttgacgacccactctcgccggcccaacagcgcaacctcgagcggatcctcggacgcacggcgatcgaccgcacggccgtcatcctggacgtgttcgcgcagaacgcccgcagcgaggaaggacgtcgccaggtggagctcgccctgctctcgtaccggttgccacggcttcgcggtcggggggtggcgctgtcgcagcaggtcgggcgcatcgggactcgaggtcctggcgagaccaagctcgaggaggatcgtcgtcgtatccaggctcgtatggcgcaactacgccgtgagctcgaccagctcgccaggcgtcggttggtgcagcggcgagcgcggctcgcgtcgcgccaggcgcaggttgccctcgtcggctacaccaacgtcggcaagtcggccttgttgcgggcgctgtcgggtgcggacgtgctcgtcgagaaccggctgttcgccaccttggatccccggacccgtcgggtggcgctcccgggaggcgagacgatcctcgtcaccgacaccgtgggcttcatccgcaagctgccccacgagctcatcgagtcgttccgttcgacgctcgaacaggtggccgaggccgatctgctcctgcacgtcgccgacgcatccagtcctgacgtcgcggcccagatcgctgaggtcgaacgcaccctcgccgagatcggtgccgatcgcgtgccgcggctcgtcgtctacaacaaggtcgaccttcggccgatcgacacgctcgctgctggcgtccccgaaggagtcgcgatctcggccgagcacgacatcggcctcgacgacctgcgtgctgccatcgccgcggcgctcgatgcgatgcggcgtccgcgtcgctacgtggttccggctgggcggggtgacgtgctcgcgctcatccatcgcgagggtgccgtcgtgcgagaggaggtggatgcggagcgggtgctcatcgacgcggtgctcgacgatgcctccgatcggctggtccgccgggcgctcggagaggcgccacctgagccgctagggtgaggcggtgtcgcagcgcccctcccgcgtcgagctcaccgcgctcgcagccgatcggcacccgttcgtcgtcgatgcgtccatcggctcgcccgtcgatccgcccccagcgttcgtcccgcacctgctcgcgtgccagggggaggagcgtgcgtacccgccagcggcagggacgcccgcactcgtggagtcggcgacgcgctggttccacgcgctgcggggggtgacgctccccgacggcgcggtcgcgccgaccatggggtccaaggaggccatcggtacgctggcgtggttgcttcgggagcgccgacccgatcggggggtcgtgctcatccccgggcgcgcctaccccacctacgccgagggagcgcgggcggccggctgtgagatcgtgcgggtcccggacgactgctcgggtgctcctgccttcgacgccgtggctgcgtccgtgtgggatcgcacgttggtcgcgtgggtcaactcgccgtcgaatccgaccggtgcggtctatgacccggggccggtcgtcgccctcgcccgcgagcacggtgcggtgctggcctcggacgaggcctacggcgacttcgtgtggtcgggggaggccccgagcgcgctgcgcgcggggctcgagggcacgctcgcgctcgtgtcgctctcgaagcgctccaacctggccgggctgcggctcggtctcgtggcgggcgaccccatgctcgtggacgaggtggtcgcgcgccgacgcgcgctcggcctcttggcctcagggccctcccaagcagtggcggccgaggcgctcgccgacgagggtcacgtcgccgagcagcgctcgcgctacgctgggcggctgcgccgcttggcccgggtcatcgaggcggtcgccgacgtcccggtgcgcgtacccgatggcggcatctacctctgggtccgcgctcccgacgacgacggggcggcgttcgccaggtggctcgcgacgcgcctcgggatcgtcgtcgccgacggtgccgactacggcgatcgtgcgttcgtgcgcattgcggcgacggtgaaggatcgggcgatcgatgccctgtgggagcggggaggagtgcgatgaccgaggacgcgcgtgcggccagcgtgcatggcgcgttcgcacatggcgaaccgatcgataccgcggtgctcgtctcggtgttcgaggacctcgagcgcggcgcgctgcgggtggcctccgtcgactgggacgagggccgggtggtggtgcacgagtgggtcaaggaggcgatcctgctctcgttcggccactggccactcgtggagtccgaggccggcccgctcacctgggtcgatcgcatcccgctgcggcgcgatctcgccgaagcgcgggtacgtgcggtgcccggggcgatcgtgcggcgagggacctatctcggcgcgggtgtcacgctcatgccgagcttcgtgaacgtcggcgcctcggtcggtgagtcgacgatggtggacacctgggccacggtgggctcgtgtgcccagatcggcgcccgtgtccacctctcgggaggcgtgggcatcggcggggtcctcgagccgccgcaggccgctcccgtcgtggtgggtgacgacgccttcgtcggctcgcgcgcgatcgtggtcgagggctcgatcgtcgggcggggcgcggtggtggccgccggggcggtggtgaccccgacgattccgatcatcgacgtcgccaccggcgacgagcttgagcgcggcagggtgcccgactggtcggtcgttgtgcccggcacgcgagagcgccgttggcccggtgggaccttcggcctcgcggctctgctcgtgatcgcgcggctgcccgagggggagcgccacgagaaggccgcgctgaacgacctcctgcgcgcgcacggcggagccctgtgagggacccggtcgagctcgcggcggcctacctcgaggttccctccgtcaccggcgacgaggcggcgctcgctcggctcgtcggtgagcacctcgatgcggcggggcttcgagtcgaggtggtggcgggctgcgtcgtggctcgcaaccacggcggggactcctcggcgacgctgctcgtcggccatctcgacaccgttcccggtgagctccctgtcgccgtcgacgaactggtgttgcgtggacggggtgccgtcgacatgaaggcagggctcgcggtcgcggtggcgctggcgtgctcggagccctccgtgcccgtgaccgtcgtcgcctatccgggcgaggagggtccgatcacaggcaacgggctcgcgcacctcgtggccgagcgccccgaactcctcgcgggtgctcgcggcgtgctcctcgaacccacgggtgggttcctcgagctggggtgccaaggggtcgtgcgcgcgacgctccgactgcgtgggcgtcgagcccacgttgctcgagcctggatgggccgcaacgccatcgatcgggtcggcgaggcgctcgggacgcttcgcgccctggaacgtcgcgaaccccagatcggcccggtgcgctaccgcgaggcgatcgaggtcgtcggggtgcgtgggggcgttgcatggaacgtcgtgccggacctcgtcgagatcgacgtgagctatcggttcgcccccgacctcgatgctgcccgggcgcgccagcgcctcgaggaggccgtgcgtcccgtgatggacgacggtgatgacctcgaggtcgccgaggccgtgccgggcgcggtgagtgacctcggtcggttcggcgcactgcgcagcggcgcgttcggcgtgcgtgccaagctcggctggaccgacgtcgcccaactcgtcgcggcgggcgtgccggcggtgaacttcggaccgggggatccagaacttgcccacacggatcaggagatggtcgaggtggccgaggtgcgccacgtcgcccaggcgctgtggcggtggttgcacgcctaggacgatggttcgcctcttccgatggcgagtgaggccagacctcggactcgcgatgcgggtcgaggtggaggtgaggaggcccatccctgggcgaagggtcgctctcgagcacctccgatgcagtgtctgagcgcagccggtctggcccgccgtgtgctcgggcgtggtggggcaggcagatgggcgtgggcctgtggcgcccgacgccgtaggtcggggtgaggtgccccagatttcgtagacacccaggttacttcacgcgagcctcctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatcccgtgtcgggcacagaaggccacaactcgatggtcgctgaactgactccctcggtcggtgtgccagatgaccccctgcgcgtgggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccggcgatgccgcgcctggccatcgctgctgccaccgtgttgtggctcgtcaccacgccagcggcgaggagtgccgccgtgatccgtcgtgcgccgtaggtgccagaggatgcctggtggaccgcgaccactcggttctcgaggtcgcgtcttgcacatgcccgacgcgacggtgctacctgggtgcgtcgccatcggtagtagccagcccgggagacctcgagtaagcgtgccatccgtttgatctcgaagcgagcgtactccgcctccatcagcgcgaatctctcttgcttggtggcttcgcggcgaagtacgcggctgcttttcccaggaactcgttgtccttgcgcagctcctcgagctccctgcgcagcctgatgagctcggtgcgctcctgcgccgtgaggggcgggctgccagtggcgtttgctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggggcggctcaggggaccaatgtgcgcgctggtcgggtcgaggtggcggcaggcatgaggttgcgatggccacgactggatcgagggggacgagatcgtctgtcagttgcgctgcttcgaacgcctcgagcgcgttcacggtgaccttcggcgcctcggtccccgttgcgtgctgtggaggtgctcgaggacgcgatcggcgccgtccacggcttcacgatgccggggacgcgcatcccgtgggtcgattgcgcgccgtggtgatcggtgtcgcaaccgagtccgccgttgccgtgagctcggcaccctcgtgtgagtgctcgctgctcatcgcgggcacctaggagaggggcgcgtgtcgccaggcgagccgggccagcgagggctgccgcgggtcggcaacgtgaggcgctcgagggggcgagtcggtcgagagcgccctggttcgtgtggcccggctgggtgtcggtcttctcgtgggggtgcgcgcctcgtgcggcgagctctggtgcttcccaaccgggagcgccggacgtggctgagcgttcgagagcccgcacaccgtgtcctacgggagctgcacgagcggcgggccagcaggtcacctcgtactcggccgcccgcgtgggcgagcgaggtggccgcgatggcaaggtcctcgcggcgattggcgccacgctcggaccccggccctctccgctcggtgccgaacccatcgaaggtcgcacgatgctgcgcgtccatccgagccgaccgccacacgggtgtggtcgtcctcctccttcggcgctccttcggcgttggctggcccagcaacggcggcgcgatcgcgaccgaggcgcgggtaacgttcgcccgaggccagaacgaggagggtcggagcgatgttggagggcacggtcgtgacggtgctcttcgaactgcacgctgaggggctcggctatcgcgagatcgcccgccgcacgggcatctcccgcaacacggtgcggcgctacctgcgcgacggcgcgagcgcgggacaggtcactcgtccccggcgccgctccaagctggatcccttcaagcccgagatcgatcgcctggtggcggacgggctcacctcggccccggccatcacggaacggctcaaggagctgggctacaccggcaaggtcaccatcgtgcgcgattacgtgcgtaccatccgtcagggtgcatcgcgcggggcgtgacccgcgccgccatgcgagccaagggtttcggcggtcgtcgtcgtatcgtgttcgcggaggggatggccggctcccgaagccgagtccatctcgcatgtgaggcccggcggtagggtcgtgcgggcgccatgtgcatctgtgggggatcctcgtctggtcgacaggccccggtggcgtgcggcatcgtgcgcttcgtcgggtgcacgcagcgggagggcggcagcccgaggcgttcggcttgcgggcgtggtccttgcagcagccgggtcggcgcagctcgcgtgtcgtcaacgctgtggtgcgggtgccgtcgcgctggtgcgagcgcgttcggatctcctcggatctcgtcgacgaacaccggtgctgggtcttgcgcccgtcggcgcgaggcgtcgtcggcccgacgcacaatcctcacggcgcggccggacgctctggcaccgctcaggcgatgggggcgttcatggggaactggagggcgaagcggcctcgtggcgcgtcgcatggactgctcgctgggcgatgggatcggttggcgatgtcctcgtggtcctcgagcaggtcggaacggtgcaaggcatgccgacccgtcggacacagcacctgcagcggcagggctaagccaggggcgcgagcacgtacctggacgctccttggcgagcagccggcggcctggtcagggtgcctggttggcgaactgtgcgtcgacgacctggctcattggcatcggcgtgtggtagtcgaggttgccggcgccgaggtagaccgactgcatggaggagagcaccgacgattggggtgcgagggttggggagaagacgttcggcggctccgagcgcagcagcgagagcgattcgccggtcgccttggcgatgatggcgaggttggcggcgctggtggcggccgacccttggaggtcttgcgcgcccttggcgagcgcgtcgaagaagcgttgggcggccgacgtgtggatgaagctgcccccgtagatgatgccggtgacggcgatcccaacgggagcccctgcaagcaccgtgccttggtgctgcgcgacggccgcttggaggaacggtgtcgccatgtaggccgcagcgacgccgccgttcgcgagagcggcgccttgttcggggaagttgacgttgaccaaggtgacgcgagcgagcgagaggtgtgccttctcgagcgcgagcgcggtgaggtaggcgcccgcggagccctggccacctgcgaccgcaatgcgctggccggcgagctgggagagcgaggtgatgtgagcggccgccgaacccaccaggccgttagcggcggcgcccggcgcctcctcggccatggagccaacgacgcggacgtcgaggccctggtggatggcgttgaagaggccggcgctgaagccgccgaggacgacctggacccggttcgtcgccgccagcgtgatcgcgctctggccgttggcgacgacttggaggttcaccttgatgtgctcggcggcgaagtagccgtgtgcttcggcgacgaagagcggtgcgaagagggggagcgggacataagccaccgtcaccgtggtgggggcggtcgatgaggtggtggtcgacgaggtgctcgtggtcgagccacacgctgccgctgtcaatccgagagccgctgtgagcgcgagagcgcgacgatggcgacgttgcatggatccccccttggtgcaagctgaggggatgctagcgtgcccgccgtctggtccagggcagcacgagccgttcgacgccaacgacgatcccggtcgcgacgacgccgaggagggcgatcacgacgaggccgacgtacatgtcggcaggttcgaacagctgccacgagttccagacgaggtagccgagccccgagttggccgcgacgaactccgtggccgtcacgaccaccagcgcgagcgcgaccgcgacgcgaagccccgtgaagatgccgggtgcggtcgcgggcacgagcacgtgcacgaagcggcgccagcgcgtggcgccgtaggcttgtccggcctcgaggagttctggcggtacgcgtcggacggcccccagcgtgttgagctcgacgacgaagaacgtcactgccgcgacggtgatgatcttcgcggtctcgcccaggccgaagatcaccagcagcaggggcaggagcgcgatctggggtaccgcgtagagcgcggcgaacagcggtgagagcgccgagcgcagcggacggacgaccccgagagcgaggccgacgacgaccccgaggaccgcgccgatgacgtagccgacggcaaggcgcgccgtcgtgatcccgagatcggcgccgagggtgccgttcgtggccaagctgccggcggtgcgcacgatgtcgctcggcggggtgaagatccgggtgtcgatcgcgtgtgtggaggcggcgatctgccacgccaccagcagcacgatgggggtggcgataccgagggccacgtcggcggcgcgagctcggcgagcactgcggcgtgcgccgcggacggcgagttcgctctgggtggtcacgagggggctcccatcgaggctcgcacctcggtctcgaggcgcgaccagagtgcgtggcgcagcgaggtgaacgcctcggtgtcgagcatcgcttcgtcgcgtggtcgtgggagtgggacgtcgaagacgtcggcgatgcggccgggcctcgcggtcatcgcgacgacgcgatcgccgagccagatcgcctcctcgagcgagtgcgtaacgagcaccatcgtgaccccggtctcctcgtagaggcgtgcgaggtcttgctggaccaccaggcgcgtctgggggtcgagggcgccgagcggctcgtccatgaggagcagcgcggggtcggtgacgagcgcccgagcgagcgagagccgttggcgcatgccgcccgagagttcgtctggccaggcatcggcgacgcccgcgaggccgaggcgctcgagccagcccatcgcccgccggcggcgctcggctcgtccgatccccgccatgcgcaggccgaaggcagcgttgtcgacgaccctgagccacggaaacagcgagtggtcctggaagacgaaggcgatgcgcgaccggaccgaggggtcgatctcgagcgttccggtcgtcgcggcggacaggcccccgatgatcctcagcagcgtggacttcccgcatcccgagggaccgatgatggagaggaatcccccggggggcacctcgaggtcgacgccaccgagggcctcacgcgcgcgtcctcggtcgtcgacgaagaccttgccgatcccggccgccttgacgagcgccgtcgctgtcgcgggcgcttcgtggggcgcctcgttgcgatgatcccccatggtggaggggatgctagcggacggcggcgccgtcgtaggagcgcagcacgccgacgacccttccatgcaggtggcaggtctcgttccacggcatcggcgcgagcgagggatcgtcctcgttggccccctcgagccacaccgagctcccgttgcgccgcaggatcttcaccgtgccgacgtcgtcaccgacggaggcgaccacgatgtcgccgtcagcggcgacatcgctcggggcgacgacgacgaggtcgccatcgaggatgccgacgtcgaccatcgagtggccacgcacccgcagtgcgaacgcaccgggcgcggccatggatgcgggcaccgcgaccgacgtctcgacctcgacctctggcaccacgtggtagccggctccgacctcggcgagcaccggtaccgcagccgatggcgcccgtcgggcaacgctcaggctgcgagccttcaacggtgagcgcacgaggcgtccgtcgcgttcgagtcgacgaaggtggtgctggacgcttgccggcgacttgagaccgaccgcatcggcgatctcgcgtaccgatggagcccaacctcgctcctcgacgacctgggtgacgtaggccagaatcgcctcgcgcacctcggggttctcgcgtgtcatgctgcgccctcctctcctgcagtgtactcaaacgcacgttcgcacgcaaccgatgagcgatcgcgcgttcggccaggtaggctcgctggaagagcccgagtgaggtggcgtgcgctgtcccttctgcggcaccaacgaagatcgcgtcgtcgagacgcgggtcgctgacgacggcgcggcgatccggcggcgacgcgagtgccttggttgcggtcgacgcttcacgacatttgagcgcatcaccgaggcgcgtgtcttggttcgcaagcgctcgggccagctcgagccgttcgaccgcgacaagctgcggcgcggggtgcaggctgcgctgaagaatcgccccatcggtgccctcgagatcgagcgcctgttggccgaggtcgaggaggcggtgcgggcggtcgacgaggtggagtcggcggagctcggtctgcgggtcctcgagggcctccgtcaactcgatccggtcgcctacgtgcgctttgcgagtgtgtaccagaacttcaccgatgccgacgactttcggcgcgtgctcgccgacctcggtccgaagcgcatcgcgaaggttcgccccgagggccaggcgcgatgacgttgatcctgacgaggaggtagtgatcatggcgggacgtatcgtcacggcggagctgaccatcgcagcccctgccgacacgatcttcgacgtgctagcgcgccctgcgctccatccggtgctcgacggctcgggcaccgtgcgcggtgtgctcaccggccctgagcgcctctcgctgggcgcccgcttcggcatgcggatgcgcctcgtcgtcccgtacgtgatgtggaatcgcgtcgtcgcgttcgacgagggccgcgagatcgcatgggcgcacctgggtcgccacatctggcgctaccgtctgacgccggagggtgagcagctcacgcgagtggtcgagtcgttcgagtgggacgatgcacccctgcgcctcgtgtacgagatgaccggcgtcccggagcggaacgcgctggcgatgcgcctctctctggcgcgtctcgaggcgctcgtcacgggagagaggcgggcggagggcggccagagcgcctgagtcgccctgatgccgctcctagcggactggggggagacggaggccgaccgctctgaccggctcgtccgcaccgaggaagagctcttcgacgtcggggccgcactcgcccgactcgaagcggcacgactcgcggcctcgactccactcggcgaccatgaggaggcgaagcgcaccgcgcgcgagcgcacccgggcgccctaccgaggcatgctggagcggctgctcgaacgggtcctcggcgagcgggtggaggtcgcgctcgacgaggaactcgacgttctggggatccgacgcccaggccgcggccaagggctcctcccctgagccagctgtgggccggcaccggggagcggtccgtgctctgcgtgcgtggtcgcgacccgcctgagcagggggcgtcggttctcctcgacggcgtgcttaccctctcggacgcccagcagggccgccggttcgtcgccgagctcgaggcctcgccgaggacggccaaggaatcgtcttcacggcgtaccccgatcgctacccggcatgggcccgcagggtcggaccgccgcccccgtcaaccacgccaccaccgcacggtcggggcgcctgtcccgctctgagctcgtcgaggcgatctggctcgagctcggcgtcgcgggccggctgctgccccagctgcgggaggagagcttcgtggcccaggagggggccggcgcggcctgcgctagcggtcaacaggggaatgttcactacactaagtcgaggacgtggcggggaatggctcgacgttgcggcaacgcgagctttccgtgccacagtgcgctcggggaagccgaacgggcccgtcttgggtgcggggaggagtgccgccatggccgagagtcgctcgttccgacggtccttcggacggtcgctggggtggtggctcgggttcgctgcggccgtcgtgggcgcaggtgcggggggctacgcgctcggggcgacgtcgcaaccaatgcgtagaggggcgcccagtacctcgcgcgcgcaccctcgtactacgacgacgccccctcctgcgcagtcggggtcctcggtgccgaagggcgtctcgggtggctcgcaggtgcctggcgcgacggggctctacgtggacggcggtgctggtaccccccactatgtcctcgcttggcacctcggtcccgacggcgcgatcagtggcgccgtcgactacgtgtaccaggatgggcagacctcggttgtcttcaccttcacgggccagctcgatggctccgacaccgtcgcgacgctgacgccccacacgatcccccaggggaccggctcggcctcccagccgcccgggacggtaccggccgcgatctcggcgaccctgtcgacgtcctcgatccagctcggggagtgcaccacctacctgcatttcgcgccgaacgaggctgcgtgcacattcctcgcatcctctagcctgcagtgaccggcaggccgtccgggttccctccctggaggcggcctcggccaggagctcgatgcccccccgtccctgagtgcggaccccctcaaggtcaccgagccgctcgaggccacgcacctgctggggccaggcggggttgcaactgttgagacgtaactgtgttctcacaagggatccgaatgtgtgcaggttcaattcgaccggtggtgaggtgccccagatttcgtagacacccaggttacttcacgcgagcctcctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatcccgtgtcgggcacagaaggccacaactcgatggtcgctgaactgactccctcggtcggtgtgccagatgaccccctgcgcgtgggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccggcgatgccgcgcctggccatcgctgctgccaccgtgttgtggctcgtcaccacgccagcggcgaggagtgccgccgtgatccgtcgtgcgccgtaggtgccagaggatgcctggtggaccgcgaccactcggttctcgaggtcgcgtcttgcacatgcccgacgcgacggtgctacctgggtgcgtcgccatcggtagtagccagcccgggagacctcgagtaagcgtgccatccgtttgatctcgaagcgagcgtactccgcctccatcagcgcgaatctctcttgcttggtggcttcgcggcgaagtacgcggctgcttttcccaggaactcgttgtccttgcgcagctcctcgagctccctgcgcagcctgatgagctcggtgcgctcctgcgccgtgaggggcgggctgccagtggcgtttgctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggggcggctcatggcgaggcctactaagcgagtcgcagatccccgttactccctaggggatcgatgtgtgggaagcggcttgcgtagggtgaccgccccccaaatcgagtccactctcaatgtgagaccccatatcttcaggctgccgctcgctcgtcctctcgggcgccgatcatctcgagcgcgtagaacttccggctcctcgccgaggccgcgaggatccgcggctccggtggcgacgtcgagctcgattgagcttccccccatttgcttgacagtctgaatttaggccacggccgcctccgcacgggcccaggagagctcgtactcgacgggcggtaggtacccgaggctcgagtgcagccacagggacaacaggtgttgcgacgatcgattgcaatcacccaccacagccatcgatgccactccgcaagcggaacggcctagggacggcgtcgacgggccgcgagccgcaacttgatccgatgtccggaagcggatcctcggctgcggctgccgactcaggtggccacgacctcaaccgatggtgcaccgcggagtcggcggtcggtcgtcaccagcggtacgccgcgggagacggccagttcgatatagatcgcgtcgaccagccgaagctcttggcgacgggcccaggtcccgaggaggagatcgtggacgggatgccgctcgatcggtgctgcggccagctcgcgaagcttgacctcgacggtgcctgcatcgaggctgtctgctcgatgcaggcgtcccagggccgacaagacttctgcgtcgacgtgcgccggtgcgtgcaaggcgtgaccagcgatgcgacgccgcaccgcacgaccgagctcattgtccagcagaagatcgaccagagcggatgcgtcgacgacggcctcagccatgccgcgtcggtgcttcgtccctcgcggcgtcgagcgctgcaagcgcgcgctcatgtgacactcgcgcaatcgggctcgccagcgttgcaagccaggcatctgtcgagcgcgacgccaggcttcgccggaccgcctcctgggtcaccgcagacaaattcaagccggccttcctcgcttgtgccgcaagatcgtccggcaggtacacgttcactcgagccacaccacacaatatacacacttgcgctacggtgcgctccgcaagccgatcggtcaccgacccgactacccgcgacgcttcgcctgctacgacgacgcacgagcctggtgcgagcgcttccttcgctggtaccaccacgagcaccggtcacgtgcgggatcggactccacgccgtggccgacgcgcaccacgggcgtgccgtggagctccgagcacaccgggcagcggtgccgttgaccgcctcccagatggctcggagctcgctgacgagcaccaggtgctctgggtcctcgcttcggtctttgcggtgtcgccaggggtcgtacgcctggcgagagactcgatgactcgtgctagcgctgctatcgagaagccattggcctcctggcgggcaatcggagtggtagcggctcactgccccccctccctcaccgagtgggcgatccctcgctccgccagctcgagttccatgatgagctgtgtgacctgacggcgcagccgggtcagctcttcgcgctcggcgcctgtgagaccttcgagctcacctcggtcgatccgctcctgacgcacccagttgccaagggtctgctcattcacgccgagttcgcgggcaacgtcagcgatggttcggtgctggtcgagcaccaacgctgcggcatccttgcggaactggctcgggtaacggcctcgtcgtcgacgaacgggggcctcgcgcggtggtggattcggtgtctggctcatcccttcctcctagagcaggtgtcgctttggagggggaggccacaccgtcctgccgcactcgacgcttgagtacctaccgccgttcgagtacgagctcacctgggcccgcgaggaggtggccgaggcctcaacccagactgtcaagcaaatgggcgaaacccagagggccgtcgagggggccctggacgggcgcgcggcgtagcctggcacctgtgtccatcgacctgcgctccgatacggtgacccagcccacagacgctatgcgtcgtgccatggcctctgctcgttgtggggacgacggctacggcgaggacccgacggtccgcgaactggaggagcgtgcggcggggctcctcgggatggaggcggcgctcttcgtggcttccggcacgatggccaatcaagtggcgctgcgaaccctcacgacgccaggttcggtggtcgtggtcggggcccgggcccacctgtgccagttcgagcgtggcgcgagcgctcgtaatgcgctcgtgcagctccacaccctggccgacgacgacggagcgccgacggccgatgcggtggccgatgcggtggcgacctatcgtgcgattggggttcagccagccctcatcgcgatcgagaacacgcacatgccctcaggcggaacccctctcgatccggtgcgcaccggcgctcttgccgatgcggcgacggcgacgccgctctacatcgacggcgcacgactctggaatgcttcggtggcgctcggggtcgagccgagtgtgctcaccgagcgcgccaccgcggtgtcgacgtgcttctcgaagggtctgggggcgccgatgggttcggtcgtggccggatcggctgacctcgtcgagcgtgcgcggtgggagcgccaggcgctcggcggtcgcctgcgccaagctgggatcatcgccgccgcagccctcgtcgccctcgacgagtggcgaagcgtccttgcccgagaccatgagcgagcggccgtgctgcgcgaccgtgtggcggcagagctcggtgatgcccgcgtgcgctggggcgggacgaacatggtgctcgtcgatgccgatcgcccggtcgagatgctcgcccgccttcgtgaagcgggcgtcttggccaacgccatcggacctcggacgctgcgcttcgtcgtccatcgggatctcagcgatgccgaggtgaccgtcgccggtaccacgatcgcccaggtcgtgtcgtgatggagcctcagcgaccatgacggtagagatctacgagccggcggcgagcgtcgccctcgcctgctttgcccacccggacgacgccgaggtgctctgcggggggacgctcgcgcgactcgcggcccagggagcacgggtcgtgctggtcgtggcgacccgcggcgacaaggggctcgcgcgggtggacgacgccgaggagcgccgcaccggtgaactgctcgaagcggccgccatccttgccatcgccgacgtcgtccagctgcgctatggtgacggcgatctctccaacgacctcgagctgcgtcggcggctcgtgaccgtgctccggtccttcgctccgcagctcgtcctcggtcccgaccccacgacggtcttctacggcggacggctctacaaccatcgtgaccaccgcgagctcggctgggcactcctcgacgccgccttgccggccgcgagtcagccgggttacttccccgaagcgggcgagccgatcggaccgctcgaggtcctccttgccggttcggaggagcccaacagcgcggtcgacgtctcggcgtacctcgaacgcaaggtggaggcggtacgtcaataccggagtcgcctcggcgccgccgacggcgtcctcgccgatgcggtggtcggccgtgccgtggacgcggcgcgcagcgtcggcattccgggcgcggcggaactgtttcgcagggtcgagggcgcaggttgaggggaggggcgatggtcgagatcgaggttcgaggcccgggtcaccacgagcgcagcacactggcggctcgagcggtcgcggtgctcgcgggcgcggggctcgacgtgggtgtggtcgtcgacgttcgtccgcggctcgccgcggacatcgaggcccagctcgaggcaggtgcggcacgcgtcgtgctcactggccccggcttctcggcggtggcacgtaccggtcgtgagggcgtggaggaggcactctccgaaggcgacgtgctgatccgactgcgtgccaccgccgacgaactcggggtctacggggtcgacgatgcgctcgggcaggaatgggtccgtcgcctccgcgatgcgggtgtgccctgtatggggcctgagatcggggtctgagcgtcccggaatcggcggtggaacgggagcgttggggttttcgacgacgagccgaggcactagaatcatgacagatcaagcctcggtttggtctgtcggcgtcgaggaggacggatggcgctgaacgaagaggagcaacggattcttcaggaaatcgagcgctccttctacgagagtgaccccgccttcgccgatcgcgtccgctcggagaccgtgtaccggcatgctggacgcaacctcaagtgggcgatcgcggcgttcgtcgtgggactcgccttcaccatcctcaccttcacaacgtcggtgatcctcggcgcagtcggcttcttggtcatgctgggagccgcgtacgccttcgagcgcaacgtccgtcgtatcggtcgggcgtccctgagcgacatggcgcgctctggtcgcggcccgttcgggtccatcggtcggcgtttcaaccgcccggacgactcgcaatgagcgctgctcgcgctgcggacggggtcgttcgaggcctccgtgtgtccgtggcgcgagaggcactccgacaggtctgggcgctgaccttcggctctcgtgggaacccgtggcgcccgggagccgttcgcacgtacctcggcatgcggcacgaggcctttggggcgcgaccgtcgttgcgccagatcgtgcgctatctcgcgtgggccgcggaggagcgtcgcgcctggaggatgcggtgagcgcgcgtgtccatctgagagcggccagaggctgaggctcgcatgactgccggggtcctcgtgctcaacgcctcgtatgaggccctcggtgtcgtcagtgtcgagcgtgcggtcgggatggtggtcgacggggacgtcgacgtcgtggacgtcaccgacctcgtgctccactcgccgtcgacggcgattcgtgttccttcgatcctgcgtctccagcgctacgtgcggataccggcgacgcgtcggatcgcaccaacgcggcgcgccatcttcgcacgcgatggttatcgctgtcagtactgcggggggcctgccgagaacgtcgaccacgtcatcccgcgcagccgtggcggccgacacgtctgggagaacgtggtcgccgcgtgccgtgcctgcaacgctgccaagagcgatcggctgccggccgaggcggggatgcaccctcgacgcgagcctcgtgcgccggccgcgcgtactggttggttgctcaccgttggggtgcgtcggcccgagtgggagccgtaccttcgagcggcctggggagactcagctcgggatctcttgcttggcggcggcgacgatggccgtgagcttgctcgccgggaagagcggactcacgctcactcgcgcgctgcccggtagggcgtttgcgatggtcacgacacctcgagcggtgtcgtaggcgcgcgggacatcagtgccgaccacgaggaaggccgcccgggcacgtgggccgagccgcagtgaggtcgatgcgaggaggatctgatggttcgaggtcccgacccgcacgatctcgttgggcagcggcgctccgaccggcaggtagaagcccccgaccgagcagctcgtcgcgctcgtgttctcaaccgagacgacggcgaggtcgtcacctgtgcgggtgcgcgagagctcgatcacgcttccgtggaggaccgatgcagggcaggtcgcgtcgtaggcctggcggtgggctcgctggccgaggacgacgccgagcaccggcccgccgatgagcgcgatcgctgcgagcgcaatgggcacgcggagcgcacgaacgggcgcgcgcacgccttgtgccatgggtccctccctgtgtgtaagccccgacgagcgctcgtgcgcgacccgcatgtcgctcgccatggtcgataggctaggcccgtggagcgagtaccgcctcctgtcgtcctccccatcggcgtcgcggtcgcctctgggctcgcgcgcgtcgatcggctgccctcccgtctgcggcgatcgatcggcggcgccttgctcgtggctggggccggtctggctggttgggcggcgttgaccatggaggcgagcggaacgtccccggatcctcgcaagcccccggaggcactggtcagttctgggccgtatcggtttacgaggaacccgatctatctcggcatgctgagtgcgcaggccggcgcggcgttcatcaccgctcgcccatcgctggtgttcggggccctcgtcgcgggcgtgttcctcgaccagttcgtcattgcacgcgaggaacgtgaactcgccgagcgcttcggcgatgcctacgccgaggtcgtcgctcggacgcctcggtggctcgtgcgccggtgatctgccaccacgaatggcagtgtcaagatcgagaacaacaacagtgcgaccgggacggcgctcacgatgtaccagggccaggggccgagcagcgacagcatggtgtgctcggcgggtggtcgacgcaggaacatatagtccgcgccggttgcccagtcgatgaggccgtcgaaggccgtgtaggcgatcgagatggcaaggacacgccagggagcgctcggtcgaggatggatgccacgaccgatcgtcaggtagaaggccgccacgacgacaccgacatggccgacgaggtactcgaagaacacgaggtgggggaagcgaaccgcaaggtctggggtgatgatcgcctgcagcgtgccggcgatgccccagagccagaccacttcgacgagccagcgtcggggtacgacgcacgcgatcgcagcgatgaacgcagccgcgtcacacagcgagagcggcagattcgctgccagggaggcgtgcggtgcgagggcgacggcgaccgcgtcgctcgcggcgtccgctgcgatggcgatggcgatgatccatcccacccagtgggcggcgcgtggtgatcgacgcgaggccgcgatgccgatggcgccggcgacgccaagcacgccaaccgtggcgagatacggacctgtggtaggtgcgatcggcgtgctcatcgtggtgctcgtgccattctcgtcaccttcgatgctactcatcgtggcccttggtgtcggagaggctcgttcgcttcgccgcgctcgctttcaggcttgccgatcatgctcatgggccttcagtaggcgtcgctggtgggatgccgagggatcctccaatggctgtggtgacgccatcgccacggttagcccagcgacgggagcctgtgcgtcggttgatcgcgcatacagatgcaggtgccgctggcgcacaacgccgggagtcagtcgttgcccctcgatgctggtggccacctgggcttccccccatttgcttgacagtctgaatttaggccacggccacctcccggcaggcccaggagagctcgtactcgacgggcggtaggtacccgaggctcgagtgcaggcggacggtgttgtagcgctgaatccaggtagcgatggcagagcgagcctcggcgaggttcgcgaagcggtagcgacccaccagctcgcgcttcaggctcccgaagaaagcttcggcgacggcgttgtcgtagcaggtcgcgaccctgcccaccgactggcgaagcccgagcgttgcgcacagctggcgaaccttccgggagaggtactgactgcccctgtcgctgtggaagatcgccccagccaggctgccccgagtcccgagtgctccgcagatcgcctcgaccaccaggtcatcgggcatgcgacgcccaagtgaccagcccacgatccgcctcgagccaaggtctgccaccgtggcgaggtagcagaacccctcgtcgcttcggacgtcggtgatgtcgctcacatacctgcgcttcggttcaccaggggcgaagttctggctcacgaggtccggcagtggcgcttcctcttcccgcctcgtggtacgcacgaagcgccggggtgggcacgctgccatctcgagctcgcgcatcaggcgttccacccgcttgtggttcacgcagtaaccacttcgtcgcagctcatgggtcaccctggggctgccataggtgccgtcgctcgcctcccagatggcgcgaagctcgctcgcgagcaccaggtgctcttggtcagggccgcgctcgcgccagcgtcgccaggcgtagtacgcctggcgagagaccctcgctactcggcatggcgccgctactgggacgccctcggcctcctggtgagcgatccagcggtagcgggtcactggttgccctcgcaggatccgcaaaggccaggcaacgtttcgccaggtctcgttccatggtgagctgcttgacctggcggcgcagccgggtcatctcctcgcgctcggcgctcgtcaggccttctcgctcaccgcggtcgatgcgttcctgacggacccagttgccgagggtctgctcgttgatgccgagttcgcgagcgacctcagcgatggtgcggtgctggtcgagcaccaacgctgcggcgtcctttgcggaactggctcgggtagcggccgcgtcgtcgtcgagcggggctatcgcccgggggcgggttcggtgtctggctcgtcccttcctcctatagcaggtgtcaacctggaggggggaaggccacagagccgctcacgcgaccgttactgcccagccctgacgcgacgcggcgaccagcgacgtggctagcgtgcggtggtgcgcgacagcggcactcaaggcgccccggggcttcgcgtgagggatgcgctcaccaatgttcgcccgacgacggtgtcggtgaacgctcgccgacgtgtcgaggccttcgtccgtccgagctcaagcgcgacgatcacacgaaggtctgtgtgttgcaaaccacgaactatcgcaaccatgagccgggcgcgcggtgctcggtccgcgtcggggacatcggggccccagggggtcgaggtggcgtcgtcgaccggtcggggtgggtgggccgacgtgtgcgttcagcgtgcgtgggagggagttgtcaccttgacaccgtcgccaggcacgtggcacggtcaggcccgaggcgagacaagctcgcaggtctgcagctaccgcgctcgagaggagtttgcgcgtcgccgtggctgcgacggcggtggttcggttcgagtgttccgagccatcaccaacgctctgcgcgggtgcgtgataggcggtcggtggccatagccgatgtgaaccgggcctgcggttcgcgcagggatcgcgaccgaggccgctcccggcagatcctgctgaggtgagcatcagggcctcatgctcggtcctcgccgtcgtcgaactgcaccgcttcgaggcgctgacggcgcgcttcgagcgtctctccaccgtacatccagtaggccccaccctgtgccgacgttgtccgcagaccgatccgctgtagagccttgacggccgccgcggacaggctcaggttctcgccctcgaactccactcgattgccaggcaggacggtcacgtccattgtctcgtctcgcgagaacgtcagtaccgcgcccaccgggatgtcgagcgcctcgatgcgcagattcgatcgacgctgcctcatgctgttaagcgcgacctggtcgtcggcatcgagttctggctccgtcacctggatcggcgtgtgcggtgcgatggagatggccaggacgactcgttctggctcaattcggaagaactcgcgcttcggattgacccgcgcctcggagaacaactggtggagcttgcgttccaatgtgcttgcgtcggcgacctctgcggcgaagtggcactcgaagggcagtgggacgccggtcgtgtaaaggtcgttcatccgtgaggctacatcgccgttcgacttgccgattgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcagatcttgacgatccctggcattgcctcgttggtgaggacatagatgatctcggccacacggcaacgttagccaacggccgtgccgtcgaggctcgaggacgcgcgaggaggctcgggagcacgccgggcgtggcgttcgccgactcgcgaatccaggtgctgcgcaggagcgttaccgcgtgatgtcgggcgagctcgcgccatggatccagcctctgggcgcgagtggctcgccgccaagggtgcgctgtctcgcgtcggcgacgatgcgtcccacgacgatcggttcgcgcaggcctgcggctcgacaggcgtcgatcaaggcggagggatcgtggatcgcgatgacgagctcgtagtcctcgccacctccgagcgcgtcggcgagcgtggcgtcgggcgcgatcggaacgtgatcgagctcgaagccgacgccggatcggtcggcgagccggtgcaggtcgagcgagaagccgtcggacacatcgatcgcggcgctcgcgccgtagctggctgcaagctggccgtgagcgaggcgtggttgaggggcaaagagggcatcgtggaggtggcgcgggagtgcctcgggggcctctcctgcgagcacgcgtcgtaggcccgccgaggccgcaccgagcggaccggtgacgagcaggtggtcacctgagcgggcgccacgtctcgtgagcggggtgccatcgacctgaccgagcgcggtcacgcacagcgtcagcgtggctccccgtgtggtgtctccaccgacgaggggcgcgccgaggcgatctgctgcctccgcgaccgcgacggcgatggcgcgggcatcgatcgctggtgggcaggcgagcgcgagcagggttgcctccggtgttgcaccagcggccgcgagatccgagaggttcaccgcgaccgccttgtgtgcgatcgccgcgaggggccaccggtcgacctcgacgtggacaccgtcgacgacgaggtcggagcaccacacgcgcgacttggacgagggagcgatggttgccgtgtcgtcgccgatcgccagcgaagccgatccggcgccgatgacggcctcgatgacctcgtcttcgcgccagttcgtgtccacttcagctatctaagctgcctggtttgcgcattcggtccggatgctggcagcatggaggatcctgttcgagcaacgagcgagcaacttgacccttcgggaggagaccatggggatcgcggatgcgaaccaggacgtccagcgttggatcgatgagtgggtgcgcgtgctcgagcccgcgcgtgtggagctctacctcggcgagcgggaggagaccgatcgactcatcgacggtctcatcgcccagggcacccttcgaccgttggacccctcgcggcgtcctcggagctacgtggcggcctccgacccgagggacgtcgcccgcctcgagtcgcgcacggtgatctcgaccgacgatcccgatgatgcgggcccgaccaaccattggcaggacccgaccgccatgcgcgagcgtctcggcaagctcttcgcggggtcgatgcgcgggcgcacgatgtacgtcatcccgtttgcgatgggggtggtgggatcaccgttcgcggtctacgcgatcgaactgaccgactcggcctatgtcgccgtgtcgatggcgaagatggcccgtgtcggccgcgcggcctgggatgcgatcctcggcggtgcgcccttcgtgccggcggtccactcggtgggagcgccgctggcaccaagccagcgagacgtcgcgtggccctgcgatccggacaacacctggattgcacacttcccggccaccagcgagatctggtcgtacgggtcgggctatggcggcaacgcgctcctcggcaagaagtgcttggccctgcgcatcgcgagcgtgcacgcgcgtgaagaggggtggctcgctgagcacatgctcatcttgaagctcacctcgcccgagcagcgcacctactacatcgctgcggcgttcccgagcgcgtgcggcaagacgaacctagccatgctccagccttccgtgccagggtggcgagccgagaccatcggcgacgacatcgcctggatccgtccgggccccgacgggcgcctccgggcggtgaaccccgagtacggcttcttcggtgtggcaccagggacctcgcgccgcacgaacccggtcgcgatggcgacgatcagccacgacaccatcttcaccaacgtcgccgtcacgcccgatggcgacgtgtggtgggagggcatggacgaaccggcgccgagcggcctcatcacctggcgaggcgagccctatgaccccgcgaagggacctgcagcgcatcccaacgcgcgcttcaccgtggaggccaggcagtgccccacgatcgcgcccgagtgggaggatccgaacggtgtgcctctcgacgccatcgtgttcggtgggcgacgccgcgacaccgtgcctctcgtcgccgaggcgaggtcgtgggagcacggtgtgtggctgggcgccacgatggcgtccgagaccaccgcggcagccgaagggtcggtgggccgggtacggcgtgatcccttcgcgatgcttcccttctgcggctaccacatgggcgactacgtcgcgcactggctcgaggtcggtgcccgtgccggcgccaaggcaccccgtctctacgtcgtgaactggttccgccgcgacgacgagggggccttcgtgtggcctgggtacggcgagaacgcgcgggtgctcgcctggatcgtcgatcgcctcgagggccgggcccagggggtgtcgcatccctacggcacggtgccggcaccaggggaactcgacctcgcgggcatggcggaggcgccgtcgtgggacgcgctcttcggcatcggtgacgaggagtggtcacgcgaactcgaggatgctcgagcgttcgtcgccaccctcgctccgcggttcccggcctcgctcctcgacgtcgccgaggcagcggaccgagcagcagacaccgacaggggctgaggcaccccggcgatcagatcatcaggagcccgtggaggcgctcacccggcctgcgcgagtcgtcccggcgacgacgagaagagcggctatgcagaacgtggcggccatgatggcaaaggcccagcggaacccgaggtcggtgaccgcgagcccgatgagggcgacccaggccgcgccgatggtttgtgagacggtgaagaacacgccgaaaccctgccgttccaggtcgcggggcatgtgatcggcgaagacggtctggcggagcggcagttcggagtaggagaagatcccgatcgcgagcccgaccagcgcgagtaggagtggctcggcgccgaccaccacgaagcctacgagcgcagccgcaccaagcacgtagttgatgagcagggtgcggcgatgggccgtgcggtcggcgagctggcccatcgctaccggcccgatgaccgcgccgacgtagatcacggtcaggatcaccgtgatggccgcggtggaggtgtggatgccgtcgtggaggtaggcgggtgcgtagaggccgatgatcccgatgccctggccgcccgctgcgatcgtgccggcgaggaggagggtccacacgggtcgggcacgaaggagcgtccacagcgacacggacgagcgggcggacgacgtggtctgcgcctgggggatcggacgacgccagggactgcgaatcccgacagcggtcaccaccgcggtggtggcgaggagcgcagccagcacccacagcgcactgcgccagccgccgatcgcgatggcgaggccggtgatgctgggcgcgatcagcgtgccgatgttgccggcggtgacgtgccacgacaggacggtgccgcgccgcttgggatgtcgggaggagaggaacgacgaccccaccgggtgctgtggccagccggcagcggcttggatcagccgtccgctcgcgaagatcaccacgttcggcgcgagcgccgagaccgcggctcccacgacggagccgatgttctggagcgtgagcagcagcctcgcaccggcgcgcttgacgacgacggccaagccctggagtgctgacccagcaatcgcggccaccgagagcagcgctccgatgaccgcatacgaggtgtggaaggcggtgagggcataggggatcacgatgccgatgccggcgacataggcgtgttggcccgcgtgcgaccacccgacgcttgcgaggtcaccgaggaaggaatgtcgagtgggtttgggttcgccggcgttggtggaagaggactctggcatcgatcagctcccctcccaccctaaccggaggtgccagcctgggtgcgattagccctgtcggcgctggcgctcgggctcgatgacgagcaggacgcgctcggaggtgatcggagcggcgtagggtccgccggtgtagcgctcggagagccgatcgatgtgctcgcgagcgcgagcgccgccctcggtggcgatcacgcggccgcgaacctccacgtagcgataggggttggcatggtcccacaccaccaacgcgaccctcgggtcgcgttggacgttgcggtacttcagccgatggacctcggtgttgatgaggacgtggtcgtcgtcgatgtcgaaccacatcaccgacgactgtggcgacccgtcggggagcagcgtggtgaaggttgcgaagttcgctccggtcgcgagctccacgaggagtggatctagcatgcacgtaggttagcccaacccgggctgggcccgcgagtgcgctcgctcgtccaccgtgaccggatcgacgggcgcaagcgcggccacggcgcccaagtggcacactcggacggaggcgacctcgtaggcgacggtacgggagggtaggcatggcggttgcgtggatcgacggggccctggtggacgaggccgatgcccgggtcccggtgttcgatcatggcctcgtcgttggcgacggggtcttcgagactctcgtcgtcgtcggagggcgggcctttgcaatccgacgtcacctcgagcgtctggcgcgcagtgcgcaggggatggggatcacgctccccgacctcgatgcgttgcgcggcgcgatcgaggccgtcgtctcgaccaacggttacgaacgagccaaggtgcgggtgacctacaccgccggtgacggcgaactcggctcgggtcgtgtcggtggtccgacgagggcgatcgtcgccgaggcgccgatcgagctcgaacctgcgacctgtgcggtcgcggtggccccgtggcctcgcaacgaacgtggcgtgctcgccggcatcaagacgacctcctatgccgagaacgtggtcgggctcgcgtgggcgcgagcgcgcggcgcatccgaggtgctcttcgggaaccttgcgggcaacctgtgcgaaggatcgggctccaacgtcttcgtggtccgtgacggcgacgtgctcacgccgccgctcgacgccggtccgctcgccggagtgacgcgtgcgctgctcatcgagcgcttcgccgtcaaggagaccaacatccccctcgacgatctcttcgacgagcgggtgtcggaggtcttcgtcacctccacgctgcgcttcgtccaaggcgtgcaccggctcgacgaccgcgagttcgagcaggctccgggtccggtgacggccagggcacaggcgctcttggctgatctcgttgcctctgacatcgacccctgaggagtcctcgtgcgcttcgacgatcttgctcgcgtcagtgagctggccgcgcggttcccggacgccgctgtggtccggctcgtcgcgttgcacggtttcgggggtggcgagcgtgcggcggacctcgcgatcatggctcccgaaggaacggtcggggcgatcgtcggcccgggggtcgtcgatcgcctcggatccgacccgacgccacgacttgctcgtgtcgaggtgagcgatcccgacgccgaggcgcatggcctcgcctgcggtggctgggcggaggtgctcgtgcatcccgcctcgtggctgccgccacttggcgaggtcgccggtcggcgtgtcccgttcgtgttgaccaccgtcgttggtgacgacggaccggtggcaccgatcgcgatcgaggtcgatccgctcgtgcgtccaggcgtgacggtgcgcgatggcgtccatcggcaggcgttcgtcccgaggccgcgtttcgtcgtggtcggcgatgggcccctcgtcgacgagctgggatccctcgggacctggctcgacgtcgaggtcgacacaggggacgtcactgggctcggcccgctcgacggcgtgctcgtgctcacccacgatcatgaacgggccaccccggtgctcgcgtccgcgttcggtgcaggggtcggctacgtggcggcgctcggatcgcgagccacccaacacgagcgtgtggagcggctgcgagccgtcggtgtcgacgcgcgccgactcttcggcccggcaggtctcgacctcggatctcgaagcgtccgcgagacggcgctgtcgattctcgctgagtggcttgccgtgacgcgagggcgctccggtgcgcacctcgccgccggcgacggaccgatcaacggctagtcgatcgcgtccagcttgagcggagggatgtcgccgagcggtgggggcgacgacggctcgccctcgagcgctcggtcgcagagccacgcccgcgaggggctcttggtcgatgccgggcaggtcgagtcgagcaaccgcagctgcttcgctgagcgcgccgaggtgggtgaggaggtggcgcgcgttggtcggcgcttcggcgagctcggccgccgtcctccggaccgcgtccccaaggcgcttgcctacgctcccatcgagggctgcggtgatgcgttcgacgaagccatcgcgcacaactcggtcggcgagcacctcagcggcgtcgagggcgtggacgtggggggttccctcccagatcgggagcacgagtgcttcgcggtgccatcgtgcgatcggcgcgtcctcgacgaagccaagcccgccgaacgcctccatggcccgctgggtgacgaaggcggcctgctcggcggtccggaccttggcgacgtgcgaccgtgcgcgaaggatctggtaggcacggtcgccgtggtgcgatccgagcgagctctgcgtctcctcggcgagctcgaacgcgagcaacgaggtggcgagctgagaggcgcggaggcgagcgagctcgtcggcgaacaaggcatgggcgagcagcggtcgaccgaacgcgacgcggcgctgcccacggatggtcgcctcggcgagcgcgatgcgtgcgatgccggcggcgctcatggcgttggcgacccgcgcgatcgtgagcgattcgaggatgcgatggattccgtcggggggagctgcgaggagttcggcgggcgcgtcggcgagatccacctcgccggtcgggacggcgcgggtggcgagcttgtccttcagccggcgaacggagaaggcgagcgagccatcgggctgctcgcgacgcacgaggaagagcccgagcgaacggaccccgcgaacctcaccgacgtgggccgcgacgagcgcaacgtcggcgagtccggcgttcgaggcgaagaacttctcggccgtgccgatccgccactcgccgttgggcgtctgggtcgcacgggcacggagcgacccaaggtccgagccggcgtgggtctcggtgaaccacgtcgcgccgaaccatggcccctcgcgcaagcgtgcggtggcgctgtggtggggggcgagatccgcgagtgcgagcgagacctgcgtggtgagcgtgatcgtgcagtagaggccgggatcggcgaggaggtagccagcggcgagcgcggcgaggaggccgtcgggctctgtcgtggcgagcgcgaccatgggacgcagtcgctcgagcagggccacgtgggtcggggcgagctgggcgcggtcgatgcggttgccgtcgaggtcgtgggcgaccagccgtggcggcgcgtcacggtcgacgtggcgcgcgacctcgagggcgtcggccgagatggtgcgattgaggtgctcgagctcggatcgtcgagccgcagagagtcgagcggcgagccagcgctcgaccacgggatcgagcgcgagctgatcgagtccactcgcgtagccgccctcccgtggcatcaccatccgatcgcgctcccgtcctcggcccgggggtccgagcagctgatgacgtcgtgctcgcgaaccatcgcgatatggcacacgccggcggccgtggtgaggccgggctcgagggtgagcggcccgatgcgctcggcgagctcgccgaggacggacggatccacgtggtcctcgatcacccacgtgcgcttcccgtcgtggtggtgggtgtcgaaaccggggtgtggaccggacgatgcggcggtctcggcgagtcgggcgcgagcgagggcagtgcgcgggtcgatgccctcgcgcagcgtcgcagagaccacctgggcgatgaccgtcggctgacgatcgcctcccatcgtccccgcgacgaggcgcaacgtgccggtacgcggatcggtggccatgagcggcgcgagggtgtggcgcgggcggcggcgcgggccgagctggttcggactcgcgggatcgagatcgaacccgaccgcgcctcgcgagtgcacgaagaccccggtctcgtgggtcgtgagtcgggtgccgaacgcattcgcgttcgactggacgaggacgcaagcgccccctgcgtggtcgacgacgacgatcgccgtggtgtcgggtgcgttcgggcgtcggagggtcgcgggcggagacgacggagccggggcggcgagggcggcggcgacgtcggccccgtcgtagtggagctcatggagccagcgggtctgctcgatggcgtcgaccatctcgagataggcctgcgtgagcgacgtcggtcgttcgggcgggagcgccgcgaggaggccgagggtgagaaagctcgccgacggagccggtgtccccatcatgcgcagcccgagggcgtcgacggcgatcggctcgacgagctcggcttggggtcgggcgaggtcttctgctcgcagtgcgccttgggtgagcgccatgagctcggctccgacctcgcctgcgtaaaagccctcgcgtccgagacgcgtgatggcctcgagggtgcgggcgatgccgtggtgacggatccgctggccagggacgaagcgacccttgaacgccgccgtgagctccgagcgaaagccgaggtccgagagctcgcgtgcgccagcggcgagacgggcgggcgcggcgaagccgttgcgcgcgtagtcgatcgcgtcggcgaggatggtatcgagggcaaggcggccgaagcgttcgtgggcgaggagccaaccgtcgacggcccctggcaccgtgatcgccgctggatggtcgcggggaatggtgcgaaacccttgctctcgcaggatctcggcgttcgcgttcgagccggcgcgcccgatgccgaccagcgcgtggacacgaggtggcgtgcggggtgtgcgaggttgatagacaagtccgacgacgtcgccaccgaggccgcacgcgtcaggggcgacgacggcgagcaccgcgttcgccgcgatcgcagcgtcgacgctactgccgccgcgacgcagcaccgtgagggccgcctgcgaggcgagcgggtcgatgctcgagacggccgcatgggggaaaccgtgacacgcgacgacaggtggctccacatcgcgcaaggctactccacacgtcgcttcggcgcgcagggccgtgagaaatgcgcgattgcgtggtcgacgagctcttgtgcggcggattcgtgagatttactcgtgtggtcatacggaatcggcttgcctcggggagcgagatgcgctagcgtacacaacggttccgcgctccgcgttgccacagcgcgaccgcggcgtacgtccagggcacacgaggccagcaccgagagggcacggccgagagggcaaggccgagaacacggccaagaaggagcagagcatgattcgcacgatcgggctgccggcggagacgaaggatggcgagcgacgggtagcgctcgagccgagcgcggtcaagagctgtgtccaggccgggcacgatgtcctcgtgcaggccggtgccggccgtggcgctggctttggtgatgccgactacgaggcggtcggcgcgaagatcgtggccagtgcccaggaggcctggagtgcggatctcgtcgtgaaggtgaaggagccccagcgtcacgagtgggcctacttccggcgcgacctcgtcctctttgcgtacttgcatctggcggccgagcccgaactggcgcgggcgctcatggacgctggggtgcgcgcgtatgcgttcgagacgctcgaggagcgaggcggcttgccgctgctcgcgccgatgagcgaggtcgccggacgcaccgccgccatcgtgggcgctcattacctggcccaagggtcgggcgtgctccttggcggctcggcaggcgttccgccggctcgtgtcgtggtcgtcgggctcggtgtcgcaggaacgatggcggcgcgtggtgcgcgcggcatggatgcggaggtcaccgggatcgacatcgacctgcaccgcttgatggaggcccacgagcgcgggatcgtcacggcgacgctcgcgagttccgagcacgcgatcggtgaggccgtcgccgatgccgatctcgtcgtcggtgccgccctggtgaccggggcgaaggcgcccaagctcgtcctcgaggagcacgtgcgatcgatgcgaccggggtcggtgatcgtggacctcgccatcgaccagggcgggtgcgtcgagaccgcccgaccgacctcccactcgaacccgatctacgagacccacggggtgatccactactgcgtgacgaacgtgccgggccagtacccgcgcaccgcgtctcgcgcgctcagcgccgcgatcgctccgaagctcgtccgcctggccgcgaacctggatgaccccctcctcgcgaccgcgctcaacgtcgctgacggtcgggtggtgcacccgacggtcgccgatgcccttgggctctagtgtcgctgcccgcacccagcctctggctgcgtgagctcggtcgcgaccgttggcgtccgcagctcgatggatccctcgaggcggacgtcgccatcgtcggcggtggcttgagcggcctgtggaccgcacacgcggtgctcgacgctcgtccgggcgcctccgtggtggtgctcgaggccgagcgggtcggctggggcgcatccgggcgcaacggtggctgggcgtcggcactgttcccggtgagctggggtacggtggcgcgcagcttcgggccggagggggcacgggcgttgcgcacacgtctcgtcgagaacctcgacgagatcgaagccgccctcggcgatgacgccgcggacgtggagtggcaccgagccggcaccgtcgtggcggcccgaagcgaggagcagtggcggcagctggtggccgatgtccgggaggagcaggcgctcggccttcgggaccctggggtgctcctcgacgcgcgaggcgtgcgggctcggttggcgatcgacggcgctgtcggcggagtcttcgagcccgtgtgtgcctcggtgcaccctgccaagctggtcgagttgctggctcggcgcctcgagcagcgtggaggtctcgtgctcgagcggagtcgggtccactcgggtgcacccggcgtgctcgtgggtgtcggcggtcgcgtccgggcatcgcaggtggtgtgggcgacggagtcctacagcgccgccgaaccgcgctggcatcgggcgctcgccccggtggcatcccagatcatcgcgacggcaccgctctcggcggcgcagcgtgagcgcctgggcaaccccgaggcagggctcaccttctccgatggtcggcgtctcgtgatctatggtcaactgcgagccgacggtcgggtgatcttcggcggacgaggcgcgccgtatcggttcggctctggcgtcgagttcgcgaccgaggtcggcgcgaggatgcgcctcggcctcgccgcgacactcgcggagctgctgcgtgaggccgggcccatcgagatcgaggcgtcgtggggcggtaccatcggtgtctcgcgcgattggtatcctcgggtgctgcacgatccgagcgagcgcatcgtcttcgtcggcgggtatgcaggcgacggcgtcgcgatgacgcgcctcgcgggccagctcgcggcggcgtacgcgactggggtgcggctcgatccggacctcgccgtgatcctcggccgaccggtgcggcggtgggagccggagccgatgcggtggcttggcgtgaacgttgggctcggactcacgcgactcggcgatgcgctggagggtcggccgcacgcgcagcgcgcagtggacgtgctccgaggagcagtgctcggtcgttagcgttcgctgcgatggtacgtcgtaaggtggagcgagaccgcccaggtgcggtcaagacgagaaggaggcaaggcgatgggccgcttggcaccggtgtggagcaaggtgtcgccgatcacggtcacgcatggccgaggcgcgcgtgtgtgggatacgaacggtcaggcatggcttgacatgacggctgggatcgccgtgacctcgacgggtcacgcgcatcccaaggtcgccgaagccatcgctcgtcaggccgagcgcttcatccacgcgcaggtgaacatctacactcacgacctcttgcaaccgctcgccgatgccctcgatgcgatcacgcccgacggtatcgacacattcttcttctcgaactcgggtgcagaggcaaccgaggcggccgtcaagctggctcgccaggcgaccaagcgccccaacgtcatcgtgttccaggggagctttcatggccgcaccgcccaggcgatggccatgacgacctcgcgcaccgggtaccgggccggctacatgccgctgcccgctggcgtcttcgtctcgctgttccctggcttcccgcgctcgagtcgggtgggtgacgaggtgagtgtggacgaggcactcgactacctcgactacctgctcgcgtcgcagacggcgccggccgagaccgccgccgtggtgatcgagccggtgctcggcgagggaggctacatcccggcgccggcggcgttcctcaccggcgtcgtcgaacgcgcccgggcgcacggcatcgtgttcgtcgccgatgaggtgcagaccggttttggtcgtaccgggcggatgttcgccgtcgagcacgccaacgtcacgccggacatcctcgtgatggcgaagggtatcgcgtcgggatttcccttctcggggatcggagcatcgtgggagctgatggagcgctggccggtcgggagccacggaggaacctatggcggcaaccccatgggcgtcgcggcggcgctcgcgaccatccaggtgatccaggaggaggggctcgtcgacaatgcggctcgacgtggcgcccagctgcaggcgtcgatggagcgcatcgccgagaagttcgagtgcgtgagccgagttcgtggcctcgggctgatggtcggtgtcgagcttcgtgacgacgcggggcggcccgatgcggacctcgtcggccgagtgctcgccgagatgcaggcgagccaccgcgtgctcgcgatgagtgctggcaccttcggcaacatcatccgctggatgcccccgctcgtggtgagcgaggccgagatcgacgaggccgccgccgcgttcgaggcgtcgctggcccacgtgctcgcacagcggtaggagcgtcctggtcgggaggctctcggtctcccccgaccgcccccactcgaagtgctcgagcgggggcggtcggccaggtgcaggtcaccgcggtcgggcgccgtggccgcgccccgcgcgcgcggccgcgaggcgtctagccgttcgcgagtgagggacgcacctccgcgacgacgaagtcgcgagcggtgccctcgaagtagcgctgtggcggccggagcatgtcgtagaccaagcggtagccgtcggacggcgaggctgcctggccgagctggtggttgaagtagaagaagtccgtccagtcggagttgatgtccagctccatcgcgttgaccgctccgacgcgcgcgaggaggcgggcgagcgacgcgaccgacaggccgggacccgtcacgtagacgagcgcgccgttacgggtgatgccaacgccggagcgccacaccaacagctggttcccgaccgtcgcgccccagatggcgaagttggtcgagttcacgagtggattgatgcgcccgttggagatgagcgggatcaggttctgtcgaacgaccgcgatccccttgggcacatggttgccgtgcgtccaggtctcgatggtgggcacgccgctcgtcgagatcacgaagctggcggcaccgttgcgcaagggaaccgccgtgcggccataggcgtagtacccgccgttcgcgtcttgcatgcgaaagccggagttgaaggcggcgacgagatcggctgcgaccgggttcgtgatcggtgccatgtagggccaaggaccgccaccaggcggttcctgggcacccgcatactggatgaagcgcaggagccgagtgtccatccaggcgaccccggcgaccagcgaggtatggatggggtccgggcgcatgagggtgacgtagagggtagggacgccattgacgagcggcccctccggggtccaaacgccctcgttggcgagcggcggcttggcgaacgggatcacacgggccggtgccgggagcggccccgacgcggttgcgtcgacgtggccgaccggtgtgagcgcgtgacgcggtggcttcccgcccgtcggcggttggttgatggcgtaccaggtgttctcgagaaaggcgacgaagctcgcgcccccgtgtccgcggacccactcgacgaacttcacgccgagcgacgccgaaccgggcatcgtcacggtgccgatgccggcccaactcgccatggcgaggacgacgacgagcacgacggcgcgaaccagacggaacgtgcgcgagcggcgacggcgaggaagccgctcgatgcgggggcggctcggcgcggatcgttggacggtactcacgaaagctccttctgtcgcaggggggtggcgaacgaaacggctgcagtcacggtagcagtggggagttcgactcggaagcgggcgccaccgaggtcgctgtcgaggacgcgcacgcgacccccgagcccgacggcgacgcttcgtacgatggcgagcccaaggcccgtaccgccgtcatgacgggcgcgggccgtatcgagccgcgcgaagcgctcgaagacctcgtcgcggcgatcaggagggatgccgggtccgtcgtcgtccacatcgagcgtcacgccgggcccgagggagccggtcacgagcgtggacgtccgaacccgaacgcgagaggtcgcgtgtcgtgcagcattctcgagcaggttgcgaaccagcgaccggagcaactctggctcggcagcgatcgtggcatgcacatcggtagcgagcgcgaagctcaggcggggattgaggcgttcgaggcgagcgacctcgtcctcgacgacaccgaccaggtcgagctccgtggaggcggggcgtcggggtccggtctcggcgcgcgcgaggaggagcaggctctcgatcaggcgctgcatgcgatccgcctcggacagggcgatctgcgtcgattcgtcccagtcggtgatctccgggtggagcgcaccgacctcgagggtggtgcgcagcgccgagagcgggctcttcagctcgtgcgacgcgtcctggatgaactgcttctcgcggatgagcgcgtgttcgagccgtgcgagcatggcgttcatcgtctgtgccagtcgggcgatctcatcgtcgcccggcggttcggtgacgcgctggtcgagctgcgacgaggtgatctctgcgacgtcgctgatcatctggtcgaccggtgccagcgctcgcctcgccagccaccacgtggcgctggcgacgacgaggagcacgagcggatagacgacgtcgaagatgtgcaccaaggtcctcgtcgcctgatcgacactggcgagcgaggcgatggtgaacacgtagtaggtctcgacgccggagctgccgacctgggcaggtacggcgctgtgcgcgagggtcgctgctgcgcgtgtggtcagcgcgatgggctcggcgacgagcaccgatcggatgtcgatgtcgtggccgaccaggatcgaccgcgccttgctcgtcgcccgcgtgacgacgagaccggcgggtgggacgtggtgcggattgacgagtggggcgacgccacggaggttgggggtcgcagcgacgacctgcccggtgctcgagacgatctgggccgcaagatcgccgcgcgggagcgggagcggtcgaggcacgtcgccgttgcgcacgaggaggacgatgtcgtaggcctcgctacgagcggtctggacgatccccctcgtcagggcggtacggagcacgagcacggtagcgacgaggcttgcgaggagcgcgagaccgacggcgacggtggccgcgacggtggtgcggaccaccaccgacgcagcgaggcgaccgaagaaccgaacgacgcgccaacgagatcgtgcgagacgccccaggtatccgagcgagttcagccgcatgggccgcggtcactcactggcgctcgacgccatcgcctcgcttctgccaccatcctcctccaggcgatatcccacgccgcggatggtggtgattgccttcgtgccgaacgggacatcgatcttcttgcgcagatacccgatgtagacctcgacgatgttcgagtctccctcgaaatcgtagtcccacacatgggcgatgatgtcttgcttgcgcaggacgtggcccttgttgcgcagcaagagctcgaggaacgaaaactcgcgggtcgtcagatcgatggtcacgttgccgcgcgtgacacggtgactcgctgggtcgagggtcaagtcgccggcctggaggatgggtgggtggctctcgacgttacgacgcaacagcgctcggatgcgcgcgacgagcacggtgaacgagaacggcttcttcaggacatcgtcggcaccggtgtcgagcgcctcggcttcgtcgtattcaccgtccttggccgtgagcatcaagatgggtgtccagttgcgctcctcgcgcaggagttgcgtgaacttgaacccgttgacaccgggcaacatgatgtcgaggacgatgcagtcgtagggggcatggcgcgccatgtcgagccccgtcgtgccatcgctcgcggtatcgaccgcaaagccttcagcgctgagcccgcgcttcaagctggcgagcaagttttcctcgtcgtcgacgatgagcagtcgcatgacacacctcccagcactcggaccctacgaggtttgctcggggctcgcctcaagcgagtccgaaggtttcctgagagtctgccgatccgagctgctcgagacgcggcttacgtgagcgtgggtgcgtgggcaggccgagactggtgccgacgccgacgagcgcgacgatgcgttcgtggacagcgagttcaagtgcgctggcgaggaccgggtcgcgggcgaggcgccctgttcgccacatcgagccgtacccgagtgcccgcagggcgagcaggagatacccggtcgcgacgacggcggcgtcacgctgctcctcgacgctcgtgcgagcggcggcgtcggggctcgcgatcaccgcgacgaagagcggcgcacgggagaagctcactcgagcacgtgcagcgtcgtcggggcgttcgagttcgatgtcggcgacgatcgccgctgctgcgtcgggccagatcgcgaccatccgatagggcgtgagagagcgatgatcgggtgccgtcgcagccatctcgatggcgaaggcaagctcggccgccgagggcgctggcggcgcgagcttcggttcggagcgccgggtcgccatcacggtcagtgccggtgcgcgtcgagcaagctcgagcaggctgtcgtcgctcaccagccacgctcgatccaggtcgcgagggaagggcgctcggccccgacggtcgtgatgcgcccatgtcctggcagaaggacgcacggatcgggcagctgttcgaacagttcggccgagatcgagtcgatgatcgtccgaaagtcctggggtgagccggtcttgcctggaccacccgggaacagcgtgtcgcccgtggcgcacagtgacgtgccgaatgcgaagcagaccgaccctggcgtatggcccggggtgcagatcgcctcgatcgtgacgtcgtcgatgacgagctgctgcgatgtctcgatgcgatgggtgacccacggggcatcacggccgtcggccgcacccatccagacactcatgcctcgcgccgcgagtgctggagcggcgccaatgtggtctgcgtggccatgggtgatgaggagagaggtgatcgatcgttcctcggcagctcgccagagcgtgtctggatcgctcggggcgtcgatgaggacacctccgcccggccaggagcacagccaggcattgttctcgagtggtgccaggacgaagcgctcgacgaccacatcgtcgagcgtgatgaccagctctggagcgcccacgtggcgggagcctagctggttcgcctggatctgggggacgggctcgtgcgcgcctcagcgtgcggcgaacggtggtgggtacactggaaacgggtcgtcgtgacggacgagtcgtgagtgaggggaccgaaggtgagacgtgtccggcgctcgggggagtgggctgttccggtcgcgaaggacgaccgggatcgggctcgagcgattctcgtcgaacgtctgcgttcgggcgcgatgggattcgatgagtacgagcgtcggctcctcaaggtcgagcgagctgcctcggtgccggctctctacgacgcaaccttcggtcgagcgcgactccccttcgggggaacgaggtggcgccgacgacgtgtccggctctcggtggtcgggctggtgatcgcggctgcggtcggggcgctcgggttcatgtggatcgggttcctcgtcgctgccgctgtcgtgctcgtcgctgtggcgggcgtcaacctcgcggtctgggtgcaggcccgcaggtacccccaacggttcgaccagtccgtgggcggcacgtcgcgctagccgggtgcaccggagggagccggtcgacctgcgttgcgcagccgatacgccgattggatcgatgcgccgcttgggactgcgtcgatcggcccggagcgagtcggtgaggttggcttcggcgtcgcggccagatagcgtgcggtcggtgccatcgacgcacgaggtggctggccagaagggagcggtcaatgagccaacactggcatgaggtgcaagacgagcttcgcgacccggtcaaggagctccgtgcccagatcccagagacgtggcacgcctatgcgacgttgcaccgccatgcactcgaggccggccacatcgacgccaagaccaaggagctgatcgcgctcgcggttgcggtgacgacccagtgtgacggctgtatcgcgtcgcacgcgcgcggtgcggcacggcaaggcgcgaccgctgaagaggtcgcggaggcgctcggcgtcgtggtcttgctcaccggcggccccgggaccgtctatggcccacgcgcctatcaggcattcctcgagtttcgcgaggactatcgaaccgctgagtgagccacggcctggacgacgagatcgacgacgtcgatcccagcgcgagcgagtgttcgtgctccgacgacatcttcgatctcattgaccaccacgtcgtcgtcgtgctcgaagaggtcgatgccgtagtagccaggtccgatcagacccatgacacgggtagcgaggcgatgggactcgcgagtcggtgtggcgaggtgtcccgatgctccacggctcaggttcgcagccaccccgtcggccgcgcgtcgctcggtccatgctgcgatcgtgctcccgacgacgtaggcgcgcaggacgcgctcaccgccttggacgaaggcttgggtgatccacgcgtcgagatcgcacctgggtggtgcggctgccgggacgatgcgcacgccgtggccgccgtggcccgctcgaggtttgacgacgagatcagtggccgagaaggcgcggtgtgcgagccacgagggcgtcgttggtggtccggggagctcgtgctcggcgagccaccgggcggtcgccagcttgtcgttgccgatgagggccagaagcggtgggttcaccacgaccgggagccggtcggcgagccagcgacgcagctcgcgatcgcgcgagcgggcgatcgcgatggcggtgtcggcagccaacgccgggcgatcaccgggcccgaccatgcggagcgagcacgagccgaagtgtcgctcgagcccgtcgcggagcgcgcgtgcaaagtgcacgttgcgcgccagggaccatggatcgtaacagaggaggacgcggctcatcggctggggccgaggagctggtcgagcaccgcggctgcgacatcgatgccggtgatggcactgaggcgccagatgtgtgcgttggcgttcacctcgcagacgatcgagccctcgccgtcgtcgtcgatgagcaggtccacgcctgcgttctcggcgcccacggctctcgcagcttcgatggcgagcgtctgttcgcgccgggagggccagtacggatagcccgcgccacctgccgagagattggctcggaagtcgtggcgctggcggcgctccatcgcagccaccacgcggtcgcgagcgacctggagccgtcgatcgcgaccacgcgacgatgcgatgaagcgctgcaccaggaggcgacggtccgcgagtgccgaggcgatgtcgatgagatcgtcgagcgtctcggcgaggtggacctgcgatccgaacgagcccttggcctccttgacgacgagggggaggcccacgtggcgcaccgtggcctcgagtacacccgggtcgatgggctgcttgggatagagcggcggtaggagtacggacctcgggaccgtgaggccggcgccgacgagacgtgcatcggtgcggcgcttgtcgtcgcaggcgaggatggcctctggcgagttgaccacctgcgcgccgtcagtgcggagcgcctcggcggtggaggcgtccttgtcgagcatcagcacgaagcgtgcatgcggcgggtcgtcgagccagatggcctcgcgcgagagatcgaggacgccgacatgcggtgttcgctgacgcgcagcgtggaggtagaggccagcgttcgcgcggaatgctgggccgagtccaaggttcgccacgaccaggatgtccagcgggcgcgtacgatggcttggcgccgggtgcacgcgcagagtctacgggtcgcggtgacgggaggacgtgtgggggtggtgagccgagacgacatcctcgacggacgtgtcgtcctcacggcctcgggagggctcgacgacgtcgaggaaggcgtgacggtgctcgccctgttcggtgccaccgaggccgtggggggtggccctcccgtcgaggtgctcgggggcttcgccgatcgtcttgcggagctgtcgcgccgaccggtggtcacctttgcgccgcgaggactcgatggcggtggtgcgttccgagagcgagaagcgctggcggatgcacggcgtgtcctggccgaggtcggagggcctgtcgtcgtgctggcggcgaccgtggcagccggggtcggcgttgcactgggccgcgacgagcgggtcgtgggggtggcgctcgtcgacccgtggacgatcggcgaggcggtcgccttcggcgtgaacctcgacacggatgcgagcatcgatcaatccggcgatgcactggcctgcgcggtgctcgtcgtcaccgaccacgagcgcgacgtcggtgcgatcgagacgatcgcacccgaggctgagatgcatcggctctctggggccgcgcgcagcttcgtgctcgatgcgcgcgtcctcgccatcgtggcgggctggatcgagcgggccccgtggtctggggaggtcgcctcgcccgaggcctagagcacgggcgtggaggatcggcggttgtgcgtgagagtggcggcgccgggtgtgccccagctcggctgttcgcgcgcgagctcgatggcggcgcgaaggtcgtgcgctgcttgcctcgggtccggggcttccgtcagtgcccgcacgacgacgaagcgccgtgcacccgccgcgacgagcgctggtatggcttgagccgtgacgttgccggtgatgaagcggggtcgagcctcggctgctcggtgtgcgaaggcgacgtaggagcggccggtgccggggcgccctggcttcgtcggtgtgggctcgaccggcccgacggagaggtagtcggcaagtggcgaggcggcgttgaactcggctggtgcgtgcgtcgacaagcccacgattctgtcggggccgacgagggaacgaacggtgccgacgtcgaggtcgtcttgaccgacgtggaccccgtcggcgtcgctggcgagtgcgatgtccggccgatcgttcacgatgaacggcacgccgcgccgcgcaaggagccgggcgaggtctcgagcggcgcgaagcacgagtccatcgggcgcgtccttcgcccggagctggacgatgtcgacaccgccgcgcacggttgcgtcgacgaacgcaagcaggtcacgccgcagcgggacgcacaggtacaggcagcggtccccgagcgacctcgtcactgccgcgccttggcgcgagcggccttgaccgccgccttggtctcacggatgcgctcgatggcttctggcgagacggcgtcggcgaccgagcgaaagctgccgggctcgccaaagggctcgctctcgcgctcccacccgtcgggacgaacgccgaagcgcttggcgagcagggcgaggtagatgcgtgccttctcgtcgccgaacccaggcatggcctcgatgcgccggcgcagctcggccgcgtcgcgcacgtcctcccagagtgcggtgacatcgccggcgtaatgctcgcacacgctcacggcgagtgcatggatgcgcttggccatcgaggtcgggaatcgatgcagcgctggcttggtggcgacgagtcgtgcaaggtcctcggggtccatcgccgcgatcgagcacgcatcgaacgtgcgaccgagcgcacggaggcgctgctccagctcgagcggacctcggaaggctcgttccatcggtatctgctggtcgagcagcatgccaacgaggagggcgaagtgatcggtggcgagcagctcgttggcgcgctcgtcgtcggtcaggtagagctcgatcacgcttgctccttcgacgggaccgtatgagtggcgtgccctcgagcctacatggtcgggtcgaagcgctcgggtgagactccgtagtgcgcgagcgcatcgtggagttcctcgggcttcgcctcgccgatgcgcacgagttgcgcgatcgcggcgacgacgacgtgcgccgcgtcgacctcgaagaagcgtcgaagcgcctcgcgcgtatccgagcgaccgaagccgtccgtgccgagcgcgaggaaaggtcgatcgacgaagttggcgacctgttcggcgacgagccggacgtagtccgtggtggcgacgatgggcccgctcgactgggccatgagctcgtcgagccacacgcgctggcgttcggtcccggtcagtcgctccgtgcgctcggcctcgagggcgtcttcgcgcaagcgcttgtacgacgtgatcgagaatgcggtcgctgccacgccccagtggcgagcgagttcgctctgggcctcgagcactgcccggtgcgcggttccggagaagaacagcgtcacgggacggcgccgatcgcgaggggtcgctgccgagatcggctcgacgtcacccatctcgggggcaggacggaagagatacccgccgcgcatgatcgcctcgaccagtgccgctcgctcgaggtggtcgggcgcgggcggcatcgggtagttctcgttgtaggtcgtcaggtagtagatcacgtctctcggctggggaccgtacatgtcggcgatcccgtgctcgaagacggttgcgatctcgtaggcgaacgctgggtcgtaggcctgcacgttggggaatgccgccgccaggagcagcgaatgtccatcggtgtgctggaggccctcaccgaggagcgtggtgcgccccgccgtggcgccgacgagaaagccgcgcgctcgtgcgtccgaggccgcccaaagcaggtccatcgtccgctggaagccgaacatggagtagaagaggtacaccgggatcatcggaacgccgagcgttgcatacgacgtgccggccgcggtgaacatcgccgtggcaccggcttcggtgatgcccatctcgaggatctggccgtcttgtgcctcggtgtaggacagcaagagcccggcgtcgaccggcgtgtagagctgtccgatcgacgagtagatcttggcctctcgaaacagcgcttcgagaccgaacgtccgcgcctcgtccggcacgatcggcgcgatacgggatccgacctgtgggtccttgatgagcgatcgcagaatgcgagccatcaccatcgtcgtcgacaccgcttgggcgccagagccgtcgtagaactcggcaaacgcctcgctgctcggcgcagggaggctccgtgcgcgttcgacgcgcttcgggaggtagccgccgaggacgcggcgccgtgtgtggagatactcctcctcgatcgagcccggaggaagcgtgatgtagggcggatcctcgcccgcaagcatctcgtccgagatcacgtcgttcaggtggaggcgatcacggaactcgaggagctgctcccgggtcatcttcttgatctggtgggttgcgttgcgcgcctcgatgtccgggccgagcgtccaacccttgatggtcttggcgaggatcgcggtgggtgaacccgtgtggttcaccgcggcgtggtaggccgcgtagagctttcggtagtcgtgtccaccacgagggagcgcctggagctcctcgtcggagaggtgctccacgaggcgacggaggcgtgggtcgggtccaaagaagtgttcgcgaatgtaggcccccgactcggtcgcgagcttctggaagtcgccgtctggcgtcgtgttcatcttgttcagcagcaccccgtcgacgtcccgggcgaggagctcgtcccacttcgagccccagatcaccttgatcacgttccagccggcgccgcggaaggtcgcctcgagctcttggatgatcttgccgttgccccgaactgggccgtccagacgctgcaggttgcagttcacgacgaagatgaggttgtcgaggtgctcgcgtccggccacaccgagcgctcccaccgcttcgggttcgtcgagctcgccatcgcccacgaacgcccagatgcgactggaagcggcctgggcgagcttgcgattctccatgtagcggttgaacatcgcgtggtagatcgcctggatgggcccgaggcccatcgagaccgtggggaactcccagaagtccggcatgagtcgcggatgcggatacgacgacaggccctggccaccgacctccatgcggaagtgattcagctgcgcctcggtgaggcgtccctcgaggaaggcgcgggcgtagaaacctggtgaagcatgtccttggaagtagacgaagtcgccggggtactcggtgtccttaccgcggaagaagtggttgaagccaacctcgtagagagctgccgagctcgcatacgtcgacaggtgcccgccgatgccgtccgcggcatggttcgctctcgtcaccatcaccgcggcgttccaacggatgaacgcacggatcctgcgctcgatggcctcgtcccccggaaaccatggctcgttctccggtgcgatggtgttgatgtagggtgtcgagaccgtcgcggggaagccgacctggcgctccctcgccgcttcgagcagcttcatcagcatgaaggtggctcgctggcgacctcgctcgtcgacgagtgcgttgaaggagtcaacccactccgccgtctcgtcggggtcgatgtcggggatctgatgtgcgaagccgtcgatgatcacgcctccattctgacagctcccgatgtcggtgtcgactccccgctagcctggcgcggatggccgtcgagcgtctcgtctacaccgatggagcctgtttgggcaacccgggtcctggtggctgggcctggttcgagcctctcacgggacgtcgagcgtccggctcggaggcgcagacgaccaatcagcggatggagctcaccgcggtgcttcgagcgctcgaggcagaccccgcgcccctcgtactcgtgcgctcggactcgcagtacgtcgtgcggtgcttccaggagcggtggtgggcacgctggcggcagaacggctttcgcaacgccaagggccaacccgtgtcgaaccgcgacctgtgggagctcgtccttcgtctcgtgctcgacgagggccgcagcgttcgtttcgaatgggtgcgtggccacgctggcgatcctgggaacgaggaggtcgaccggctcgcccaagctgcggcccgtgcggtggcgcgcggcgtctgacgggtgcgccgacgacctcgtcactaaggtggcctcatggagctgcgtggatcgtcggtggtggttacgggaggcgcctctggtcttgggctcggggtcgccgagcgcttgatcgggcgaggtgcccatgttgtgatcgtcgaccgcaatgcggaggccggggcggccgttgctgcgcgactgtccgccgagttcgtcgaggccgacgtgacggacgaagagcaactcgctcgcgcgttcgaccgggctgcagcgttggggccagtgcgtatgggcgtggcgtgtgcgggcatcggaattgccgagcgtgtccttggccgctcgggcgagccgcatcagttggcgtccttccaacgggtcatcggggtcaatctgatcgggacgttcaacctcctccggctcgcggctcgcgccatcggagcgagcgagccggccgatggcgagcgcggggtgatcgtgctgacggcgtcgatcgcggccttcgatggccagatcggccagatcgcctatgcggcctccaagggcggcgtcgtcggcatgacgttgccggccgcacgcgatctcgcgagcgcgcagatccgggtcgtgacgatcgcgccgggcatcatggacacgccgctgctcggtcaacttcccgaggaggtgcgccgcgacctcggcgcgtcgattcccttccccaagcgactcggccaaccagccgacttcgcgcagctcgtcgaggcgatcgcagagaaccactacctcaacggtgaggtcatccgcctcgacggcgcgctgcgcatgccgcctcgatgaaccggcgcgcggagtcgtcgatcggctgacctaggctggttcgcgtgcgctacgtcgaggcagccggactcaaggtgtccgcggtcggcctcgggacgtggcagttcggctcgcgagagtggggctatggggaggcctacgccaaccacgatgctcgcttgatcgtcgagcgggcgctcgagctcggcgtcaccttgttcgacacggctgaggtctacggttcggggcgctccgagcggatcctcggcgaggcgctcgcgtcgtcgcgggccaacgtggtcgtcgccaccaagtacgctccgacgctgccgatcccgggcagggctgctcgccacctccgcgcctccgcccagcgtctcggtcgtgacgccatcgacctctaccaggtacacttcccgaatccactggtgcccacgcaccagctgctcgaggaactcgaggccgaggtgttcgctggtggggctcgtgcgctcggggtgtccaacttctcgttggcggcctggcgcgccgccgagcgaacaggtcacgtcccgatcgtctcgaaccaggtccacctgtcactggtggtccgccgcagccttcgggagttggtcccgtgggcccaggccaacgaccggttggtcatcgcctactcgccgctcgagcagggactcctggcagggacctacacaacgacgcatcggccgaggggtgtgcgtcggctgcggcgcgccttctcgccgaccgggctgctccgggcgcgtccagtcctcgacgagttgcgacgcgtggggactcgctacggtgcctcgccggcacaggtggcgctcgcgtgggtgctgtcacacccgaacgtcgtggcgatcccgggcgcgtccagcgtctcccagctcgagcacaacgtcgaggccggggcgctgtcgctcacgaacgaagacgtcgtccgtctcgaggcctctgcgcaagcagcgtggcccgtcaggtgagtgcatcggtgcggcggcgaggaattgtgtggacgttgactgcctggtagaaacctgtatcggaaggagtggaacgaacggtgagtgactcgacctacgacgtcgtcatcctcggtgcaggtccagcgggctacgctgcggcgctctacgggggatcggctggcctcagcatcgccatcgtggaacaagatcgcgtgggcggtacgtgcttacagcgagggtgcgtgccggccaaggagtttctcgagacagcgaccgttcggcgcacgatcgaagcggcgggagcgttcggtatcggtgccacgtatacgggcctcgatttcgcgacggcgcaggcacgcaagcaggacgtcgtcgccaagctgaccggtgggctcacgggactcatgcgttctcgcggcaacaccatcgtcgaagggcgcggtgtctatcgtggcggcggggtcatcgaggtcggcggcgagcggctcgtcggcgaaacggtgatccttgcgccgggatcggttccaaggaccatcccgggcttcgacgtcgatggtgaggtcgtcctgacctcggacgaggtgctctcgctgaccaagctgcctgacagcgtggtcatcatcggcggaggcgtgatcggctgcgaattcgcctccatgatggccgatctcggcaccaaggtcacggtggtcgaggcactcccgcaggtcctgcccggtgtggacccggatctcgtcggtatactgctccggagctttcggcgtcgcggggttacggtgcggaccggagtcggcgtcagcggcctcgaccggaccggttcgggtgcggtggttcgactcgccgatgggacgcaggtcgaggccgagcaggtcgtggtggcggtcggacgtcgtcccaacaccgacggggtcatcgaccctgcgagtggtgtgggcctcgacgagcgagggtttatcaaggttgatgaccagtatcggacctccgaagcgggggtgtacgccatcggtgatgcgatcgcgacgccacagctggcccacgtcggctttgccgagggggttgcggtcgtcaagtccatcttgggcgagatctccccgtcggtcgagtacgacaaggtgccctggtgcatctatacccatccggagatcgccttcgcgggtctcacggaggagcaggcccgggcccaggggcgtgacgtgatcgtcaagaaggacccgcttggtggtaactcgcgcgcccgaatcctcggcgagaccgatgggatggtcaaggtggtagcggaccgagcgacccaccagcttctcggcgtccacatcgttggcccctgggcaacggagctcctgtcgcccggctacttggcggtcaactgggaggcctcggcggaggaggtcgctgcgttcttgcagccccacccgaccttgtccgaagcgttcggcgagactgtcctcgcactgactggaaggagtctgcacgttggctgatgtcacgcttcctcaacttggcgaaaccgtcaccgaggggacgatcacgaagtggctgatcaaggtgggtgacaccgtcgagatcgaccagccgatcttcgaggtctcgaccgacaaggtggattccgaggtcccttcgcccgtctccggggtcgtcaccgagatcctcgtccccgacggtgagaccgtggacgtggggacggtcctgtgccgcatcgaagccgcggcgtcggctgcgtcggcatcatcggggccctcgacgcctccagccgcacaggccgctccggcgccacagcccgcgtcggcgccacagcccgcgtcggcgccccagcccgctccggcgccacagcccgcgtcggcgccccagcccgctccggcgccacaggctgcaccagtgccccagcccgcaccagcgccccagcccgcgccggtcgcgatggcaacgagcaccagttcgcagccagccccgagcacgcctcctgctccatcagcgcccgtgtcgccgtcgccgagcacggtcgaggccaacggcgtcgccgccggcagcggtcccgaacgagacctcgatggcctcctgctctcgccggtcgttcgtcgtctcatcatcgacaacggcctcgacccgcgagacctccacgggaccggcgtcggcggacggatcacacgaggcgacgtcctgcgcgccctcgacgagcgggcccggtcggctgcgggatcggctccaccggccacgagcgagccggccccctcggtcgccaacgagccggccccctcggtcgcccgtgaggcagcgccgcagccgacggccgcgtcggcgcctgagctctggtcgccgagccaggaaccgacaccgagcaaccgtgcccagcaggtcgtccccgtgtcggccatggagccgagcgaacgtgattacgtcgtgccgttcacgaacattcgacgccgtaccgccgagcacatgatccgctccaaggccacctccgctcatacgctcatgtcgatcgaggtcgacttcgagggtgtcgagcaggtccggcgacgtgtgcgtgagtcgttcgctcgcgacgagggtttttcgctcacgtacctgccgttcgtggtgcgagcctccgtcgaggcgattcgcgcctaccccaacatcaacgcctcggtgctcggtgacgccctcgttgtgcatcgggacatcaacatcgcgatcgcggtggatctcaacctcgaggggttgatcgccccagtgatccatggggccgacgccatcagattgcgcggtatcgctcgcgcgatccacgacctcgctgcccgagcgcgcagccgcaagctgagcgccgacgacatcgccaatggcacgttcacgatcacgaacccgggtccgttcgggaccttcatgaccggggcgatcatcaaccagcctcaggttgcgatcctcgcgaccgacgggatcacccgtcggcccgtggtggtcacggatgcccatggagcggagtccattgcgatccactcggtggggctgctcacggtcaacttcgaccatcgggcgatcgacggcgcctatgcggcggcgttccttgcgaaggcaaagcaggtgatcgagcagacggcgtgggagcaggagctgtgagcgacaccctgcgcgtccggtggctcgggcgaaccgattacgacgacgccctcgagctccagcaccgcctgcacgagggaacggggtcgtggttgctgctcctcgagcatccgcacacctacacgatgggggtgcgcgcgaagcgcgagcacgtgctggtggaccctgccgatgtcggagcacggctcgtgtggaccgatcggggtggtgacgtcacctaccacggacccggtcagctcgttgcctaccccatcgtcgacgtgccggtcgagcccgactcgacgccgcgctacgtccatcgactcgagcaggtgctgatcgagaccttggccgagttccagctcgctgcgttcgcgttggacggctacccgggcgtgtgggtcgacgccgcggcaccgcgcaagatcgcggcgatcggcgtgaaactcacgcggggtcgttcactccacggcatcgcgctgaacgtcacgacggaccttgggatgttcggccatatcgtcccctgcggaatccccgacaagccggtcacgtcgatggccgccgagggcgtcagggtgagtgtggaggacgtcgcgcgggtctttgcccgacgctttgcagtgacgttcggactcgaagcccgaagtgccggtgtcgactggccggtcgcccagccggcgtcgtccgagtcggccacctcgccggtcgagcggcgcttgcaacgggccggcgtctcgctcggcgaagcggttccgttccatgcgcgcaagccggcctgggttcgaccacgtgtccgtcatgggagcgaggtcctcgaactcaagcgtctcgtcggccaactgtcgctcgtcaccgtctgcgaggaggcggggtgccccaacctctcggagtgctggaaggatgggacagcgaccttcatgatcaacggcgagcgttgtacgcgtgcgtgcacgttctgtctggtcgacacgagccatccgctgccgctcgaccccggcgagcccgatcgggtggctgctgcggtggccgccctcgacctcgagttcgcggtcgtcacggccgtcgctcgtgacgacctggccgacggcggtgccgaggcttttgcgcgaacgatccgggcgatcaaactggcgcgtcccaccacgcgagtcgaggtgctgatcccggacttcaagggctcggcggcggcgctcgacaccgtgctcgaggctggtcccgatgtgctcaatcacaacctcgagacggtgcttcgtctgcagcgggccgtgcggccaagtgcgcactatgcccgcagtctcgcggtgttgtcccgagcgcagcgagccggattcgtcacgaagtccggcctgatggtggggcttggcgagtcgttcgacgaactccgtgaggcgatgggggatctcgccgccgcaggggtctcgatcctgaccgtgggacagtacctccgtccgacgcagtggcacgcgccggtcgctcggtactggcatcccgaggagttcgacatgatccgggactacgccaccgaactcgggttccgcttcgtcgaagcctcgccgctcgcacgctcgtcgtaccacgccaagcgcggatcggacgccgcgcaggtccttgcggagcgcgcgtgagcctggtcgagcgctacccggaacgacgtgcggcgctcgtcggcgagctcgtccgcaacggcgtggatgcggcgatcgtgaccatcggaccggagatgccgtggctgatcggctacgaagcgatgccgctcgagcgcatcacggccctggtcgtgcgtgccgatggcacggcggtcctcgtggtgccgcgactcgaggagccgcgggtgcgtcatcgcgacgggatcgacctcgtcgcctggagcgacgggcaagatccgttcgagctcgtggcagctctgctcccaccgacggggcgcatcgcgatcggggagcgcgggcgcgcgggatggctcctcgagctgcagcgtctgcggcccggctgtcggttcgagccggctggtgccctgatcggaccgctgcggcggcgcaaggaccccgacgaggtcgcggcgttgcgagcagcggggacggcagccgaccacgtcgccacggcgctcctggcgggcgagatcgcgctggtcggaaggacggagcgtgaggtgtcgcgcgacatcgccgagcggctgatcgcggctgggcatgcacgtgccaacttctcgatcgtggcgtcggggccgaacggcgcatccccacaccacgagcccggcgcacggcgcatcgagatcggcgacgtcgtggtgtgcgacttcggcggcacgttcgaggtcgacggcgagccgggctactgctcggacaccaccaggacgtttgccgtcgggacggccccggatgggttcgcgtcggtctacgacgccgtgttaggcgcgcacgacgcagcgatcgccgcgatcgtgcccgggatcgtagctggtgaggtggatcgcatcgcgagagagacgctcgtggaggcgggatatgccgagtggttcgttcatcggctcggccacggcatcgggctcgaggaacacgaggacccgttcctcgctcctggggccacgacgacgctcgaggtcggtgacgccttctcgatcgagccgggggtgtatctccccgggaacttcggcgtgcgaatcgaggacatcgtcgtcctgacggaacatggggtcgagcggctgaatcgctcgagcacgcagcggacggtgctcgaggcgcgctgagtcggccgccacgtgcgtcgcggtggcccccgtcgagcaggtgtgcgctcgataggctggcagccatggcacaacgcagtctctcccggcgtgcaacggcgctgggcgtcgtcgtcgtggtcgcggtggtggcgggcggtgccggcgcggtcgttgccacgcgcctctttcccccgaccgtccacctcgatacgccggtgtcccagctcaagccggggccagcgctggccggcggcgtatcgattcctgccatcgtgtcgtcggtcttgccagaggtcgtctcgatcgatgccactggcgatctcatcggcgtgacgaacggcggcccgttcggcctcggtggcggtcagacgggggcggagttcaagtccgccgggaccgggatgatcgtctcgacgagcggcctcgtcctcaccaacaatcacgtcatcgcgggcgcgacctcggtcgccgtcacgctggacggaacgcacacggcgttgccggccaccatcgtgggcacgattccgtcgcacgacctcgcgctcttgcggatcgaccatccgccggcccacctccacaccgtgaccttcggtgactcggctgcactggtcccaggcgatgcggtgatcgcgatcggcaatgcgctcggcctgcaggcgggttcgccgacggtcacgagtgggatcgtctcggccctcggacgggtcgtgacggcgtcgatcccgaccaccggccagaccgagacgctcgacgacatgatccagaccgatgccgccatcaatccggggaactcaggaggtccgctcgtcgactcggctggggacgtggtgggcatgaacaccgcggctgcgggcacgacgtcggacggtacccaggcggagaacatcggctttgcgatcccgtcctcggagctcatcgcggagctcccggtcctcgagcatggcggcacgtcgggagcccctggcgccttcctcggcgtcgaggtcgaagatgactcctcggcgctcgcggctcagttcgggctcccggtctcgcagggggcggtcgtcgtgtccgtcctccctggcaccgctgcggcgcaggctggactgagcgccggcgacgtgatcgtcgccttcgatggacacaaggtgacttcggcggcagcgctcggcgcgatcgaggagacgttgcaccccggcgaccaggtatcgctctcgtactggacgtcgtcgtctgagcgaacggtcaccgtgacgctcgggactcgcccggcgagctgactcgtcgcacgctactcgacgccgacgtctttggcccgcaggtgcatcccttcctgccagcgagcgagcgtccagagggcgtcggagagtcggttcaagtacgcgccgacgtgcgagctgggcgccgatgcgacgaagcggaccgcgaggcgctccgcgcgccgacagacggttcgggcgacgtcgagcgctgccgcggtcggggttccaccgggaacgacgaagtctcgaatcggctcgaagcgttcactgacgtcgtcgatgagccgctcgagccgctcgaccatcgccttcgtcacgagggtttcacccgggacgagcttgcttcggtgctcgggcagcgtggcgacttcggccatgaggacccacaggtcgcgttccagatcgagacagatggtcgcgaggtcgacggctgcactggccctgacgaccccgagctgggcttgggtctcgtcgacggctccgttgagctccacttgcgggtgatccttcggcagtcgaccgccatagagcatgccggtcgtgccgccatcgccgcgacgcgtgtagatcggcgtccggcgtcgtgctgcaccctccacgatccacctccccggtcccggtagcctagttgtcgtgaggacctacgaggagctgctgcgtgagcgtgtcgtcgtgttcgacggcgcgatgggcaccaacctgcagctggccggcctcggcgccgacgactttgggggtcccgcgctcgagggttgcaacgagatcctcgtcgtgacgaggcccgaggcggtggccgcggtgcacgactcgttcctcgccgtcggtgtcgacgtcgtcgagaccgacacgttcggcgccttggcgccggtcctggccgagtacggtatcgccgagcgtgcctacgagctcaaccttcgagcggcccagctcgctcgagacgtcgcctctggctatgcgacgcccgatcatcctcgcttcgtggcgggctcgatggggccggggacgaagctgccctcgctcggccagatccccttcgaggacctgcgagacgcctacgaggtgcaggccgagggcctgatcgcgggaggtgtcgatctcctgctcgtggagacggtctacgacctgctctctgccaaggcggcggtgatcggcgcccgtcgagccatgcgccgactgggccgctcggtcccggtccaggtgcaggtgacgatcgagaccaccggtcggatgctgcctggcacggaggttggtgcggcactcgccgcgctggagcgtctcgacccggtcgcgatcggcatcaactgcgcgaccggtcccgaggagatgggcgagcaccttcggtatctctcggagcatcagcgcgtgccgatctcgtgcctgccgaacgcgggcatgccccacgtcgtcgacggtcacatgcactacgacctgaccccggacgccctggcggcggcgcaccgtcgcttcgtcgacgaactcggggtcgggatcgtcggtggctgctgtggcacgcggcccgagcacctgcgggccgtcgtcgaggccgtcggtgaggcggtcccgagagagcgccatccgacgccacgggcacaggtggcgtcgctctaccaggcggtcgagctgcgacaagacctcgccatcactgcggtgggtgagcgcaccaacgccaacggctctcgccgcttccgcgacgccatgctcgctcgcgactgggacacctgtgtgcgcatggcgcaggatcaggttcgcgacggcgctcacatgatcgacctctgcgtcgactacaccggcgaggacggcaccgtcgccatggaggagctctcgagccgcctcgcgaccgcgtccacgttgccgatcatgatcgactcgaccgaagcggcggtggtggagaccgcgctccggcacctcggcggcaggccgatcatcaactcggtcaacctcgaggagggtgaggggtccaatacccggttcgactccttcttgcgcctcgcgaaggactacggtgcggcggtggttgcgacctgcatcgacgaggaaggccaggcgcgtaccgcggcgcgcaaggtcgagatcgccaagcggatcgttgcactcgcggtcgaacgctacggcttggccaccgacgacatcatcatcgatccactcgtcctcccggtgacgaccgggatggaggagtcacgacgtgacgcgctcgaaaccatcgaggccctgcggcgcatcaccgccgagatgcccggcgtctcgacgctggtcgggttgtcgaacgtctccttcggtatcaatgcggctgctcgtgaagcgctcaacagcgtgttcctcgccgaatgccaggcagccggcctgagtatggccatcttgcacccctcgcggatccagccgctcgctcgcatccctgaggatgtgcgcgcgatctgcctcgacctcatctacgatcgccgcggccagggcgacccgcttgcccgcctgatcgagcgcttcgcggacgtccaggcggtcgcggtcacgggcgaggagctcgaggccctctccgtgccggaacggctgcaccggcgcatcgtcgacgccaatcgtcagggcctcgaggatgacctggccgccgcgctcggcgagggcatgagcgcgctcggcgtgatcaacgacgtgctgctcccggcgatggccgaggtcggcgacctgttcgggtcgggccagatgcagcttccgttcgtgctcgcctcggccgagacgatgaagcaggcggttgcatggctcgagccctacctcgatcgcgcatcggtgaacgatcgaggcaccgtcgtgctcgcgaccgtccaaggggacgtgcacgacatcggcaagaacctggtcgacatcattctcaccaacaacggctatcgcgtggtgaacctcggcatcaaggtcgccttgtcggagatgctggcggccgccgaagagcaccatgccgatgcgatcggcatgagcggactgctcgtcaagtcgaccctcgtgatgcgcgacaacctggtcgagatgaacgaacgaggaatggcccacctgccggtcatcctcggtggcgccgcgctgacccgtaccttcgtcgagcgggacctgcgccaggtgtacgacggtcgggtcttctacggcaaggacgcgttcgaggggctcgatgtgctcgagcggttggggcgcatccgtcgtggcgagctcgacgatcccgagttcgggcgttcgatccggcagtcgagcacgaggacgccgcggctcctgcgacgctcgacgagtgagcgcaccgagcgatcgccgacggtcgcgatggacaacccgatcttccgtccaccgttcctcggcacgagagtcgtgaaggggatcgcgctggacgacatcgcggcctacgtgaacgagaccgcgctgtttcgtcaccagtgggggtatcgacccgaaggcgatgaggacgacgcggccttcaagcagcgcttgcgcgcggagctgcgccgtcagctcgaccgtgcgctcgtggaccagagcctggtgccccaggtcgtctacggctacttcgtcgcggcttccgagggtaacgacctcgtggtgttcgcggacgaggcgcgtgagcacgaactcgctcgattccgtttccctcgccaagagcaggagccgtacctctgtatcgcggacttcttccggccgctcgcggggcccgagatcgactacgtcgccttccacgtggtgaccatgggtccgcggatcacggaggtcgccaagcgggcgttcgacgagaatcggtaccaggagtacctcctcctccacgggctcggagtcgagctcaccgaggcgctcgccgagtactggcatgccaggatccgagcggagtggggctttggcgacgaggacggcccgacgctcgcggggctctttcgtcagcagtaccgtgggagtcgctacagctggggctacccagcctgtccggacctcgaggacaaccggacggtcgtcgatctgctcgatgccggtcgtatcggggtcagcgtgtcggacaccttccaactggagcccgagcagaccacgaccgcgatcatcgttcaccatcctcaagcgaagtacttcgtcgcctagcgagcggatcgccgaggggcgcatgacgcctaacgtggggccaacgaacgttcacggtgacgagacgagagggagccccgcatgggtgtgacgacgaacgtggtgagtggtgtcgaggctcgcgggctgcgggttcgactcgacgcagcgagcgagcgtgaggacgcctggcgcaccgagatcgtcggtgacgaactctggtgggtcaggggctacgacctcgaccacggcgcgcggggagccggggccgatgtcgtggcgctcgccgccgaccgccacgcgaccgacgtcagcgtcgatctggggtcgcacgacgcgatcgttgccgaggagttcgccctcggcgcgctgctcgcgagctaccggttcgatcggtatcgacacgcctcggcgccggctcagacctggcccaccgaggtcgtcgtgatgggtgacgtcgcgcgtgcggcgctccagcgggcgaggagtcgagcggaggcggtggcgttggcacgcgatctcgtcaacgagccgccctcgaggatgacgccgacggtcttcgcacagctcgccgagcaggtggccgatgcggcgggtctcgaggtgcgcgtctgggaccgtgcggcctgcgaggctgagggccttggcgggctcctcggtgttgcacgagggtccgtcgaggagccgcgggtcgtgcacctcgtctatcggcccggggcgcccaccggtgagccggttgcgttggtcggcaagggtattaccttcgactcgggcggtctcagcctcaagagcgccgacggcatgatgtccatgaagacggacatggcgggcgcggccgcgattctcgcggccatgtccgtcctcggtgagctcggctgtacgcgtgaggtgcgtgcgtacctgatgctcacggagaacctcccttcgggcagcgcgcaaaagcccggtgacgtgctcgtcacgcgctcggggaccacgatcgaagtgctcaacaccgatgccgagggccgcttggtgctcgccgacggactggcgctcgcggtggaggacggcgcgagcgccatcgtcgatctggcgaccttgacgggcgcgtgcgtcgtcgccctcggcgacgaggtcgcgggcatcatgggttcggatccgaatctcatcggtgcgttgcgcgcagccggtgaccgcgaggacgaacccctctgggaactgccgctgccgtcacgctacgaggcacacatcaagagcagcgtcgccgacgtgaagaacatgggcaagcctggcaaggctggggccatcgcggccgcgttgctgctcaagcgcttcgtcgggtcggttccgtgggcacacctcgacatcgccggtccggcgcgcgccgatggcgaccgagggtgggtgcgcgagggtgcgaccggtttcggggtcctcaccttgacgcgctggctgtgcggaccgacgctcgacgacgctgctcgttgacggcccgggtcaccgcctcgaccgtatagccctggcgaacgaggcgtgccgagacctcggcctcgctcgcgcccaggccgagcagggtcgcggtgagctggcggagcctcgcttcgcgtcgctgcgcgttggcgacctccgaggcgctcgggtgccaggcgtcgacgaggcgcagtgatgcggggagcgcacgacgctgacgcgcgctcagatgcggcacgggggaacggatctcgagccggtttcgttcgacgacgcgagccagttcgaaggtcgcgaggcgctcgatggcgcgcacgatcgagcgcaggccggtgtcgtgcgaacggaggccgaggctcgcgccgaggtcgtcgagccgtacgagcgcgggtccgtgctcgctgagcgcgtcgagtcggcgcaggagagcgagggcggtcggcccgatgaggggcagccacagaagttcgacctcgtcggagcgggggctccagccgggctcatgcgtgtgccaccggtcgatggtgagtgctggatcgagctgtgccatgggccatcctccatgatgcgggctcgggcctccctagcccgagcgcggatcggaacgtcctgttccgccttgcgccgtgtggcgcgcactccagtatgtcagctatgacgtttcatgtcaagcgatgtccgtccctacgagccgtcgtactcgccgaagactcctcgtagggtgtcggcgacctcgccgagggtcgcaccagcgcggagtgcagctcgcatgggatagagcaggtttccggtgccgcgggcggtggcggccaggtcatcgagggtgccagcgagcgcctcggcgtcgcggtgacgacgccaccgttggacccgcgcggcttggtcgcgctggaaggccgggtcgatggggaagacctcgggggcttctggctctggttcgcggtagcggttcacgccgacgatgatggtccgaccctcgtcgatggcggtggcggcctcgtaggcggagcgttcgatctcctcctgcatccactgctgttcgatcgcggcgaccgcgccaccgcgcgcatcgatctcgtcgatgaggtggcgtgcactggcctcgaccgcatcggtcagggcctcgacgtagtacgagccggcgagcggatccaccgtgtcggtcgcgccgatctcgtgggcgagcacctgttgggtgcgcagtgccaacttggcggcgtgttcggtcggaaggccgagcgcctcgtcgaagccgttggtgtgcaggctctgggttcccccgagcacggcggagagtgcctggagggtgacccggacgatgttgacctctggctgctgggctgtgagggccgatcctgcggtttgcgtgtggaagcgcatcagccagctccgctcggacctcgcgccgaagcgttcgcgcatgatgtgagcccagatacgtcgagcggctcggaacttggcgatctcctcgaagaggttggtgtgagcgttccagaagaaggagagccgcggcgcgaaggtgtcgacgtcgaggccggcggcgagcgccgcgtcgacgtaggcgatcccgttggcgatggtgaacgcgatctcttgggccgccgacgcgcccgcctcgcggatgtggtagccggagatcgagatcgtgttccactggggcaggcgatcggcgcagtaggcgaaggtgtcggtgacgagccgcatcgatggtcgaggtgggaagatgtaggtgccgcgggcgacgtactccttcaagatgtcgttctggatggtgcctcggaggtgctccggtgcgaccccttgctcttcggcaacgagttcgtagagcagcaagagaactgaggcggtcgcgttgatggtcatcgaggtcgtcacccgctcgagggggatgtccgcgaagaggcggcgcatgtcgtcgatggtcgagatggcgacgccgacgcgccctacctcgccgtgcgcgcgcgggtgatcagcatcgtagcccatctgggtggggaggtcgaaggcgacggagagacccgtttggccagcctcgaggaggaacttgaagcgctcgttcgttgcctccgcggtgccgaagccggcatactggcgcatcgtccatgggcgatcgcggtacatccccgcgtggatgcctcgggtgaaggggaaggttcctgggtcgcccaggtcccggtcgtagtcgaggtcggcgaggtcctcgggtcgatagacgcgtcggatcgggatgtgtgaggaggtgagacgctcgtcgtcggccacgggctcatcctaccgacgtctggtcctcgcgccacggcgacccggcgtcctcgtcgagcgctcgagcgagcgcgtaggctggtgcgaggacagcgcgacggtgaaggccgcttggcgcgtgagcgttgggcgcgacgaacgatcgtgatgccacgggaggagcgttgcgtggagcagctgagtgccgagcagttcacggcggtgcccacgttgagcgcgtgggaggttcgtgggcacgttgccgtgtgtcggttcgcgaccggtgacttcgcgaccggcgtgaggttgctcgaggacgttgcccatatcgctgacgccctcggacaccatccggacgtcaccatccgcttcggctcggtcgaggtggcgaccaccacctacgagacgggcggtttgacggaccgcgacgtcgcacttgcgcgtgcgatcacggagcttgctcgacggttggggctcacgcctcgagacgcgtagcaaccagccaccccgagctggaggaggccgccggtgaggctaggggcgcacggggtggggcaggcatagatcgtcgtaggcggcgatggtgatctgtgcggggtcgaggctacaagccggacacgccggatcgcggtggaggcggtagctgtggaaggtctccgcgagggcgtcgaaggtgaggaggcggcctgcgagggtgtcaccaaggccgaggatgagcttgatcgcctccagggcctggattgaccccacgatgcccgggagcacgccgagcacgccggcctccgcgcacgacggcgcgagctcggccggtggtggctcggggatgaggcaccggtagcagggcccgtcgtagggcgaaaagacggtgacctgcccctcgaagcggaagatcgacccgtggacgaccgggatcttgagcttgagggaggcgtcgttgacgaggtagcgggtcgggaagttgtcggtgccgtcgacgacgacgtcgtagcccgacaggatctcgaggacgttgtcggcatcgaggcgcaccggatgcttgaccacgcggacgtccgggttcagctgtgcgatcgcggcttcggcggagtccaccttggccatgccgacgcgatcgagggtgtggagcacttggcgttggaggttcgaggcgtcgacgacgtccatgtcgacgatcccgatcgtgcccacacctgccgccgcaaggtagagggcagccggggaggacaggccgcccgcaccgaggagaaggacgcgcgcttcgagtaggcgcagctgaccagcttcggagacctccgggagcagcaagtggcgatggtagcggcttcgctgctcaggggtgagtgtccggggcgtcgaccaggcccgtccctcgtccttccagcgattgaagcctcccgccatggagaccacgcgctcgtagccgagatcgccgagcgtcctcgcggcgaacgccgagcgtacgccgcccgcgcagtagacgacgatcggcgtcgacttgtcggggagtttggactcgaccacgagctccaggttcccgcgagggatgaacaccgccccggcgatcgcgccttgctcgtattcgtcctgttcacgaacgtcgaggagtgcccaaccctcgcgttggaggcgagcagcctcgtccgtcgtgacctcgtgtaccgaggccttggtctgaaacagcagatcgcgaaagcctgccacccctacgcacctccggaccgtccgccctgtagcttacggagcatcggcacgaggcgctgcgcctggaggtcgagcggcacgacgcggtcgcgggggtcgaggcgccctcgcctcgacggtgagccgtgcactggctcgggaagggggtggccgagcgcgaccgtgatgacgatgcggctcgtctgagcgagtccggcgaggtcgcgcagcacctcctcgcctcgaaaggtgccgatgacggctgccccaatgtcgagcgcggtcgcggcgacgaggatcgcttccagtgtggcgccagcgtcgacccaccagtaggggatgggccatcgttccaggctccagagtccggcggcgcgcttgtcgggggcaccgtagcgttcggcgtaggccgcggggtcgacggtgacgaggagcagggccggtgcgcgttcgagtcctcgcatctcgggacgcgcggccagccaccccggcgtcgtgagtgctgcgaggatccgggcgcggctctccggttcgcgcgcgatcgcgatggtgacggcctgtgtgaagccggcggacggcgctcgcagcccggcgtcgacgatggccgcgagcgtcgcgtcgtcgatcggatcggcagtgagcgctcggcgcatccgtcgccgccgaatcgcagcgagcgcctccacggtgctactcgatcacgacgacgatgtcgcccgtgccgacggtgtcgccggggttgacgcgcacttcgcggacggtaccggcgcgctcggccaagatggcgttctccatcttcatcgcctcgagcacgatgacgacctcaccagcgtcgacctgttgccctggggagaccgggaccttcaccacggtgccctgcatcgggacgctcacctcgccggagcccgtctgtgctgctcgggcaccggctctggccgatgagcttcgctgaggtcggctcggtgcattcggcgtgcgcggagcaggcgcactcggtgctgcggcgtcgagatagagcgtgacggcgacacgcttgccgttcacctcggcgatgaccggggtgggcacgagctcgtgagcgtcctgggatgcggtcgcgacgggggccacgccgcccaggtcgaggcgttcttccacccaacgggtcgagtgggttcctgcgcgaaagtcggggtggtccaagatggcgacgtcggccggtgtggtcgtggcgacgccctcgatgcggagctctccgagcgctcggatcgcacgagcgatggcgtggtctcgatcggcggcgtggacgatgagcttggcgaccaggttgtcgtagtactgcgagaccgtgtcgccggtgtcgtagccagcgtccacgcgcacccctggtccgtcgggccggtcgaagcgggtgatggtgccaggggtcggcatgaagcggccaccggcggggtcctcggcgttgatccgcacctcgatggcgtgtccgcgccgcacgacgtcgtgctgggagaagccgaggggctcgccggcggcgacccgaagctggagctcgacgaggtcgagacccgtcacgagttcggtgatcggatgttcgacctgcaggcgcgtgttcatctcgaggaagtagaacgcgccgtcttggtagaggaactcgacggtaccggcgttgcgatacccgcaggcgcgcgccacggcgcacgcagcctcgcccatcgcgcgccgggtctcgtcggggaagtgcggtgcaggtgtctcctcgatcagcttctggtggcgtcgttgcgcggagcagtcgcgttcgctcagccacaggaccgagccgtggtcgtccgcgatgacctgcatctcgatatggcgaggccaggcgaggtagcgctcgaggtagcactcgtcacgtccgaacgcgctgcgtgcctcgcgccgtgcggaggcgagggcctcggccgcctcgtcggggcgggtgacgacgcgcatgcctcgcccaccgccgccataggcagccttgatcgcgacgggccagccatgctcgtcgccgaaggccacgacctcttcgggatcgtccaccgggtgggtgaggccggggacgccggcgacgccagcggcttcggcggctcgtcgggacgagatcttgtctcccatgacctcgatcgcgtcggggggtgggccgacgaacgtgacaccggcctgggtgatcgctcgggcgaagtcggcgttctcggagaagaagccatagccggggtggacggcttcggcgccggagcgctcgatgatctcgaggagcttggtcgtattgaggtagctctcttggctggtgagcccgccgagcgcccaggcctcgtcggccatgcgcacgtggagtgcatcgcgatcggcgtcggagtacaccgcgatggttcgcagtccgagctccttggcggtgcggatcacccgaaccgcgatttcacctcggttcgcgaccagcagcgatgaaaacacgcgccctccttttgctcgccccgcgctcagggctccgccactcggcgactctagggtggagtccgtggcaggacgtcgagcgccctggcggctgatcctatcggacgaggtcgactccaccaatcgcgtcctcgcggctcgcgcccggtgggccggcgcgcacctggtggtggtcgccgatcaccagcgcagtggtcgtgggcgccgtggtcggaccttcgtcgacgtgcccgggggctccctgctcgtctcgtcgctccatcgctacgaggcaccggcgcgcccgatgctcctcggagcgtccgtcggtggcgctgcggccagcacgctgcgccgcctcggcgtcgcccagggagcgtggctgtggccgaacgacgtggtggtgggcgaggccaaggttggcggggccctgatcgaggcgtcctggcagggcggttcgctcgagttcgtcgtcgggttcggcctgaacctcgccggttgtcccgaggtgccaggtcgccagctcgccgacctcggctcgctcgctggccggtcgatcacacgcgacgaggccctcggggtctggctcgaggagctcgcgtcctggctcgagcgctggtctcggggcgatgacgtgctgggcggtgcgcgtgcgttgctcgcggggatcggcgaggaggtcgttgtcgaacgagctgcgggtgagcttcgcggacgtgtcgtcggattgggtccctcgggtgccttggtgctccgtcacgacggtgctacgttcgaggtgagcgaggcagacctcgtccgtctcgtccgctcgtccacgggagccactcgagccgacgaccaaggaggcacgcacgcatgacggtggagttctcgccggaacacgagcagctgcggtccgtggttgcggacttcgtcgcgggagaggtcgcgccgaacgctgccgcgtgggatcgtgaggagcgattcccactcgaggcggtgcgcaccatgggcaagctcggcttgttcgggatcccgttcccgtcgcgctacggcggcggggatggggacttcacctccttgtgcatcgcgatcgaggaggtcgccaaggcggactcgtcgctcgcgatcaccctctcggccggtgtcgggctcggtgcgagtccgatctaccgcttcggcaccgacgcgcaacgcgaacgctggctcccagccctcgtccggggcgaagccctcggtgccttcggcctgaccgagccggaggccggatcggacgccggcgcgacgcgaacacgcgccgagcgcgtcgctgaccgatggcgtctgcgcggcgagaaggcctacatcacgaactcgggcacgcccatcacctccgtcgtcaccgtcacggcgcgaacggacgaagggatcagcgcgttcatcgtgccggccgggaccgctggtctcacggtgctgccgtcctatcgcaaactcgggtggcgcgcgtccgatacccacggcatcgtgctcgaggacgccgaggtcggcgacgacgcgctgctcggagcgccaggggctggctttcggcagttcctcgcgaccctcgacgagggacgtgtcgccatcgcagcgctcgcgctcggtctccaggaggcgtgcctgcgcgagggtctcgagtgggcgaaggcgcgcaacgccttcggcggtccgatcggtcggtttcaggcgatcgccttcaagctcgcagacctcgaggtcgcggtggaggcctctcgtcatctggtctaccgtgcggcctggctgcgtgatcagggacgcccgtttgcgcgcgaggcggcgatcgcgaagctctatgcgaccgaggcggcggtgagcgccgccagggaggcgacccagatcctcggtggtgccggcttcatcgaggacaccccggtcgcgcgctactaccgcgacgcgaagatcctcgagatcggtgaaggcacctcggagatccagcgcttggtgatcgcgcgctcgctcgggttgagcccgagctagcatgagcgccgcatggatcggctcgtcctatgaaggcgctcgtcctcgctggcggttcggggacgcggctgcgtcccatcacccataccgcggccaagcaactggtcccgatcgcgaatcggcccatcctcttctgggcgctcgactcgatcgccgaggcgggcatccgtgaggtggggatgatcgtcggccacacgaaggacgaggtccgcgctgcggtcggcgatggctcggccttcgggctctcggtcacttacctcgagcaaccccagccgctcggactcgcgcacgcggtcagcgtcgcgcgtgactggctcggcgacgacgacttttgcatgtacctcggcgacaacgtcttgctcggtggcgtcgcgccattcgtcgagcggttcggtcgacccggccgtagcgaggacgcactcgtgctgctcgccaaggtcgacgacccgacgcggttcggcgtcgcggagttcgacaccgaggggcgcctcgtccgcctcgtcgagaagccgtcggtccccccgagcgacctcgcgctcgtgggcgtgtacttcttcagtccagcggtccacgacgccatcagccagattcgcccgtccgctcgtggtgagttggagatcaccgacgccatcgacgcgctcatcacgagcggacgcatcgtggacgcgctcgcggtcgatggtttctggaaggacctcggcgaccccgaggcgctgctggccggcaatcgcttcatgctgctcgggatcgagggttcggtcgaggggacggtcgtggactcctcggtggacggcccggtcgtggtcgagcctggtgccgtcgtggagcgcacggtggtgcgcggtcccgccaccatcggtcgcggggcccgcatcgtcgatgcgtacgtcgggccgttctctgcgatcggtcccgactgcgagctgcgggccaccgagatccagaactcgatcgttctcgccggcgccaggatcgatggtgtcggcccgttggacggctgcatcatcggacggagcgctgtcgtcgagcgccgaggccacctcccacgtgcgaccagcgtcgtggtcggcgaccactctcggctcgagctcgcctgagccgagaggcggccaaggtcggtcgctaggctgccgggcgcccgtcgagggtgcatcgcaggtgaggaggagtggcatgcggcttctggtgaccggtggagcgggattcatcggctcgaactatgtccacgagcgagtggcccgccacccagacgaccggatcgtcgtgctcgatgccttcacctatgccggctgtcgtgagagcctccgcgacgtcgatgaccacattcgcatcgtcgaaggcgacatcggcgacaccgagctcgtgagctcgctgctcgacgaggagcgcatcgaggtgatcgtcaacttcgccgccgagtcgcacaactcgctcgcgatcatcgacccggagcgcttcttccggaccaacgtgctcggcaccgtcggactgctcgaggccgcgcgtcggcacgacggcttggtgcgattccatcacgtctcgacgtgcgaggtctacggcgacctggagctcgacgaggagcgagccttcaccgaagacgacccctaccggccccgcaccccctacaacgcgtccaaggccggcgccgatcacgccgtgcgggcctaccacctgacctacggcgtgccgatcacgatcacgaactgcgccaacaactacgggccctaccagttccccgagaaggtgatccctttgttcgtgacgcgcgcgctgcgtgatgctcccctgccgatgtacgcatcgaaggagaatcgccgggagtggatccacgtgcgcgatcacgcggccgcgatcgaccgggtgctggaggccggcaccgtcggcgagacctaccacgtgggcaccggcgtcgagcgctcgatcgagcagatcgccacttcggtcctcgacctgctcggcaagccacggagcctcatcgaggtggtgcccgatcggccatcacacgaccggcgctacgtgctggactcgacgaagctgcgcaccagcctcggttgggagccgacggtcgccttcgacgaaggccttgcgtcgaccgttgcgtggtacgtcgagcatcccgagtggtgggagcccctgcttggccgtgctcctgtcgtcgaaggcgaggcctggcgccggtgagcgatcgcatcgtggtcctcggtgcgggcggtcagctcggtcggcggttggtgcgcgcgttcgagcgcaccagcgccgcggaggtcgtcggtctcgatcgtcgagcactcgacgtcaccgagcgtgtggcggtgcacggtgccgtcgacgcactccggccacgctggatcgtgaacgccgccgcgatgacggccgtcgacgcctgtgagcgcgaggtagagcgggcggttcggctcaacgccctcgccgtgcgttggctcgtcgaggccgccgagcgcgccggtgcgcgcgtatgtcaggtgtcgaccgactacgtcttcgacggtaccgccacgcgtccttatacggaggccgaccagccgaaccccatgagtgtctacggcctcacgaaactccagggggagcgcgagttgcgtcccgggatcgacagttgtgtgcggacctcctggctgatgagtgccgacgatcgttgcatgctcgggaccatcgaccgccttcgccgaggacctgggcccttgcgcttcgtcgaggaccaggtcggttctccgagcttcgcggacgacgtcgcgctcggcatcgtggagctcgtgcgtcgtgaggtgaccggcgtcatccacgtgacgaacgacggtcaggcgagctggtacgacgtcgcgagggaggcacttcgggcctttggcgacgatccacaccgagtcgagccgatccccacgacgcaactcgccggcagcttcgtcgctccgcgacctgccttctcggtgctcgccggggtcgtgcgcgccgcggtcgggctcgagcccctgcgaccgtggcaggaggcgctcggagctgcggtcagcgagcgtgctcgtggatgagctctgggcggtcgtggtcgactacgggggccacgccgacgactcgctcctcgatgcgctgatcgatgccggtgcggcacgcgtggtcgtcgtcgacaatgcactcgctgtggcgagctcgcgcaccgagccacggggccagggggtcgtcgagtttcggtcctacggcgccaacctgggcttcgggggtgccgtcaatcgggtccttgcccgtcgaggagccaggtggctgctcatcgccaacccggacatcgagatcgctccgtccgcgctgcggacactcctcgcgaccggcgagcgctggtcgcgagctggcatcgtcgcgcctcgactcgaagaccacgcaggccaaccccaggcgagcgtccgagcgttcccgagcctcgcgctcgcggcgctgcacggagcactcggcgtcgtctggccgtcgaatccggcgtcacggcgctatcggcgcgaagtgcccgatccgccgaatgcatacctggcgccgtgggtctcgggcgccctgatgctcgcgcggtgggaggcactgtcggcgatcggtgggttcgacgcgagctacttcttgtacctcgaggacgtcgatctcgcctggcggctcacgcgggccggttgggaggtcgtcgtcgatccgaccgtgcgtgtccgccacgtcgggggtgccaccacacgctcccgacgcgtggtggcggccctctggcacgcacgttccctggttcgctacgggctcgcgcaggaggacacggccactggcgcggcgttggtgctcttcggcgtgcttgctcgttgggcagtggtcgtcgtggcgtcgcgacgcagctcagcggacggatgagtcgctaacctagtgccggtatgcccaacccccaggaaggagctcggcgagtccagcgcgccaaggcggctggtcgaggggctcacgtaccgcgtgagattcccgtcgggttctacgctgccctcacgatcgtcgcggtgctcggcatcgctgccatcggctactcccgctacgaggtcaaccatccggtctccgcgacgtcgtcgcagtcgccgcctcgcgtcggccagacgtggtacaccgcactcgggatcgaggtctgcgggcacttcgagccggtgctcgccaagggttcaggtgctgcgagcggcatgacggccctcggcaacggggtcgtcaaggtcgcgccgaagacaccggccgagaccggcgctgcggcgacgctcgtgcacttcctcgacgcggcgggcgtgcgcgtctcgacgtcgagcgtcgtcctgcctgggcacgcgagcatcgacgtcgcgagcgtgtgcggccagcggccggtcgaggtgcgtacggcgacgtgggcatccctgcttgcgactcggccgacgatccatgcggggacaaccggtgtgcgcatgctgagcggcgaggtcgtggccgtcgcggtggtgaccaagggcgcgacgatcgcccagcctcccacggccgccaacctcgcgaacgtctaagggtcacccgaggacacgcaagaaagtacggagggcgcgtgcaagcgatcatccttgtcggcggggaggggacccggctgcggccgctcacgctgcatcaacccaagcagatgctgcggttgctgggctttcccatgctcgagcgcgtcgtcgagcgtctcgccgcgatcggcgtcgatgaggtcgtgctgtcgctcggataccagcccgatgcgttcatcgcgcgctatcccgaccaccgcatcggcacggtcaaggtgcgctacgcggtcgagccggagccgctcgacacggcgggcgcgattcgcttcgccgtggacaagggcaacgtccacggcacgttcttggtcgtcaacggcgatgtgctcaccgacctcgacgtcgcccagctcgtcgacttccatctcgatcgaggcgcactcgcaacgatcggcctcgtggaggtcgatgatcccagccgcttcggtgtggtcgtcaccgacgaccggggccgagcggtgcgcttcgtggagaagcccccgagggatcaggcgccctcgcacgcgatcaacgctggcgtctacgtcatggagccggcagccatcgagcgcatcgccgttggcgagcgcgtctccgtggagcggagcctgttcccgcagctcgcgagcgaggggacgctgtgggggctcgcgcagcggtgctactgggttgatgcgggcacaccggcgagctacctgcgtgcggcgctcgacatcgcaacggggcggcgcgcggcgagagtgcgagagggcgtgcggttcccggtcgagagtcgaccccccggtggcgagacgtgttacctcggagagggatcgcaggtcgcgagcgacgccgtcgtggacgccgcgatcatcgaggacgatgtcgtcgtcggcgacggggccgtcgtgcgatcgtccatcgtcctcgagggcgcgcgactcgcacccggggttcgggtcgagcactcgatcgtcggagccgagacggacgtcccggaggccgtcgagctggtcgatctcgcggtggtcgcgccgtccacggagctcgcccccggccagcgactcgctggcacccgatgagcgaggcgccgccggtactcgtcacgggcggggcgggctttctcgggtcctgggtggtcgagcgcttgttggcacgcgggctgcgcgtggacgtcgtcgatgacctgtcgacggggtcgctcgagaatctgcggcgagcgcgcgaccgacacggcgcgcgactcacggtcgtcgtcgaggacgtgacgagtgccgccatcgggtcgctggcggagcggcggggctggcgcagcatcgtgcacttggctgcccgagcgagcctccgcgcatccacgctcgatcccgtgcgcgacgccgaggtcaacgtcctcggtaccgtgcgcgtgctggaggctgcgaagcgggctcgctcgcgcaaggtggtctttgccgcctcggcggcgatctacggcgaccagcgggcgttgccgattcgcgaggaggcgccgcttgcgccgatgtcgttctacggcgcgggcaaggtggccggactcgagtaccttcgagcggctcgacacgtccacgggacggcgtccacgagcctcgtcttcgccaatctctatggtccgcgccagcgcgctgagctcggcgcggtggttgcgcggttcgtcgacgcactgctcgcggggcacgcgcctgtcgtcgtcggtgacggcacgcagacacgggacttcgtgtgggtgggggacgcggccgatgcggtggtcgccgcgctcgatcgggccgatggggagatgatcaacgtcgccaccggcctcgagacctcgatcgcgggcctcgcacgactgctcgtcgaggtcgccgggatcgacgggctccacccggtgcaccagggacgccagtcggtgggggaggtgcaccgcaacgcgctcgacccctcccgcgcggcgcacctgctcggctggcgaccatcggtccgactcgccgatggcctcgcgcgcacctgggcggctgcgctggaggcgcggcgaatccgcgaggcggcgccgaggtcctgagcagcgctgatcgagctcagtggtcctcgcggcgggcgccgagctctcgatctgccccttcgcagcgcggtcttgacctcgtctggctgctcagaagcccacggctcgccgcggtgctcttcgaggtcggcgcgcccggcgtgggcgtcagcgaaagaggtctcgagcgctgtcgcgcacgatggcgcgggcggacgactcggcgagccaggcggggtcgatgcctcgcacgacgctgaagggcgtgccggcagccttcgtcgcgacgagattcgccgccgctgcgatctcgtcggcgatgcagacctcggtcacgcgcaaggttgcgccggtccagtcggcggtgccacgcaggtcgaggattgcccgaacccccgccaccccgatggcgacgtcggtgaccccctcgcgccacgctcgaccgaaggtgtcggtgacgatgacaccgacgtggaggttccatgcaaagcgcaggcgatcgcgaatccgacgcgccgagcgatccggatcctccgggagcagcacgagcgcatgtgcgggggcgttcgaacggtcgataccggcgttcgcgcagacgaagccgtggtgggtctccacgatgcgcgtggtgccacgcacgcgcagcaccctgcgcgtctcggcagcgagtgcggcctcgaacgcctcgtcgagatgctcggggtcgctctggatcacgcgaccttcggccttggagacggccttttgcgacacgcagacgacgtcgccgtctgcgagctcgccggtcgcgcccaggagatcgccaaggttgtccccggcgcagatctcgcgatcgatggggatcgaccagatcgtgagccgtctcatcggtcagaacccaccacttggacgagccgatccacgaggtcggcgcttcggtcggggtcggcgatcatcgtgtccatcaccacggcccgcacgccatggcgttcgacgtcgccagccagtgcgccatcgcggtggtcgacgacgagggtgccggcgtacggtgcgtagagctgggccacgctcgttgcgctcggttcgaggccgaagtcggccatgatggaggctgcagggcccttgatggcctggcctcccacgatcgggctgatcgcgaccgttcgatcccgtgcgtcgcgcacgaggtcgccgaggtcgccgagttcgaggatcggaaagaccgagaggaacgggttcgagggcgcgatgatcacgagatcggcctcggcgatcgcggtccgtgcatcgggatggggacgcgcggttgcgatgccgtcgtagcggatgcgttcgacgtggggttggtgtcgcatggccacgaagtactcctggaatcccacctcggcgaccccgtcgtcggtccgtaccgtgagcatcgtcgccacctcgtcgtcgctcatgggtacgaggtcgatgtcgatccccagtcggcgcacgacgtcgcgggtgatggatcggaggccctcgcctcgacggagccggtcggttcggtagaggtggaggccgatgtcgcggtcgccgagcgtgaaccacgtcggtcccccgagccgtcgcagcatggtgagcgccgagaaggtctcgggagcgatcccccagccggtgtgggggttcacgaggccgctcagtgtgtaggtgatcgtgtcgaggtcggggcagacgcgcacgccggcgatccatgtgtcgtcaccggtgttgacgaccgcggtggtcgcgggagcgagcttgcgtcgggtgacgccagcgaggaggcgagccgcgccgaccccgcccgagaggacacagatgcgcgggtttggagtcacggccacgaggctaccggtcgaggtgtgacccgatcggcccagagcctcctcggtagactgcgcccgtgctgcgcgtgagcctcgacgtcttgcccctggtgggcgcgaggacgggcgtcggagagttcgtctggcacctcgcgaacgcgcttctcgaggccggcgtcgacgtctcgggctggggtgtgacgtggcgaggccgcgaccggctccgagcggccgtgcccgccgagctccgtgtgcacgacgctcgtctgcctgctcgtccgctctgggcggcgtgggcacggtggcgatggccgtcgatcgatcgcgtgttcgccgacgtcgacgtcgtccacgcgaccaacttcacgctgccgccgctgcgtgagcgcccgagcgtcgtgacggtccatgacctcaccgtcgtgcaccatccgaactggtgtgatcgcgcgacgctcgtctatcccaagctggtcgcggctgcagtgcgcgagggctcgttcgtccacaccccatcggaggcggtcgctcgcgaagtcagggcgtggttgggtctcgacgccgatcgggtggtcgcggtgccccatggcgcccccggggcgccggttgccccgcccgcggcgccagcgaggatcgcgcggctcgccgggcgccgctacgtcctcgcgctcggaaccctcgagccccgcaaaggtatcgacgtgctcatcgaggcgttcgcgcacgtcgccgagcacgagcgcgacctcgagctcgtgctggctggacagtgggggtggggggtcgacgccatcacctcggcgctggtggccagtccggtgcgcgcacggatccgggtgctcggctacgtcgatcccatcgagcgagcctggctgctcaccaacgccgccatgctcgcctacccgagtcgctacgaggggttcggactgccgcccctcgaagcgatggcggccggcgtcccggtcgtcgccagcgacgtgcccgcggtacgcgaggtggtcggctcggcggcggtgctcgctcccgtcggtgatgcggcggcgctcgcagcgtcgatcggccgcgcgctcgtcgacgcggaccgtctgcgcgcactcggcccgagccgagcggcgcagttcacctgggagcgcacggcgcgcgccatgatcgagctctacgagcgggtcgcggcgacgtgagggtcgacatcgtcgtcgagcagctcgcccgtccggcccccggggggatcggtgtgtgggttcgcgaagtcaccccacggctcgcccgacgtcacgccgtgcgtctggtcgcgtcgcgctcggcgcgcctcgacggtgtagtcgagggggccacgacggttcgacggatgccgttgcccgagccgatcgcacagcgtgcgtgggatgcggggctctggggggcagatccgtccgccgatgtggggctctggctgtcgttcggagggccgccgatcgcgcgacgaccgccctcggtggtggtggtccacgacgtgatcttcctcgagcatccagagctctacacgaggcgaggggctcgctggcacgtggcccaactcgaggcggcgctcgcccgtgcgacgcggttggtcgcggtcgatcccaccgtggccgatcggctggtcgcgctcggggcacgagatcgggtccgcgtcgtcgctcccggggccgaccaccttcctccggccgatgcagagggcgcgcgggccgtgctggcgcgagccggggtcgagcgcccctacctgctcgtggtcggtacgctcgagccgaggaagaacctgggtcgcctcgtcgaggcgtaccaggcctatcgcgcgcgatcgttcgaccccgtcgacctcgtcgtcgtcggcccggctggctggggcgacgacgctcggcgcggtcccggggtgcacgtgctcggcacggtggcggcgccgatcctggcgggtctgctcgtgcaggcgagagcgctggcctacgtctcgctggtggaggggttcggcctcccggtcgtcgaggcactgcacgccgcggtgcccgtggtggtgtcgacgaccgtgccggccgcgcgtttcggcggcgttggcgtggatccctacgacgtccggtcgatcacggatggtctcgccgcggtgctcgacgacgaacgggcgcgctcgcggctcgtgagcgagggcttgctcgccgtcgagcagctcaggtgggaccgtacggccgacgcgctcgccgacgtgctcgaggaggtcgccgatggctgagatcgtcatcgatgcaaccagcatccctgcggaactgacgggcgcgggtcgctacgcggtcgggctgtgccgtgcgctcgccgcgctcgaggggcgtccggacatcgaggtcttcacgaccggtgcggcgcgaccccacttcgtcagcgacgcccccggctgggcggtgtcgacggcagccccgcgccacagggtggcgcgcctcgccgcccaggaactgctcgtcggccggcgtgcacgccgccacggagcccgcgtcatccacgggctgcactaccagctcccgagggcacgtggggtcggcctcgtcgtcaccgtgcacgatctcacgctcatcgagcatccggagtggcacgatcgcgcgaaggtcctctactttcgcggcgccattcgctcggcactgcgacgtgcgcacgccatcatcgtgccctcggaagccactcgcgagggtcttcgagcacggttcgacccgcgcgttccggtccacgtggtccaccacggcgtcgagggcgttcctcgactcgaccatcgccttgcccgccccggtcgacgcagcctcctcgtcctcggaaccctcgagccgcgcaagaacttggtgcgcatcctcagggctttcgatgcgatcgccgaggaggagcccgacgtcatccttcgcttcgtcggcaagcgaggctggggcctcggcgagttcgacgcgacgctcgctggccttcgccatcgtcgtcgcgtcgaggtgctcggcttcgtctcggacgaggcgctcgcaggctacctctcggaggcggctgcgctcgtgtacccatcgctcgaggagggcttcggtctgcccgtgctcgaggcactcgccgcggggcttgcggtcgtgacgtcgaaggactcggtcatggaggaggtggcgggtgggttcgccaccctggtcgaccccaccgatgtcggctccatcgcccacggcatgcgccaggcgctcgacgaggcacgtccgacggaacggatcgaggcgcagatcgcctgggctcggagcttcacctgggagcgcgcggccgagacgaccctcgcggtctatcgggaggtcgccgggctctagcctcctcacgcatgcgcgcgctcgtcaccgggtcacggggattcgtcgggacgtggctgcgggcacacctcggggccgccggcgacgaggtcgtcgagctgccggccgatctcgacgtcacggatcgagccgcgatcggtgcgtggatgcgaacccacggcgccgcgatcgaagcctgctatcacctcgcggcgcaggcgagcgtcgccaggtccttcgaggatccaggccacacctggctcaccaacgcgctcggcacgcagttcctggtcgaggccctgtccgaggcggcgccggccgcgacgctgctcgtcgtgtcctcgtccgaggtctacggtgcaccggcgcccgatgagctcccggtcgacgaggacgcgccactgcggccgacctcaccgtatgccgcgtccaaggtcggtgccgaggccgcggggctggagggagcctggggccgtgggcttcgggtcgtgatcgctcgaccgttcaaccacatcgggcccggtcagtccgaggcgttcgtgatcccgagtcttgtgggtcgggtcgtcgaggcgcaccgcaacggagagcgcgtgatccgtgtcggcaacctcgcggctcgtcgggacttttccgacgtgcgcgacgtggtcgcggcctatcgagccttggtcgtcgatgggcacgatcgcggcgtctacaacgtctgttcgggccaggcgtactcgatccgggaggtgctcgaactcatcgtgcgagcagccgatgcgtcactcgaggtggtggtcgatcccgcactgctccggcccgtggacgtgcccgtgatcgtggggaatccggcgcgcctcgtcgcacacactggggtgcgctttcaccactcgctcgaggcgacgatcgaagagctggtcacgagcgcacttcgcggaccaacggcgacgggagggttcgtcgatcgctagcgtggaggcctcatgtctaccgctccacgggtcgcggtcgtcgtcacggcgttccgtcctggtcgctacgtcgacgagtgtctcgcagcccttgcgcatcagagctacccagatctcgacatcacggtggtcgacggcgccggtgacgatcgtgaattgcgcgacgccgtggccatggcggcacccagggcgcgcatcgtcgatggaggaagctgtggggggtacggagcctgcgcgaacgcgggggcgcgggtgcaccccgacacaccgttcctcgtcttcgtccatgacgacgccgtgctcgcgcacaacgccatcgcgtccatggtcgaggtggcctatgccgccaacgccggcatcgtgacgccgaagctggtcgccttcgacgatccacgcagtctggtgacggtcgggtgggatctcgacccgttcttcaacccgaccgctcgggtggaggcgggcgagctcgaccagggtcagctcgacgaagtcgtggacgtggacgccgcaccgggtgctgcaatgttggttcgtcgtgacctcttcgacgccctcggtggcttcgacgaggtcttcggcctcatcggggaagacgtcgacctgagcgtgcgcgctcgactcgctggtgctcgcgtcgtcaccgctccgcacgcccgcgtccgacatcgaggggtgcgcatggagcggctgcgacgcgcgcgccgacgccgccaggtcggcgcccaggtcctcgaggagcgcgtcggtctgcaagatgccgagcgggtctggcgcaggcgccgcgcctcgcgcatcatgatgtcgagcctgtacgacggcccgatccgcttggtgctgctcctcctgtttgccacggagcgcatcggcgagctggtctggagggccctcgcgggttcgccgtcggcgggtgtcgcgggactgcgggcgctcgtgctgtcgcgcgacgaccgcgtggcgctccggcgtcgtcgtcatggcatcggcgagcgcgctcggtcgcatcgcgtcgtcgcgacgcgcacctggacaccgggggagcgtctcgtggccgtcggggcccaagcaggtactctctcacctgggcccacggatgcgccccccaagcggctcgcacggtgggtgccgcgctcgggctcggctcgctggttgctcctcgtcgcgatggtgattggcctcgtctcagcgcgaggtgcgctgacggcctcctcgcccggggggagcctcctgggtggagtgagcggcctcgcgttgctcgatgcctgggtccacgctcgggccgttccggcggtcctcggggccggcgtggcgccggtggggaccgcgttcatcgggctcgtgtcgctggtgttcggcggtgacgtcggactcaccgtgcgattggcggtactcgtcggcgcactcgtggcgcccgtcgcggtggctcggctcgctcggcgcgagttcgacgacgtgcgctccagtgcgctcgcgctcgtgtggtcgctcggtccggccttggcactcggcatcgccaggtcctctctgtcgctcgtcgctgcgtcggcgctcgcaccggtgctcgtcggcgccacgctcgctgccacccaaggacagcgtctcagtccgcgtcgcgccaagcgtgcccagcggcggctcgggctggttgcggccgtcgcgctggcgttcgcgccagagctcgtcgcggtgtggctggtggtcatcgctgccgaggcgctgtggtgggcccgtgcggcagacgcctaccgactccggcgtctcgggcgcgcgctcggcatcgcgggcctcatggcgatcggcatcaacctgccctggctcgcggccctcgtcctgtggcatcctggggtcgctgtcgtggcccacggcgtgccgggagcgcgagtgcagtcgctcggggcgcacctgttcggcggaggctacctcgctggcccagcaccgtggctgtacgtggcgctcggtgcgatcgccctcgctgcgggcgtcgagcgcagcgaacgagccagactcgcggtggctcgggccgtcacgggtcttgccctcagtggcgtcggggcgctggcgatgctcggtggccttggctcgacgccgatccagccggcctacttcgacgtgctcggtggcctcttgatcgtgctggcggtgccgactggtgtcagcgcggcccaggcgtggctgcgccgcagacgcctcggactctggcatctcgtgggggtggttgcggcgctcctcgtcgccatcctcggccttggttcggcgctgtcggcgctcatcgcgccggcggagccgatcgcgctgccgaccgccaacctcgcgctcgctggcgggttcttcgcccgtccggtgccgacgttgtggatcgaggtcgggcccggcggacctgttggtggcgcagcggtcgccgccaacgtgaccgttgcggtcaccacgggtgcggagccgagcttcctcggccagttcggtccgccggtgacggaggggtatcggcgcatcgtgccctcgattctcgatgcgctctctggtcacacggtgcaactcggcgcggtcctgcgaaggctcggccttggtgaggtcgtggtgctggacgcatcgcagtctccgctcgccagtgcagtcacgctcggcgtcgagcgccaggtcgacctgcgtcagctcctcggaacctcgtcgatgactatcgcggcgacgacgggggtgcctcggccggtcgccgcggcggcaacaccgccgtggttcgtggtgagcgagctcatcgcagcgggggtgctcgtctggtcggcagcgagcgtgttcgggatcgaggagcggatggtgaggcggcctcggctgcgcatgcctgctgcccccacgaccagggtcgaggtgctccagtgacgcgctggtcgcgcaccccgacgatcggggtgctcggcgtcgtcgtggtcgtcgcggcgacggtcgcggcaggactcgcgccggcacggccgcgcccagcggtgttcgcgcttcccgggcaccgctcactgagcggtgcgaccgtgctcggggcactcactcagccagcggtcgtggccggtgcgtcctcggaggcctggtactgcgtcgccccaccgttgctgccgctcgcggcgtccacgatcgcgctggccaacctcggtgcgagggcacgccacgtggaactcgtgcccacggccagcggtgctcgcccgatcgccgtcgtgcccctcgcggcgggcgcgatgacgtctcggcccgtgggtgtgcgtgggttctcgatcgtcgagggacctgggggcgtcgcggcgacggtggtgagtcacgagagcgcgggcgtccagagcgagccgtgccagagcactgcgagcgatgcgtggaccgtccttggtttcgacaccggcgcgggcgatcgcgccgtggtgcgcatcgccaacccgttccagacgactgcggtcgtcaacgtcgatccgatcggaccgtcgggtaccacggtggtcgcgtcgacgcaggggatcgtcatccagcctggccagacggtgaacgtggacgtagccaagctcgagccgggcatgacggacgcaggggtcgtcgtcggcgcgaagaacgggcgcgtcgtcgtggtcggagcgacgcggcccaatggcgcgatcgcgccgatcgtgctcgatccgcaggcgacgcaggggcgatcgctcgtcgcgccgtgggtgccggtggtcggcctgcgcaacctctcggtagtgctggccaatccgagctcgagcgtggtgcgagcctcggtgcgggtcgtcggccttcgtgggaccgccggatcgacggcttcggtcgcggacggacatggcgtgagcgaacgggtcgtcgtgccgagcggcgccacggtggtggtcccgctcaccgccgaggccctcgcggagccgtcggccggggtgcagctcagcgtccacacgagcggcggtgctgtgagcggggtcgtggacatcgagcgccgcggtgtcctcgacgggcgcagtgtgatctccctcgagcaggttgcttctcgcgggtggttcctcacgtgcccatcgagtgcggcgatgtcggcgctcgccttcgacgaggttggagcgagcgcccagctcaccatcgccgcccacaccgctgcgagcggtgcgcgatccttcgagacgaacctgctccacgcgggcgtcatcggtcttggcggcgttcggggcgtcgcctggtacgacgtgagcgccaccgagccggttgccctctggccggtcgcttcgtcgaccggctgtgcggtgctcggtgtggtcggtccgctcgattagtcgaacctggtccaggcctcggcccagaggcgctcgtagccgacacgtgcgaccagctcgatcgcgtcggtcggtcggctgggctcggctccaccctcgagcaggatgcgcgccatcgccgtgggtatgggatagtcaccgggggtctcggcgatacgagccagcccatccgggggtgcctgggagttcggtccgagcggtccccaggctccccaggcgcgcagcaccacgacgaggagcgctgcgggaccaagggtccgattgaccacctgctcggtggcacggcccggggggccagcgatccagctcgccccgaggtagtcggcagcgacgagccgtaccgggccgaaggtcgtcgtgaggtgtgccgccatggcgtcgagggacggaccatcctcccaatcgagcaccccgtcgacgagggacgctcgaggctcgagcgcgcgcgcgacggccagcaggcgctcggggtcgaggatgcggcgtcgtaggatcatgcgtcggcccgatcctgggtggtcggcaagccgaggcgccacaggagctcgcgctctgtcgagacgagggcgagcggtgtcgccgtgagcggagcctcgaggatgcgagggacgagcggcgcctcggcttgcccggcgacgatcggagcgaccgtcagcgagagttcgtcgatgagacggcgttcgaggagggtcgcaaggacggtcgggccgccctcgacgaggaggtggccaggggcgctcggctcgacgccacaggcaccgaagaggtcggcgcgcgtgcggatcttgtcgaggtcgacggcgcgagctgcgaagtcaggcgccgtggcgcgggtggcgatgcagatcgggacctcggtgcccccgatgccgaggcgcgctcgcagcgaccggagctcctcgttgcgcaccagcgcgggtccatagccctcgtcgcgagccgtggcagaccctacaaggatggcttgggccgtggctcgcaggaatgcgagggccgaacgatcggcctcgctcccgaggccaccggagcggccgtcgatggtggctcgcccgtcgagcgaggcgatcaccaccgcaatgacacggcaggtccctggcgcaaagtggcggccgaggagcgtggtcgggatccgtccggtcggccagtgctcggtcttcacgatctcacgctagccggctaggctcggttcgtcgtggagctgttcctcgggcgcccggccccaccagcgacgtcgacagcgttgatcgacgaactcgtggtgccgcgcgcgctggtcggggcgacgttcgacaactacgagccgaccgacgcctcccaggtgcgtgcgagagacgccgtgcgtgcctgggtgagcgcgatcgaggccccccgcccccggcgtccgtggagacggcgccatgggcggagggcaccgatggggatctacctcgacggtcccttcggcgtgggcaagacccatcttgcggcggctgcggtggcggctctcggcgatcgtgcacggttcagtgcgttcggtgacttgaccgcaatggtgggtgtgctcggcctcgagcgggtggtctcgctgctcgcggcctctcgcgtgctcgtgatcgacgagttcgagctcgacgatcccggcgacaccgtgatgatcgccaggctgatcggtgagctcttcgagcggggcacagcggtgctcgccacgtcgaatacgctccccgagcggctcggtgaggggcgcttcggtgctgatgactttcggcgcgagatcggccagctggaggctcggttcgaggtggtgacccttcgtggcaccgactggcgtcagcgccgcttcgacgcgctggtcttcgatcggcccctcgtgccgacgcgactgcgtgacgacctcgagcaccggcggggaacggagctcgtccgggaactcgttcgggtgcacccggttcgctatcgcggcgcgattcgcgggcaccccgggtgggtcatcgagggaccggtaccgctcgatgaccaagatagcgcgctgcgcctggtcgccttcgtggatcgagcctgggaggaagacgtggcggtcgtgctgcgcgaccagccgctggcgaccttgttccgtgagagctggctcaccggggggttccgtcagcgctacggcagggccctctcacgtctcgtggcgctcagcgaccgtggcggtccgcagcggcaggctgaacctggccatggtgcccccggttggtcggcgctcgagacggaacgcgccgccgagttcgtgggcacgggcgctgagattggcgagaccgtgcccgagggtggccccgtcggagtcgaatccgacgccgtcgtcgtcgacctcgagggtcaccgtccgcgcatcgacggcgatgcgtaggtcgacgcgctgggcttgggcgtgcttgacggcgttcgtcaggagttctcgtaccgcggcgacgaggtgtggccggagcgaggcggcgaccgcgaagtcgacggggccatcgaaggccacgctccgtcgcatgccggtcgcggcggtcaggcgctcgacgaggtcgagcacctcgccgcgcagtgacgttcggcgggcctgttcgaggtcgaagatggtggtgcggagaccctggatggtcgcgtcgaggtcgtccatggcgttgccgaggagttcgagggcgtggggcgcctcgatctctcggagcgccgcttggatggtgaggcccacgccgaagagccgctggatcacgtcgtcgtgcaggtcgcgtgcgatgcggagccggtccgtcgtcacttcggtcgccgcgagctcgtcgcgcagcgcgaggctctcgatgacggcggcgagggcggtggcgagcgcctcgaggacggcggcgtcgacgaggtcgaatgggccgccgtccgcgcggtcggcgacatagaccgtgccgtagatggcgtcacgaacgctgatcggtgcgccgaggaaggaccgcatcgcagggtgggactcggggaacccgacgctgcgagggtgcgtggcgatgttggcgatcgcaacgacgtgatcacgtgcgagtccgaggagccccttgccctcgggaagggaggcgatctggtctgcggtggcggggtccatgccggaggtgacgaagcgagcaagacggtcggggcgatctcgctgccacacaccgatggctccgtaacgggcgttcgtcagccctcgcgcggcctgggcaccgaggtcgaggagttcatcgaggtcgtgggctcgaaccaaggcgatgacctgatcgaagagcggccggagccgtcgcgccggaattgcctgaggcacctcgactagcctagcgatggcgctcagacggtctcggacgtcgcgtcgagttggagggcggtgccatgatcttgctggaagagaccccgatcgaagccgaggtacccgagatcggctcgggcgcctggcggggggtgcggctcctgcgtcgccactgcccggtcttcggcaccggcacgcgcctgatcgagggcgccaaactgaccggcacggggtccgatctcgcaccgctcgtggccgaaggggggttctgccctttctgtgccgatgtcatcgaggaggcgacggctccgttcccgaccgagatcgccgtgacgggacgcatccgtcaaggcacggcgtgggtggtgcccaacgtgctcgcgtactcggcggtgtccgccgttggcgtctatgaccccgggcgccacgtgctcgagctcgccgatttcgacgaggacctcctcttcgacgcctttggtgccatgctcgagcacgcccgagccgttcgtcgcctgagacccgagctcgtctggtcgtcgatctcggcgaactacctgccgccctcggggtcatcgttgctgcatccgcacctccagagttcacacgatccggtgccgcttgcggcccaagcgatcctcgaggcgaggagcgaggcgcactgggcgtcgtttggtcgagggttgctcgacgaactcgtggagctcgagcgcagcgcgagcgcacgcttcgttgcccagaccggtccctggtcgtggatcacgccctttgctccaagcggcttctacgaggtctggggcgtgcacgagcgcctgggcgatctcgtcgcgctcgacgaccacgaccgccgacagctcgcaggcgcgatggccgccgtcctcgccagctatcgcgccaagggtctgtcgagcttcaactaccagctgctcggggccggcccgcgtgggggcgagttcgacgttcgtgtgctcgtgcggatggtggcgcgtaccccggcggccccctggtaccgtagcgacgtcacctacttcgagaagcttggtttcgaggcgatgatcgatcacacgcccgaggcgttcgccgcggagctacgtcagacgttcggcacggggctctaacgacggggctcaagtcagagccctgagacgtccgatacctgcttcgttcaggcggtgtggcctcaggaggcatggatgcggacgctggcacagaagttgctcatcgcgatcgtgacgctcgcgatcgtcgtcgggattggtggcgccatgacggtcgaccaggcgctcgcctcgcggactcaagcacgcgtctacgcggccgaccaggcgcggctcgaggtgttgtcgcagaccatcacctctgacttctacgcctgggacgatcagatgaacatgtacgtcctcacggcgctcgcgacgccaggacagcacagcctgatcgctcagacgtaccagcaggcagcccaagccggcgcccagctcgaccatgacctcggcgtcgctgcgtcgctcccggcgacgcccgcgatccgagctgacctcgcacgggtcgcacgcgatgcacgggcctatggcgggtatgcgcgagaggtgcacgcggcggtcctagccggggcgacgagtcgagccgcctacatccagacggtgggcaacctcgcgccgtccaacgacatcatggtcgcgctctcgaacctcggccgcgacgcacggatcgacgcatcgggcgcactggccaacgtacgcgccaaggcagcctcggcggcgacctggaccgccatcagcttggcactgctgatcgtgctgctcgtcgcgctcgtcgtcgggatgcgccgttacgttctcggaccactgcgtgcgctcggcgcgtcgctgtgggcgcttgccgaggggtcgacgacggtcgagcggctcgatgagtcgcgggcggacgaattcggtgagatcgcaagagccttcaaccagttccggggaaggctcctcacgctggtggaccgcgtggccgcttccgtcgggacgttgctcgagagcgcccgcgaactcaccgaggtggcccaaggcctgagcgatggcgcacgcgagaccgcggaccagaccgccaacacggtccacgccgcccgggacgtcaacgagcacattcaggcggtcagcgtcgcagccgagcagatgcgcgtcgccatcagtgagatcgcgcgttcggcggccgatgcggcgggggtggccgctggtgcggttgacgtcgcaggcgcgacccaggggcgtgtgcaggccctcggcgagtcgtccgccgagatcggtgaggtgatcgcgacgatcaacgggatcgcggagcagaccaacctgctcgcgctcaacgcggcgatcgaggcggcacgcgccggcgaggctgggaagggattcgcggtcgtcgcgagcgaagtcaaggagctcgcgcgcaataccgctcgagcgaccgaagacatcggagccaagttggaggcgatccgctccgagagtctggcggccgtcgaggccatcggtcggatcagcgaggtgatcgcgacgatcaacgacctgcagtcctcgatcgcttccgcggtcgaggagcagtcggtcacgacgaacgagatcagtcgggtggtcgagctcgcgacccgctcgacgggggatatcacgcgcgcgatggaagacgtctccgacagttcgcgccgcgcggtcgactcggtcgacagcgcaggcacggtcctcgcccagctcgtcgagctcgcgaattcactcggagagctcgtcggggtcgcggcgacacggagccgcggcagcgatggtgccgcacggttcggcctcgcgcgtcacgacgccgatcgtagcgagtcgttcagcgcggtatcgtcgtgaacttgagctcgttgatctcggggtgatcgtcgaaggtcccgaggacgtggtcgagcgtccggcgggcaagcgcaccgtcgccattggggcgggtcatcaggcgtacgaacgcagctcggccgtcatcgaggatgacggtgggcacgccgaagacgcgaaagcgctcgacggcatcgtggtgtgcttcgccgagggcgcggatcgcgcgaggttcttcggcggccgcgagcacgctgggcccatcgagcccgctggcggtgagcacgtcggcgaggacctcgcgatcggcgaggtctcgcgcttcgtcgtggcgggctgcgaagagcgcccggtggacgcgcgcgaaggcttcagggtggcgatcgcgaacgaccacgcccgcgctgagcgcgagcagctggtcgcgcttggactcgtccgcgaagacgctcgtgccaccttcggggacatggacctcgaggagcgagaagggaacgaagtcgacgttccacgacgctccagcctcgagggccgcgagcacgtgctcatggaagttgcgggcgaatgggcaccgatagtcccacgtgacggcgaagtgcatggcgtacctccttcgaccaggctaacggctgcggggagaacgcgtgcagatgcaattacatgccggggctcggtgccctgagcgcgcggaggagctcgacgtcgccgccgtagtgcaggagctccggtgcgtcggccagggggatccaggtgacctggtcgacctcgacgccgtcggggcgaagctggcacggggccggcgcgagcatgaggaaccacgtcacgaccttgatgcgtccgtccgcgaggcgatagcgcgcgacgccgaccggcgcgatcgggaccgcatcgacgccggtctcctccgcgacctcgcgcagcgcacaggcgaggatgggttcgtcatcgatggccttgcccttcgggagtgaccaatcgtcgtagcgagggcggtggacggcgatgacggtgtcgtcggatccgatcacgatgccgcctccggcacgcaccagcccggcacggaccggctcagccacgccgacgccctcgacgagcgtcgccgggctcgaggtgctcgatcagtcggcgggcgaacgtgccgtaggccagcccgaccgcgatgccgccgagcacgtcggaggtgtggtggatccggacgtagatgcgcgacagcgcgaccgcaccagcgagcggcagcagtgagcgccgctgcgcaggcgtgcggccaagcagcatggcggcggcgaaggcagccgaggcatgaccgctcgggaagctcgaggtgcgcggatagcggagtccgagtgggtggggatgatcgcgatcgatcgggcgatcgcggtggaagacgctcttgacgacgccgttcacgagtacggactcgagtccgagtgcggcgatggtcagaagcgcccgacgacgagagcgcgcagagagcgcctgcacgcccgcgatgagcatccacaagatcgagtgatccgcgagtgccgtcagcgtgtagaacgtcacgtcgacgatccggtggccgcggagggcgtcgatcctgcggtcgatcgcggtgtcgaaggtgtgcagtgggcctgccgcggtgctggcgctcatcgggcggctcccatcgccgggcacacgtcacggtgtgggcagctcccgcagagccgtgaggggcggggcggaaagtcctcgcggtcgcaggcccgctcgatcgcgtgccagagcgcgcgaaggcgtgtggcgaccccgcggagcatctgtgcgctcggtgcgcgttcgatcacgctgccgtcgccgaggtagacgaggcgaacgagacggggtacgcggccgaagagcaccgacaccagcagggcgtaggtgaggacaccgccgagccgcgcgtcttgatgggacggtgggggggtccgcccggtcttgtagtcgacgaccacgaggtcgccctcgtcgtcgaggtccaggcgatcgatgaccccgcgaacgtggacgccctcgatggtggcctcgagacgcagttcggtgccgattgcccgaacgcgcgcgggatcttcgaggtcaaggatggtgcgcgagagggtggtgatggagcggtacagtgcagcgcgttctcggtcgtcgagctcggccacataggcaccgagctcgtcgtcacaggcggcggcacggaccgcggtgtccaccgcttcgttgagcgcagcttcggatcgacggtccggctctcgtcgatagaagtcctccagggccgcgtgaaccaaggtcccgaccgcgagcgggcgggtcggtggggttcgcacgccgtcgatcacactgcgccgaaaggcaaaggggcagtcgctgaacgccgtagccttggtcggggtcagggtcgctggcggcgcgagaggcatggcccaaggttaccgaggcggctcgagcggtgccgtcgagagccacgagcgaacgacgcttgcgacggcgtcgggatgctcgaaggggccgaagtggccgacgccgtcgacgatcgcgcagctcgcggacggcgcgcgttgggcaacgagtgcgaggtcctcggccgtcatggtcgtcgaggcggcgcccgcgaggatgagcatcggtgcgctgatggtggcgacgaggtcgagcgccccggtcgtgatgccaccgcgatacatcgcggcttcggcagcaggggcgaagcggaggcgaacgcccgcgtcgtcgctgacgaggcacgtgtcgaggtaggcctcgagcacgcgtgggtcgaacgaggccatcggcggcttggcgccgagccgttcgcgtgctgcttcgcggctcacaaaggaggctcgccgacgcagcgcgccgtcggcgagcgcgttggcctcggccagctggcgtgcgttcgtcgggtcgatcaggatcggctcaaaggccaccagtgcccgagcgggcacggaggcgcgtgagagtgccatgatggcagcggtcgcgcccagggagtggccgaggatcaccggggcgtccgcgaaccgcccgagtgcgtcggcgacggctcgtgcaaagacgttccagtccgtggcatcccccgggggtgggtcggagtcggcacctccgtgaccagggagatccagtccgaatgccaagccaccgagcgcttcggcgagtggtgcgtagcaggcggcgctgaaaccgcccgcgtggacgatcaaggtcgagatggccctggcgctcgccgagatcggtcgatgcagcaggacgaggttgggcgctggcagttcactgctccttctcagggactttcggtgcgacgtccaccacgttacggctaccatcgcggatgtgacccacctgatcgactcgctggtgtctcgcgatggcttgatcgccatcgtcgttctcatgacgctcgagtctgcgctgatcccggtgccctcggagctcgtgatgtcgcttgccggcttctttgcctacgaggggcatctcagcctcgtcggcgcgatggtggcgggcgtcgtcggcaacgtggttggttccgtcgtgctgtgggtcatcggccgtaccggtgggcgcgctctcgtcgagcgcttcgggcgctacgttctcctcaagcctcgagacctcgatcgcgcggagcgttggttcgccaagcacggcgagtcggcagtgatcgtctcgcgactgctgccggtggtccgatcggtgatttccttgcctgcgggagtggcagagatgcgggtggggcgtttcacgctgttcacgctgatcggttcgatcccgttcgtcgtggcgctcacgcttgccggctatttcctcgggagcagctacgagacgatcgtgcgcatcgtccaggactttggctacctcgctgccgtcgcgatcgtgctcgccgtggtcgccttcgtggtggcacgggcgagggctcgacgccgtggggccgaggcggcctgacccgagcgaggtctagactctcgcgtgcgcgggaagtggcgcagcttggtagcgcacctgctttgggagcagggggtcgcgggttcaagtcccgccttcccgacggccacagccacgcgggtgtagctcaatggtagagctccagccttccaagctggtggtgcgggttcgattcccgtcacccgctccgcatcggcgcttctgggcgcacgacccgacggtcgtgcgcagggggcgcgggcacgatcgaggcggtcgcgttgtcgctcgttcggacggattcgcgagcctcgcgcgtgccgacaccctcgggtcgtggcgggtgccgaagaacgtcagcggtgcgccggcatgagcgcacgcaaggactcgtcgtggctctggtgactcgcggctggccgtcgccatgcctgatacctggtagggtataaggagcggacatgggacgtgaccggtctgaagtcgagttgctgggtcggatttcgttcatgccgtttcgtattgcgctattatcagtgcgatagcagagaccgaaggaggcccccggtggtgcaggtcgtgcgccctagtgatccttccgaggagcttggcgctccgtcgctggactcggtcgtcggcgagggtgtcgacggacgcgtcgtcggcgatcagccggcaggcctcgacgagtccgaccctcggagcggagaggtcggcgacctcgttcgacgtctctcgcgcatcgaaggccagatccgcggcatcaagcggatgatccaggacggtcgcgactgccgcgacctcgtgacgcagttcgctgcggtctcgcgcgcgctcgagcaggctgcgttgaactacgtcacctcggagctggtgtggtgcgtcgagcgacctgacgaggccgctgagcacggctacacggtcgacgagctgcgaaagctgctcggtcgccttcgttagtccggtcagcgggccggcgcccccggtatgattggtgcgctatgcgctctaccacctctaccagcgatgatcgccgatcagccaccgtcaccgtcgagttcgagagtgacgaactcgcctccaagttcgacgaagtcctcgcgcgcctgcagcagcaggtgcgcctgccaggcttccgtcgtggcaagatccctcgtcagctcctcgttcggcgcatcggcgaagaggagctggtgcgcgaggctgcggaggcgttgatcgaggagcgcgtcggagatctcctcgccgagagcggtctcgacgtgatcggccggccggcgttggcgcgggtcgaggcgcggcccgagggaggtgccgaggccgagctgcgggtcgagctgcgtccgagcgtcgaggtcgcgggctggcgcgacatcgaggtgcgggttccggatccccgcttgacgagcgaggaagtcgatcgcgtgatccgtgagatcctcgagcagcgtgcggaggtccgtgacgtcgatcgtcctgtcgccgaaggtgaccaggtcaccttgaacgtgtggcgtgtcgagtccgacgggaccgaggcgctcgtcactccggacctcgtcgtgcgcctcgggcgaggtcaggttcctcgtgacatcgaggaggcactcgtcggcgccgtcgtcggcgctcgcgtcgagcgaccggtgccacacgagacgccgaccgacgctggggccacgaccgacgccgaggcaggggaggccggcgatgccgaggatgcgtcaccggccgacgcgccgccccaggccgccgcggatgcgccgagggagctctacgaggtgcgtgcgatccgggagatcgtcgttcccgaggcgacggacgagttggtggaggaggtcacaggccagccgacactggcggccttgcgcgaggccgtcgaaggagacctgcgctcggctcgcctgcggcgcgcccaggaagccttcgaggccggagttctcgcggcgctcctcgagaggacggagccgaagacggtgccgaacacgctggtggaccccgtctttcagcaggagatccgccggttcggctcgtcgctcgatgcgtcgggaatctcgctgcgtcgctacctcgatctcaccggccagagccgcgatgacatcgcgaggagcctgacggagcgctcggcggagacggtcctcatcgatctggcgctgcgtgccatcgctcgcgacgcggatctcgaggtcaccgacgaggagttgcgcgcggaggtcgatcgcttggtcgcgacgggccagattcgcgatcgcgaggaagcggcgcggccggcgatcgagacccagctcgtcgctgacgttttgttgcgcaaggcgctcgcgctgctccagcgggaggtgcacgtggtcagtgagtcgggcgaggcgctcaccctcgacgatctcgagctcgcgaacgccatcgcagacgtcctcggcgatgcgcctccgaccgctgaggaggagcttcctggttcgatcgccgaggaggcatcgacgcccgcaggttccgagaccgacgacgctcactaggatcgctctcgtggatcgaccgctcgcgcctcgtaactacctcgtcccgaccgtcatcgagacctcgtctcggggcgagcgggcttatgacctgtactcgcggttgctgcgcgagcgcatcatcatcctcggcacgccgatcgatgatgcggtcgccaacctggtgtgctcgcagatgctctacctcgagtacgaggaccccgaccgcgacatcaatctctacatcaactcgccaggcggggagatcaccgcactgttcgcgatctacgacacgatgcgcttcgtgcgaccagacgtgtcgaccttctgcttcggtcaggcggcctcggcggcggccgtcatcttggcggccggtgccaagggcaagcgatttgcgctcccgcacgcgcgcatcctgctgcatcagccctacggcggtgtcggcggccaggcgacggacatcgaaatccaggccaaggagatcctgcgcatgcgcgacctcctgaacgagatgctggccgaagcgactggtcaaccggtcgagcgcatcgcccaggacaccgatcgcgatttcgtgctcgaggctcctcaagcggtcgagtacggtctcatcgacgaggtcgtggtcgcgcgcgaggctcgttgaaccagcagcggaccccacctccgcgaccatgacgcgctaggctggacgagtccgcaccgttcgaaggaaggtgggcgatggccaaggtgggcgacgggcaagagatcgtcaagtgcagcttctgcggtctgtcgcagaagcaggtgcgcaagctcatcgctggtccgggcgtgtacatctgcgacaagtgcatcgagctgtgcaacgacatcatctctgaagagttgggcgagccgaagccggaagcggtcacgcaggaacgactgccgaagcctgccgagatcatggagttcctgaacgcctacgtcgtcgggcaggagtctgcgaagaagatcctctccgtcgcggtctacaaccactacaagcggatccggtccggcgcgaaggatgacgtcgagctccagaagtcgaacgttctgctgctcggaccgaccggttgtggtaagaccttgctcgctcagacgctcgcgcgcatgctcaacgtgccctttgcgatcgccgacgcgacggcgctgaccgaagccggctacgtcggcgaggacgtcgagaacattttgctcaagctgattcaggcggccgacttcgacgtgaagcgcgccgagaccgggatcatctacatcgacgagatcgacaagattgcccgtaaggcggagaacccgtcgatcacgcgtgacgtatcgggcgagggtgtccagcaggcgttgctcaagatcctcgaggggaccgtggcctcggtaccgccccagggtggtcgcaagcatcctcatcaggagttcatccagatcgacacctcgaacatcctgttcatctgcggtggtgcgtttgtcggtctggacgagatcgtggctgcgcgccttggacaccggggcatcgggttcaccggctcgctcgccgagcgcgatgggggtgagaacatcctcgcccgggtccaaccggaggacctcttgcgcttcgggctgttgccggagttcatcggacgactcccgatcgtgggcactatcgagaacctcgatcgagacgccctgatctcgatcctcaccgagccgaagaacgcgctcgtgaagcagtatcagaaggtgctcgcgatggacggcgtcgagctggagatcacgccgtcggcactcgaggcgatcgcggatctcgcgctcttgcgcgggaccggtgcgcgcggcctcaaggcgatcatggaagaggtcctcctcgacgtgatgttcgaccttccctcgcggtccgatgtccagcgctgtgtgatcgatcgtgacgtcgtgctcgagcacgcggctcccacgctggtgccgatcgatccggcgagcgagccgcgccgccaggcctcttgacgagcgatctcgcgcggtcggcggacccgcgtcgttggctcggtgagctccccgacttcgaggccgatcgcagcgtcaccgttcatggccctgccgtggtgcgggccgccctcgatgcgctcggcgcacccgaccgggacctcgtcgtggtcagcgtcgcgggcaccgctggcaagggctcgacggcgacgctactcgccgcgctcctcgcctcggttggcgtgcgagctgcactgttccgatcgccgcatctgtgtcgatgggaggagcggttcgtcgtcgcgaccgagccggtcgaggcggcggccatcgacgaggagctcgagcagatccgcctcgcgagcgaggcgggactgctcgtcccgttgacgcggttcgaggtcgagacggtcctcgcggtccagctcgcggcccgcgagggctgcgaggtcctggtggccgaggccggactcggcgcccgcgaggacgccaccagagccctcgagccggcgctcgcgatcgtgaccgccatcggtgacgatcaccgggccgagctcggcccgacgctcgagtccatcgccgctcacgagctcggcatcgccgcgggtgccccgacggtcgtgctcggcgagctcggcgccgtcggggaacgggttgcggcgaggcagctcggtgccgttccgagggtccggcgtctggggatcgatcgagccatcgtggagcgccacagcggcgtggcggggcagtccgtcgtgctcgacgacggccgtgagctgctcttgcccttcatcgggcgaccgggtgcgcagagcatggtcctcgcggtggtcgcgctcgaggagctgctgtcgatctcgctggaggcggcccatatcgatgcggtcgcgcgtcgtgcggtggtgcccggtgtcccgtggctccatcggcagccggttcgtgcggtgagcgatctcgcgcacaatgccctcgcgatccgcgcgctggccgagaccgtggcggagacgttcccgcccgacctcacatggcggttggtcatcggcctgacgcatggccgcgatccgcgtgccgtcttcgaaggcctcggcacgctcaaggtcgacgaggtcatcggggtcgacgtgggtgtggcgacggaggtgcttggcgaggcggcgcgcgagctgtggccgtcggcgcgctggcggagcgcggcgagcgtggaggaggcgttgtccgaggcgccggaggacgacgtgtggacgctcgtgaccgggagtctgcgaatcgtcgcgccgctgcgctgtgccgaggcgccgtcggggatcatcgcggtcgactaggctcctcgtcccgtatgcagcgcacgcttgtcatcttgaagcccgacgccgtcgaacgaggactcgtcggggagatccttgcccgtctcgaggcaaagggcctgcggttcgagcgcctcgaactacgccagctcgacaaggacacggtgcggcgtcactacgccgagcacgaggggaagccgttctacgacggtctggtcggcttcctgacgcgcggccccgtcgtggtcgcggcggtgactggtcccggggatgcggtcggcgcggtgcgggctctcatgggtgccaccgacccggcagtggcggccccggggacgatccgcggggatcttgctatgctcatcgacgaaaatctgatccacgggtcggactcgccgggcgcagccgctcgtgagctcgcgctcttcttcccggatcatcagtagtagctcaccaccgacatgcctgaggtcgcgatcggccaccacaggggaggttccagatggccagcgtaggaaagatgttcggacgcgatatcgccgtcgacctgggaacagcgaacacgctggtgtacgtgcgcggcaagggcatcgtcatttcggagccctccgtcgtcgcgatcaacgtcaacgacgggcgtccgctcgctgtcgggctcgaggcgaagcgaatgatcggacgcacgccatcgaacatccaggccattcgtccactcaaagacggggtcatcgcggacttcgaagtgtgcgagaagatgttgcgctacttcatcggtcgggtgagcgcgtcgaaggtctccaagccccgcatggtgatctgcgtcccgagcgggatcaccggtgtggagcgccgtgcggtccaggaggcggcggagtacgcgggcgctcgtaagcctgcctacatcatcgaagagccgatggccgccgcgatcggcgcgggtctcccggtgcacgagcccaccggcaacatggtcgtcgacatcggcggtggaacgaccgaggtcgcggtcatctcccttggtggcatcgtgacggcgaagtcgatccgcgtcggcggcgacgagatggacgaggccatcatcgcgttcgtgaagaagcaccactcgctcgccctcggggagcgtaccgccgagcagatcaagatgacgctggcgtctgcctacccgctcgaggaagagctgcgggcggagattcgtggtcgcgacctggtcaccggtttgccgaagaccatcaccatcaccaccgaggagatccgggccgccatcgaagagcccaccagccagatcgtcgacgccgtcaaggcgacgctcgacgcgacaccgccggagctcgccgccgacatcatggagcgcgggatcgtcctgaccggtggaggggcgctgcttgcgggcctcgatcggcggctgcacgacgagaccggcatgccgatcgttgtggcgaagaacccgctccagtgcgtcgcgatcggttctggtcagtgcctcgaggagttcgacgccctgcgccaggtgctgatcacctcgtctcgctgatcgagctcgtgtcgcgactgcttgcgagacctcgctcgaccctgctcgtcctgctcgtcgtcgggttgaccctggtgacggtgagctttcgatcgccgaacgcgtttcgtttgggaaccgtccgttcgctcgtcactgacctcgtgaacccggtgcgcaacgccgtcgacggcgcgtttcggccgttggcatccagcgtgcgcggcgcggtcgactaccagcaagccgaggccgagatccgcacactgaaggcagaggtcgcccaagccgaactcgcagcccgggagcaccaagctgctgtggcacagctcgatcagctctcccggctgctgcacttgccgtgggcgggctccatccccgtccagccagcggaggtcatcgggaccactccgtcgaatctgcagctgtccttcgtgatcgatcgcggcagcgctgcaggggtcgcggtcggtaatcccgtggttggtggcggtggtctcgtggggcgtgtcgtcgcggtgacgtcgtcgacggcgacggtcctcgagatcaccgatcccacgtcggtcgtcggcgtgcggctccccgggtcgggtcaggtcggtgcgatgacgggcagggggcttggcgcgccaatgtcggtctcgctcatccagccaggcacgccgctgcggcgaggggcgatcctcgtcacctccgggctccagggggggctctttccaccgggaatcccggcggcgcgcgtccggtcggtctcgaacccgttgaacgcgctccaggagcagatcagcgttgttccgctccagaacctgtcgtcgctcgcctacgtggatgtgctgcgttgggtgccgacctctggcagcggcgcatgaggtacctccgtgcgctcgtggtgctggtgctgctcggaaccgcgctcgtcatccagaacaccggcctcggacaggcgacgatcctcggggtgcacccagatctcgtcatggccatggtggccgcgatcggggcggtacgaggacgcgagtcgggcgccatcgctggctttgtcggtggtatcgcggtcgacgccttcctgtcgacgccgttcggcctgtcagcgttgatctacgtcgtcgtcgggtatctcgctggtgaggtggagcgcatcgacggcggcgcacccctcgcggtgcgctggatcgtcgtcggcctggcgagcctggtcggggagggcctcttcgtcgttgctgagttcctgctggggcttgcgaatcctcttcagaccaggctggtagaacagatcttggtcgttggcggcgtcaacttggtcatcgctccggtggtccttgggctcgtgcgcttggccttcgtgtcgacgccgtcgaccgtgagttgatcagggagcgtgcgatgcctcgacgtcgacgtcgcagccgtccgggctcaccaccaaccggcccgaggacgtcgttccgagcacgagtgctcggacttgcgaccctcgccctgttcggcggtctgctcgcccggctctattcgttgcaggtcctcgaagcaccgacctaccaacaggcggcggtcgagaactccgtgcggaccgtgtcggttcctgccccccggggcttgatcctcgaccgcaacggcacggtcctcgtcggcaaccaggtcgtcgacgtggtcggcctgtcggcctacgaggcatacctgcatccggcggtcgttggtcggctcgccaaggtgctcggattgagcgccgcgcaggtcaaggcggatctcgccaactcccagtactcgacctacgagcccactccgatcgccacgggcgtctcgcaggcgaccgcggtgtcgatcgaggagcacgcggccgagtttccaggcgtggtcgtggagctcgagacgcagcgcacctacccacagggcgacacggcggcccatatcctcggctacgtgggtccgatctcgccctcgcagctcgccaagctcgccaagtacgggtacgcggcgggagaccaggtcggtcgtgcaggggtggaggagacgttcaaccagtacctccacggtcgcgccgggtcggagcagctgctcgtgaacgcatttggtcaggtggtcggggtacgcaagcgggtcgccccgacgcccggcggcaatctcgtgctgtcgatctcgctgccgctcgagcgctatgtcgagcaggtgctcgcgacccaggtccgcaagctgtcgaactcctacaacagctacttcgggcgctacaccggcaacctcggcggggccgcggtggtggaggatccgaacaacgggcagatcctcgccatggcttcctatcccacgtacaaccccgagtggtgggtcgggggcatctcgacgcagcactacgcggagctgaccagcgcgtcggcgaacgacccgctgctcaaccgcgcgatctccgcagccttcacccccggctcgacgttcaagctcgcgaccgcttcggcggcgctccaggacgggctgatcacccccagcacggtcatcgacgacacgggccagttccagatcccgaactgcaccggatcgttctgctcgctccacaactcaggtggtgaggcgctcggccccatcaccatcacgaccgcgctcgctgcctcggacgacgtcttcttctacacactcggctaccgcttctatacgcaggcggcgcagttcggccagacgccgatccagaacatggcggctgcgtatggctggggtaagccgacgggcatcgcgctccccggcgaggtctcgggcatggtggactcgccccagctgcgcaagtacctccacgagcactatccacaggcctatccctacgacacctggtacgtggccgatcagctggagatggcgttcggccaggggctcaccgagatcacgccgatccagctcgccaacgcctactcgacgttcctgaacggcgggactcgctacgttccccagatcgccctcgcggtgacgaacgaccagggccgtgtgatccagcgcttcgcgcccaaggtggcgggacacgtgacgctctcgccgacggtgcgccagacgctcatccagggctacgaggaagaggtctccaatccgctgggcacgggctactacgtctggcagggttggcccgatgccagctacacgatcgccggcaagaccgggacggcgtccgtgtccggccaggtgccgaactcgtggtacgtcggcatggggccgatgcagaacccgcagtacgtcgtggtggtggcgatccccaatggagggttcggcgatctcggtgcgggtccggtggcgcgcgagatcttcacgtacctccgagcacacccggtcggcgccccgaactaccaggtctcccacctcgctgcgggatcgatcacgccagtcgggcagctcggcaggacctcggcgggctaaactgccggtgagcgtccccttggcctacccagcgtgactgcgagagtccgctcgcggtgggcacggggcttcggattccagtggggcgcggggtcgatcggagggtgatgcggtgagcaagcgtgctcagctcccgtgtcctcgtgtcgacccgtgggacatcgtctgggaagccgccatcgccgcatccgaatggacggcccccgacacgagttcgatggtggtccgcgggcccaggcggcgttcgcgcgtcggtctcgatgcgcccggtcgctcgcgcgccacccagcaaccgagaagagggtttcatggtcgatcagccaacaccgacggaccgtgggggtgcgggtcctgaaggagcagctccaccgcctcctccaccacctccaccacgagcgccaaaggctgcctcagcgccggccacctcgagcgctcaaggtcaggggcgacgacgtcggtcgcgaggagctcgccgcggctcagcggcgtcgagcgctctcgacgccacgtcggaggccgtagcagagacctcgccagccgatcggcccgcgagcgcagctggcgggcgcccagatggcctcggcgacgacgctcccgcgaacggagccgacggctctgggagcccggctcagggggccccgggtggagagggtagtggcccatcggccgagggttcgcgacgtcggcgttcgcgtcgcggcggccgcggtcggcggggtcagggaaccccgagcgaggcccggagcgagccggtgatgatggagatccaggcgccgctcgccgagccctcctcgcagcgtcaggggcgccgtagggcccagagtcgcctcccgagggagcggcgtggccgaccggtcgggcgctaccagatggccgtgcatgtccacggggacgtcacgcacgtcgcgattctcgagggtcgcagcttgatccagcacgcggtctctcgcgcgagcgacaccgagacgagcgtggtgggcaacatctatctcggacgggtggtgaacgtgctacccggcatggaggccgcgttcatcgacatcggcacggcgaagaacgcggtgctctaccgcggcgacgtgcgctacgagcgcgaggatctcgagggactcggtgacggcgcccgcatcgagcagctgctgcgtccgaagcaggtgatcgtgtgccaggcggtgaagaacccgatcgcgcacaagggcgcgcgcctcacgcaggaggtgtcactcccggggcgtttcgcggtgctggtgccgggtcagcggtcggtgggcatctcgaagcgcctcccagaccaggagcgacggcgtctgcgagggctcgtcgaggatctcgtgcccgagggtttcggcgtgattctgcgcactgctgctgagggcgcgacccgagcggaactcgagcgcgacatcacgcagctcgtcgggatgtggcagcgcatcgacgagctggcacgaactgagcacgctccagccctgctctaccaggagcccccagcagcggtccgcgtcatccgcgaggagttctcgcaggagttccgctcggtcgcgatcgatgaccgagcgctctacgaggacgtcgcgcgctacgtccagacgatctcgcccgagctcgccgaccgtgtcgagtactacgacgccgaggcagagggcgttccgatctttcagcgttaccacgttcagcaccagctcgccaaggcgctcgagcgcacggtctggttgccgagcggcggatcgctcgtcatcgatcgcgcagaagcgctcaccgtcatcgacgtcaacacggcccgcaacgtcggggcggtgtcactggaggagacgatccaccgcaacaatctcgaggcggtcgaggagatcgctcggcagctccgactccgcgacatcggcgggatcatcgtgatcgacgtcgtggacatggtggacccgcagaaccgtgacgacgtgatgcgggcgttccgagcagcccttgctcgcgacaagacgagaacccacgtctacgacatgagcccgctgggtctcatccagatgacccggcagcgcatcagtgagggcctcgtggagtcgctctcgtcgacgtgcccgacctgccatggccaaggctacgtcctggacgaggatgtggtcgcgagccgctaggctcgtgcgagctatggacgcaatcatctcaaccgggggccgccaagagcgggtgcgcgagggggacgaggtcctcctcgacctccagtcgttcgagggctcctcggcgcggctcactccactggcgatcatcgacggtgacgaggttctcgtcgccccggctcagctcgagggagcctatgtcgaggtcgacatcgtcggggtggccaagggtcccaaggttcgagggttcacctacaaggccaaggcgaacgagcgtcgccgttacggccatcgtcagcggtacgtccgtgtgcgcgtgacgagtgtccacgtcgagcgcgcggcggcagtggagaggactgcgtagccatgtcgaagaccaagggtggcggatcgacgaagaacggtcgcgactcgaatgcgcagcgactcggcgtcaaggcattcggtggcgagaccgtgaaggcgggctccatcatcgtgcgtcagcgcgggacacgattcttcccgggccacaacgtcggtcgagggcgtgacgatacgttgttcgcactcgccgcgggccaggttcgcttcggcgttcgtcgtggtcgtcgcgtcgtcgacgtcgagcccgccggggagtcgctcggctaggcggccgagcagcgtgtcgagcttcgtcgatcgcgctcagctccatgctcgagcgggcgatggcggggcgggtgcggtctcctttcgccgtgaggcccacgtggatcgtggtgggcctgatggcggtgacggtggtgatggcggaagcgtcttcgtccagggcgacgaaggcgtcgcctcgctgatcgccttccgcgatcagccgtttcgccgtgcagaagatggccagcatggccgcgggcaacggcggcatgggcgtcgcggccgagatctcgtcgtgcggctcccgctcgggacggtcgtgcgtgatggcgagggcaacgtcctcgccgagatcctcgacaccacgacccgcgtggagatcgccagaggtgggcgtggggggcaggggaacgctcggttcctctcgaaccgccgccgtgcgccggcgtttgcggagcagggcgagcatggcgacgatcggtgggtcaatctcgagctgaagctcgtcgcggacgtcgcactcgttgggcctccgaatgcgggcaagagctcactcgttggggtgctcaccaacgccagaccgaagatcggggactatcccttcacgacgctcgagcccaccctcggcgtcgtgcggcgcggccccgagcgcgagttcgtcatcgctgacgttcctggtctcatcgagggggcgagtgagggtcgtgggctcggccatgcgttcctccgacacgtggaacgcgcgcgggtgtgcgccgtcgtcgtcgacgcggcgagtgcggcaccggagcgcgatgccgcgacgacgttgcatgagctccacgcgtatgccccatggctcagagagcgcccgacggtcgtggtgctccagaaggccgatctcgtcgacgaccgagccatggtggccgagcgggttggtgacgcggtcgggctcccggtggcaggtgtcgtctccgctcaccagcgggagggtctcgggccgctgctcgacgtgttcgagcgactcgtggccgaggcgcgggctcgggcggcggcggggccggcggtgaccgtgctcaggcctcgggcgcgtgtggaggcggaggcgcgtcgtgtcgcgcccggggttttcgagttgctcggacgcgacgccatccgggccgtgcgcttgagcgatctcagcgacgagggcgccttacgggtggtgcacgagcgtctcggagcgcttgggctgttgcgggcgttgcgccgtctcggggctcgcgatggcgacgtcgttcgtgtcggggacctcgagctcacctacgaggacgaggcgtgatccggcgcctggtggtgaaggtgggcacctcctcgctgacgaccgaggcgggctcgctccgcaccgagctcatcgggagcctcgccgctcagatcgccgagctcgagcggagcggcgtcacggtggtctgggtcgccagtggcgcggtcgccgtcggactggctcgctgtgggctgacgaggccgcaggaacccgacgtcctccaggccgcgagcgcacttggtcaggtggtgctcgcgtctggactcatcgaggcgctcggagcgcatggagtgctgggaggacagatccttctcacctcggatgcactcgccgatcgtcggagctacctgcatgcgcgcaccacgttcgaggcgctgtttcgcctgggtgtggtgccggtcgtgaacgagaacgacgcggtggccagtgacgagatccgcttcggcgacaacgatcggctcgcggcgctcgtcgcacacctcgtgggtgccgatcggttgctgttgctcaccgatcagccgggcgtcttcgccaaggatccccgttcccatcccgacgccgacctcatcgaggagctgacgcccgaggctgcctcggtggtgacgctcggtggtgccggcacgatgcgcggaagcggcggcatgagctcgaaggtccaagccgccgagatcgcggcccgttcgggggccgactgcctcatcgcgagcgcggctcgtgccgaggtgatcgtggacgccgcgcgcggacgtccgctggtggcgaccctcgtgcgacgccgtcgtcggcgtgagcctgcacggaggttgtggatcgcctacgcggcgacgcctcagggtcgcgtggtggtcgacgacggagcgcgcgatgcgctcgtcgagcgcggcgcgtcactgctcgccgtcgggatcgtcgaggtcagcggggagttcctcgccggcagcgtggtcgaggtcgccgaccgatcagggcggctgttcgccaagggcgtggtgcgggtcgattcgagggatgtgcgtcgttgtcgcgacgaggtcatccaccgtgacgacctcgccatcctcgtcgagggccccgggccgagagagcaccacgcagacggatgactcgtccgcaggtcctcgctcggttcggagtctgccgcgagggttgtgcgcgagcgttcggtgccgtgccgacgaggcggccttggcgagcgacgccgccttgaccacggccgagagccgtggtggcgtgctcagacgagctcggcgatgcggcgagcgagcttgtcctcgatctcgcgattccacgcgagctcggcgagatcgagcggcaggaacaggtcggagatgagcagcgtctccacgcccgcgacgacgaggtccttgcgccagttgccgacgccgatcgtcacggtgacggggctcggtgtgacggtgaagacgagggcccgttgcgcatcgatgatctcagcgaggaacccacccttcttggcctgcagcacgaaacccttcgtgccatccccggccatctcgacggtgaagccatcgccctcgaggagttggcgtaccttggtcgcgagctcactcgggtcgacctgcttgtcgccgaaggtcacggtcttcttgcctgccatggagtactcctcgtggtcggatcgtgccttcatagtctcgacgaccgggcgggccagcgcaagtcgcggcggtgtcgtcctctcaggaaccgaccgtgccgtcgatgagttcgcgcaggaggtcagcgtggccgttgtgacgggcgtactcctcgatcatgtgcgcgaggacccagcggatggtcggagcgccgggctggcgtgcccacgtcagctcgcgcccgtcgatggcgcgccggctcgcatcgatcgcgctctgccaggtggcgaggtcgtcggcgaagcccacgggagcgtcgatgagaaaatcggcatccggggtctctggatcccagaaccgaggtgcccagccgtcctcgccgaggagctgcttgcgaaaccaccacgcctcgacgtcggccatgtggcgaacgagtccgcgcagcgacaggagcgacgtcgcgatcggacgcgtcgtgagctgctcctcggtgaggccttcgaccttgaggagcaacgtggtgcggtggtagtccaaccatccctcgagcatggcgcgctcgccatcgtcgaaccctggttcgactcgcctgggatcgtgcagttcaccgaccgtcgctggcatcgttgcgctctccttgctcggtggggtccgttaccagtgtcaccaccagctccccgtctcggcaggctaccgggtccgacatcgtggtgggtgtggcggatgcgtggtgcctccaggttcgatggcgagcgccgagcgcacgttagagctcttggaggccttcgagtccaaagaaggcctcgcggagttggttgtcgtgttcgaaggcgtcgcgagggccgctgaagcgcacccgaccaccctcgaggacgatcacgtcggtcgcgagctcgaggaaggagacgttctgttccgccacgagcagcgtgatgccctgggcatggagatcacgcaggcgatcgatcacctcgttcacgatccgaggagcaagcccagccgagggctcgtccatgatgagcaggcgtggggccgccatgaggcacttggcgatcccgaccatcttgcgctgtccgcccgacaggctccctgctggctcgccgagacgatcggcgagctcggggaacatcgcgaggacctcgtcgatgcgcgctgctcgctccctctggcgaaggcggaggccaccgaggacgaggttctcgcggatggagagactcgggaagatgccctgctcgctcatgaacgcaacgccgagacgagcgcggcgatgggcaggcacccggtcgaccgactcgccgaacagcgagaccgacccgccgcgcgtctcgtggaggccgacgagggtggcgagcaaggtggacttccccgctccattcgcaccgaggacgagggtggcggcgccgtcctcgaccgagaacgtgatgtcccagagcacctggacggggccccacgcggccccgagaccgtcaatcgtgagcgctggtggtgccaaggaagaccctttcgacctcgggatcgcgcagcgcgtcgcgcagcggtccgacgaagatggaggagcccgcgttcaacacgacgaccgtgggcgtgacctgctcgaggaagccgagcaggtgctcgacgacgacgagtgaggttccctcggccgcgatctcgttcaagaggcccgcgatgctgtgcagttcggctggggagagtccagcgccgagctcgtcgatgaaaaggacgcgtgggcgcagcatgagggcacgtgcgagatcgagcagcttctgctgcgtggcattgagcgtgccggcttcggacgctccgaaccgcgcaagtccgaggcgctcgaggagttcgtcggggtccacgtcgccccgtgggtggcgcgtgctcgtggcaacgaggaggttgtcgcgcaccgtcatcccgcggaacgggcgggggatctggaacgtccgcccgatgccggcgcgcgcgagctggtggggccgtgccccggtgatgggcgtaccgtcgagcgtcacggtgcccttcgtggggcggttgaggccgcagatcgcgttgatgcacgtcgtcttgccggagccgttgggccccacgaggccgagcgcttgggcgggctcgaggtcgaagtcgatcccggcgagcgcgacgagcccgccgaagcgctgttcgagtcccctgacgctaagcagtggcatcggggagctccttgggccgccgaacgagcagcccgcgaacggcggtgaggatgccggcgaggccacgaggtgcgaacaggacgagcaccacgatggcgagcccatagatcagctggaaggcctgtgggtcgctcacgccgatgatcgcatagagcgcatagaggaccacggcgccgatcgttgggccccacagggtgccgacaccaccgaagagtgcgaagacgagggccagcacggtcgtggtgacgtcgaagacggcggtggggtagaacagggaactcgcccagccgtagagggcgccggccatgccggcgatcgcgcaggcgatcagccacgccacggcgcggcgcatcgggacgttgacgccgaccatcgaggcggagtagggctcgtcgcggatggcttggagggtgaggccgaaccttgagttgcgcagccagaccaccacgatcagtgacaggccgacgagcacgatggacgcgacgtagaactggccggaggagtaggcgctcgcgaggttgaggccgtccggaccgttcgtcacggaggtaagggccgggttggcgacgatgtcggcgagggcgagagcagctgcgagggtagcgatcgcgaagtaggcacctcggagccgaaacagtgggatgagcacgaggccgacgacgacggcaccgaggccgccgacgagcacactcgcaagtgccgggacgtgcaggtggatgatggcgaggccggaggcgtaggcgccggctccgaagaggccgaagtaaccgaacggaagataaccggtgaaaccgtagatgacgttgatgccttgagcgagcgcgacgtaacccatcatatagacgagcaggagttcgttgccgtagatgtggaggccgaacgcaaagccgacgaccgggacgacgacgccaaggccatcggcgatggctcggcgccccaggcgtcgtcgtgagcgccgttcggtcgtggggcgttgggcgagcgcaggctcaggcaacgcgggccctccttccgaagagaccttcgggtcgtagcagcatcgtaccgagaacgaggacgtaggggacgaggttcgaccattccgggaggtagacctgcgcgagctgcgacaagacgccgaaggcgatgccggcgacgatggtgccgatcgggttgccaagcgatccgaagacgatgatggcgaacgcggtgatcgtgaggctcgctccctcggacgggtcgacccccgagaagacgacgatggcgagaaccccggcggcggccgccagcgcgatgccgacgccgaaggtgatcgcggagatccgacgagtgtcgatgccgacggcgagggcctcgcgcgcgtcggccatcacggctcgagtctcgaggccgagtggggtgcgatagaggtagaggagaaagagtacgagcagcggcagtgacaccgcgccgacgatccagaggtaggcggggtagctctcgccgaggaagcggatcggatgcgaggggagcgccgcgatcggcagtgtccgttcgttcgggccgaacccgatcgccccgagtgcctcgatgacctgcgagatgccgaagaagaggacgagcgacatggtctcgatgtcccgagcgcgtgcgagcctggggacgacgaggcggtggaaaccgtagccaacggcgacgccgaagggaaggacgatcaccgcggcgaggacggggctcatgtggagggcgctgtagagatcccaggccgcgaagccaccgagcatgacgacgtcgccgtgggcgaggttgatgatgcgttggacaccaaagacgatgttgaggcccatcgcgaagagggcatagaagagcccgagcaggacccctccgatgatcgcaaagagggcgagcacggcggtacggttcctccagccagtcatgcgcggatccgccaccgagcaccggtggcggatccgcgtgaggtggtcgttacggtgcggggtagacggcgctgaccgggttcggtgcaggcgatgtgaccggcttcagggcgaccgtgttgcccgatcccgggaacagctgcgcgagcggcagcaactctcccgtctgtgctccctcggagttgatctggaacgtgccgtcgacggtcgtgaggttacccgagaccgaggtcagcgcgttgcgcagcgccaactgggacaacgaggtcgcgtgccggagcgcggcttcgaccaccagaccggtgttgtagccgagcaggcccagtgtgttcaccgcgctcgggtaggtgctctgcagcttggccatgaacgccgaggtggtgaggccttcggtcacggagttgtaggtgttgtagaagttggtcccgtaggtgtaggtgtactggagaccggtcttgccgagctgcgactcgaacagcgagagcagctgccccgggaagacggtgaacaccatggggaagtggtcaccggagctctcgagttgctgcaagaacgcggtgtcgttcggctggtagccgagttcgagcacggcgccaggcttcttcgcggcgaggctcgagatgatggtcgagtagctcgtcgtcgacgtcgggacctcttcgtaggcggccagcgagacgtgggccgcggtcagcttggccttgagcgtctcggcctgcgagccgtcgaagtcattgcccccgtagacgatggccacgttgttgatgtgcttcgagatgatgaagttcgccaacggatccggccagatcgacgacaccggtaggtcgcagagcacgatgtagggattgcccggggtgaagaacgggatgccggttccggactggtcgaagagcaggtagtgatgcgcctgggcgatcgagacggccggtgcggtgagcacggacccgaagtcggcgacgaggatgttgaccttgtcctgcgtgatcagctggttggtgagcacgccggccgtcgatgggttggactggtcgttcagggcgatgagcttgaccggaatgcgcttgtggtaggcgcccacgtagacgccacccttcgcgttctcgaggctgacccagagcttcaggccgtcgagttcggggatcgaactcgtcgcgtactcgccggacgaggcgtacgtcgttccgacggtgatctgggacggagccgccggcgcgctcgagctgctcgaactgcttgacgaggagctcgagccgcacgctgcggcggtgagtgccagcgtccccaacgtgagcgccccgagcgacgctcggcgaagacgcggacgaagacgtactcgcatgtggtgttcccccttgtatcccacggagtggtcgccgctgcgccgcactgcggctgcggtgcgccaaaccgacggaagcataggtggtggggtttcgggggccaaggcgatgtcgatactatgcacagtctgcattcaggcaagattcaggttccctgatcacccgcgtcggtgacctgtgtgccgtagactggacgcgcgggtcgcgacgccgtgcgacgtcggtggtccccgacgagtgggtcgggtcgatcggtgggtcgagcggctcgcgagccggtgtcggtcagggcgccgggacagcgcaggagtgggcttcgccggagttggagcggtcagatgatccaaagtgtcgaacaagcgcaggtcgatcgggtcgacgcgcgagcgatcgaagcggtcgcggtggcggcccgggcggcacaaccgcagctcgcggcggcgcccggtgagcagcgccgggcggcactgctcgcggccgcgcgggagctgcgcgcgagcagggctgcgattctcgaggcgaacgagcgtgacgtggccgacgcggtcgatctcacgagtgcccagcgggaccgactgcgcctcgacgatgcgcggatcgaacagatggcccagggggtggaggcggtggcggcccaacccgacgtcgtcggtcgggtcgtcgatggctggacgttgccgaacggcctgcgcgtgcgtcgggttcgcgtcccgctcggtgtcgtgggtgtcatctacgagaatcgaccgaacgtcaccgcggacgccgccgcgctcgcactcgcgtcggggaacgcgatcgtgctccgcggatcgtcccaggcgctcgcgtcgaaccgtgtgatccggggcgcgatcgcgaggggggtcgcctcggtagggctcccggaggcgctcgtcgggctcgtcgaggacacgtcgcgagagggtgctcgggcgttcatgcgcctcgagggcatcatcgatgtgctggtgccgagagggggtccggggttgctccgggcggttcgggacgaggctcgggtgcccgtgatcatcgatggcgacggcaactgccacgtctacgtcgatcgggcagccgatctcgcgaaggcagctgcgatcgtcgagaacgcgaagctccagcgacccggtgtgtgcaacgccgccgagacgctgctcgtccacgcagccgttgccgacgagttcctcccgcagctcgccgagcgactcggttcgtgcgaactgcggggcgacgagcggacgcgagcgctcgtccctcgggcgttgccggccacggccgcggactgggagacggagtatctcgcccccattcttgcggtgcgggtcgtcgacaccctcgaggacgccatcgcccacattcggcgctactcgagcggtcactccgaagcgatcgtcacggaggacctggctgcagcgacgcgcttcacgggcgaggtggacgccgcagccgtcctcgtcaacgcctcgacgcgcttcgtggacgggggccagctcggcttcggtgcggagatcggtatctcgacccagaagctgcactggcgcgggccgatggggaccgaggcgctcacgagcgtcaagctggtcatctggggcgacgggcacgtgcggacctgattgggggcgctagcctggggtggacatggtcgcttttggctcgccccaggtggtcgcggaccggcttcgagaggtcgggtacctcccgaccgatgagatcgcgacgacgatcttcctcgccagtgtgctcggcaaacccgtgctcgtggagggacccgcaggaaccggcaagaccgaactcgccaaggcggtcgcgagggcgtgggggctcgacctggtgcgcctgcagtgctacgagggtctcgacgagtccaaggcgctgtacgagtgggattaccgcaagcaactcctggcgctccagagccacgacgatgacctcggctccgtcttcgacgaggcgttcctcctcgagcgtccgctgctgcgcgcattgcggatgacgagcgaccgactgctgctcatcgacgaggtcgatcgtctcgagatcgagaccgaggcgctcctgctcgaggtccttgcggagttccaggtcacgatcccagaactcggcacgctcgcggcgacgagtcgaccgctcgtcgtgctcacctcgaacggcgtgcgtgacctctccgaggcgctcaagcggcgagccttgttcctcttcctcgactatccggatcccgagcgcgagcgtgcgatcgtcctcgaggcggtgccggggatcgaggcgagtctcgccgatgccatcgcacggttcgtcgcaagcgtgcgcgagctcgacgtgaagaagcgaccatcgatcgcagagaccatcgactgggctcgtgcgttggtcgtgctcggtgccgatgtgctcgatcgcgagaccgtggagacgacgctctcgctgctcctcaagcatcgtcacgacatcgagcgagtccggcgcgagctgctcggggcggccagcgcgtgatcggtcgcgtcctcggcctcgggcgcgcactcgcggaggcgggcgcaccggtgagcccggccgagctcgtcgatgcgctgcgtgccgtggctgcgctcgaggatctggcgcgctcgccgctcagggctgcgttgcgcgccacgatggtcaaggacgtctcggcgcttcccatcttcgacgtgctgttcgacatctatttcccgatggcgaacccgacggaccaggacctcgcggagctcgacgatgcagcgatgcgcgccgagctggaggttgcgttgcgcgatggcgatgacgagcgactcgctgcgctggctgctgccgcggtcgagcgtttcggcgaggtgcactctggcgccgcggtcgctggcgcctactacgcctatcggacccagcgcgggctcgatctcgagcgggtgcgcgaggaactccttgcgggcttggcccgcccccacgacgccgaactcgactggcgcgagcgagaacgcgaggcgaggcgtcgtctccagtcgttctcgcgccacatcgacgatgcggtacgcgcgcgtcttgctcgcgagcgcgatcccgacgaactcgcgcacagcctcggcctgcgcatcgccgacgacgtcgacatcatgaacgcatcacgcgaggagttggcggcgattcgcgaggccgtgcgtccactggctgccaaactggtcgcacggctcgagcggcgtaggacacgccggggcggtccactggagctgcgtcgcacgatccgtcggtcgctctcgaccggtggggtgcccctcgagcccgtgttccggccgcggcgaccgcatcggcccgacgtggttgtcctcaccgacatctccggttcggtggcgtcgttcgcccgcttcacgctccagctgctctgggcgctcgcaggggagctgcgtcgacttcgagccttcgccttcatcgacgccgtcgacgaggtcacccccctcgtcggggggtcgtgggacctcgacgctgcgcttcgagcggtggcagagcgcgccgcggtggtcggcaagcagggtcactcggactatggcgccgtgtttgcccagttcgaagagcgcttcgtcgacgccgtcagtccgaggaccacgctgatcgtcctcggcgatgcccgcgcgaactaccacgagccgcgagccgaggtgctcgatcggctggcgcgacgagcgcgcgccacccactggctgaacccggagccggcacgctactgggacagcggggactcggtcatgggcgcctacgccccatcgtgcacgtcggtcgtcgagtgtcggacgctcgcgcagctggagcgcttcgtcgaggaggtgctgtaggctctggccggcgaggcgcccggcggcgacgatgtcacgaacgcgacgatgtcacgaacgcgacggcgtcacaaacgcgtcaaggtcgcacgagggctcccgcgtcaggggcatgccgtgtcgaggtcgaccgcggtgccgttgccgttggcagagaaggccgtcgtggctccgtactggacgtagcgaatggtgccgccgccgaagggggcatactcggtcccggcggtgcccgcgcagacgctggctgggtccgccccgggatcgggaacccagaggggcgtgccggcaggcagggtcgcgccgccggtgatgtcaccccactggtagttggtcgagtagacgcctgcgctcacgccgaccgattcgaggaacgcgagggccccgtagaccgcgtcgcggttggcggtcgtcgagctcgtccacgatccgctgagctcgacgtccagccaccacgcgttgcgcagcgtgctcgaagtggagccgagatcgacgaaggaggtcgcgtaggcgtactcggcttcgtcgtagccgtaggagaagtaggcaccgggcccgctcgccgacgtggcgctcgtgtagagctgaccggccggcgtcgagagtgctgcctggggcaccgggttgaaggaggtgccgttccacgtcgaccagcttgcggtgccggcgggcgggatcgcgagcggcgccatgttggtgccctgggggatggtgttgctcgcgccggcaaagacgtagagctgggtgctggagccccccaggccgaccgcctgttggaacgcgtccggggcgcagccggagttgctcgtccagtcgtacgagaagggccagccgttcgactcgacgagcagcagtgggtcaccgacaggaaggtaggggaggttcgagcagttgaagttgctgaggtcgaccccgctcatggcgggcagttcgatcgccccgacgatggcgccagggagcgggtgcgaccccgcaagtcccgtgtagcccatcgagtaggtggtgccgtcgaagctcgcgtccccgaaggtgaacaccccgccgtcggctgcgaccaaggtgtagccggcaccggtagggctcgggtcgatcccgacgacgggagctgcgagcggacgagacccaccgagaccggtgagccccaaggtgtaggtgttgccgtagaagccagcatctccgaagctgaacaccccgccgtcggccgccaccagccaatagcccttgccgtcgggggttgtggccatcccgacgaccggggctgcgagcggacgtgacccaccgagaccggtgagccccaaggtgtaggtgttgccgtagaagccggcgtctccgaagctgaagacgcccccgtccttggccaccagccaatagcccttgccgtcgggggtgggcacgatcccgacgatgggggctgcgagcggacgagacccaccgaggcccgtgagccccaaggtgtaggtgttgccgtagaagccagcatctccgaagctgaacaccccgccgtcggccgccaccagccaatagcccttgccgtcgggggttgcggccatcccgacgatgggagctgcgagcggacgtgacccaccgaggcccgtgagtcccaaggtgtaggtgttgccgtagaagccggcatctccgaaactgaacaccccaccgtccgcgccgaccagccaatagccgccaccgcctggcacggcggctgccccgacgacaggagcagcgagcgggcgagacccgtagagacccgtcagcccgaggttgtagaccgagccgaaggtctgtgtcgcgaacgggtacgaggagccatccgccccgacgagaacatagccatcggctggcgtggtcgacgaggccagggtggccgccgtgtgcggggcttgcgccgtgagggggcggtcggtcgcgagtccggcggcggtgacggccaagaggctcgtcgcggcaagtgttccgagcgagcgtcgtagcaaccggtgcgacatgagcggtgcgatcctccgtgcgtgcgtcgtgtagcagaggggatatcggcacgccggctcgaaacgttgagccgagcgcgtggcgcgcccacgaggtcggccgcttcgcgccatcgaggtggttccctacgagtggtgctcggtgtggccggcgtctggcgcgacgaactcgttgcgcatcgtgccgatcccctcgacggagctctccaccacgtcaccgggccggaggaagacgggcggccttcgaccggcaccgacaccatcgggtgtgcccatggcgatgagatctcctggctccagggtcatgatctcggagaggtaggcgatggtggtcgggacgtcgaagagcatgtctcgtgatcggccatcttgcatcgtggtcccgttgacgcgcgtggtgagagccacgtcacggacgtcatcgacctcgtcgcgggtcaccatccatggcccgacgggcgtcgaggcctcgaagatcttgccttggaggaactggctcgtgcgatgttggtagtcgcgcatggagacgtcgttgacgacgacgtagcctgcgacgtgctcgagtgcatgggcgacatcgacgtggcgagctcggcgaccgatgacgacgccgatctcgacctcccagtcgacctcatgggacgtgaccgggagcgtgatctgatcgaaggggcccgtgagggaccgtgggaacttcgcgaacaaggtcgggaaggcgggacgctcgtcgtgacccatctcgtccatgtgcttggcgtagttcagccccaggcagatgatggctccgggggtcgtcacggtcggggcgaaacgggcgtcggcggcttcgacggcttcggctgcacgcagctcgccgaacgcgccgaggtctccctcgacggcgcggagcgccgccgcgaggtccgggaatggtaacagccgccaatgggtaccgaaatccatcgcggcgtgcgttcccgttgctgtgcggatagtggcgaggcgcacggttccctccttgtgcgacgcggtgcgtgggtggaacgctagttggactggtcggcgtcgtcggagctggcccggatggtctcgagctcgatggtgagcggtgccgccgactcgctcgagcagcgcgggcaggggtcccgatgaatcatggagcgtaggatgcgagatcccgatggattgaggcgaacgaggaaggcgcccgagaccgggtcgacgacgacggagtcatacggctcccaccgagacgggggcaccatcgccgctgcatcggggtgtgcttggttgcggggcaggcgcacgaaccgatgctcgctcgtgtcgaagatccacgtggagttgcaggtgtcgatcgtctcgtagcgcccgacgtcgttggagggctgaggtgtcatgtgtcggctcccggtcggcgggttggcccccacagtgtacccggtgggcgctgctcgcgaagagagagtgcgcgggtggagttggctagtcttagggctttgcccgccgcaccaaacggcctcgaggaaggagcacgtcatggccgaagaggaacagccagcgagtccggaagaagaggagctcgccgccttcttcgacgacgaggacgcgcccgaggatcgcatgacgttctctgccttcgatgggtttgcgaccggcatcgcgctcgcccccgaggcggtcccacaggcggcgtgggtcgcggtcgcgcttggcgaggcggccgatgaggcaccaccgcgggtcatcgagttgatggcgcactacgtcgacgagatgcgatcggtgctcgactcgaccgacgtgagcgagcgattcgtacccgtcttcgacctcgtgggcgaggacgacggcgaagagctcgtctcgccgtcggattggtgcgcgggatttctgatcgcgaccgagttctaccgtgacacgctcgatgcgctcgccgagacgaacgacgaggtggccgaactcctcgtgccgatcatcagtttcggtaccgatgagggtctcgacgcgctcgaggagagcggcgacgaggacagcctcgcggacgaactcatcgacgcgatccaacccagcgtgatcgccctgcgcggatacctgcgctcggcttagtcgacccgcgcgacggaagcgtcgtccgcgtcgaggggcgcgcttgcggcgcctgtcgcgatggtcggtgcgtccgcccagaggcgctcgagctgatagaactggcgagcctcgggtgcgaggacgtggatcacgatgtccatgcagtcgaggacgacccaggggtctcccgggcgtccttcgacgcgtgggtggagtccgagatcgcgacggatctggcgaacgagatcggtgacgagcgaggcgccgaggcggggatttcgcgccgtcgcgaggatgaagtgcgtcgcgatcgcggtgagttccgccacttccaagaccacgacgtcatcagcatgcttgtcctcggccatgcgggcgatcgcgagcgcgtgcgtgcgctgatcggagagccggaggcggtgaagatcgtggtcggtgctcacaccagggtcgtggaatgggcgcagggtgctgtcggcgatgtcgatgatggggcctcctcgtcgtgatcgttcggttgggcgcgacggcactcgagactcgtgattgccgagcggtcctcggccgagagcacggcatcgcgcagcggcgggcgacaccgaccgaggcgatggaactgacccagtcgatgcagacgaggacggacggacgcttgctcgccgagagctatctcggagcgaccgctgcacgcgagcctgcggtgctcgggcctgctcgaggtcgtaggagatggtgacgccacgcaccagtcagtctagcccggcttgggctgtatcgccgagtgtggcgggggcgcgtcgtggtagagcccgaagcgattgatggcggcgatggcctcgtcgggcaacaggaactggagggggcgacgatcgcgcacgcgttcgcgcagatcggtcgaggagatgtcgagccagggcatctcggcgaagatcggatcgcgaaagccctcgagcacggtcgggctcgggtagccatagcgattgacgacgacgatgcgagagaggagcgggagctcgtcggctcgttcccaggtcctcatctggttcgcggcgtcggagccgacgatcaagaagagctcgtcgttcgggtgctgagcccgcagctcgcggagcgtgtcgaccgtgtaggagcgacccccacgacggatctcgaggtccgatgcctcgaatccgtcgatggtctcgatgaccgcgcgcaccaccgcgagccgcagcgcagggtcggtcacttcgcgagcggcctccttctgccagggcacgttggccaccacgaagagaacgcggtcgagggcggcagcgtactgcgcgttctgagcggcaacgaggtgtccgatgtggagagggtcgaaggtgcccccgaagaccccgatgcgcatcagtggttctgctcgaggagctcgatgacttcgccgaaagcctcgcgttctggctcgtggaccacccattcgtcgacgccgagcgtctcggagacggcctggatcttctcggcaacctcggccgcggtaccgatcaggaccgccggcatggcgagcgcgtcggcgacgtcgacgttgtaggcgcgactgaggtcgcgcacgacggatgcggcgtcgttgccgaggtgcacgaacgcggtgcgcagctggatgcgtggcgatcgatcagcgagggcggcagcctcacgcaccttggcgagcttgcggcgataggaggcggccgagagctgatcggcgaccgcgcgccgcgagtcgggtcgtgcgagcgatgggttgacgctgacgacgtcggcgtagcgtgccgccagtgtcagcacgcgcggccccccgccgccggcgaccagttcgaagcccgccgcccccatggggaggcggaatccgttgagctgataggcccgaccgtggaaagtgacctcgccgtgcgatcgcagccgatcgacgatcgcgagtgcctcggccagacggtcgacgcgagcggcggcgacgtcgaagcgcgcgccgaggtggtcgaagtcgctgcgctgccaaccagctccgagtccgagcgcgatgcgacccgggaacgccgaggcgatggtcgcgaactcggcggcgatgatcgcgggatggcgcaggtcgttattcatgacgagcgccgcaaccgtgaggcgtcgtgacgctgcggcggcgagcgccaccgaggcgatgggagcggtgcgctcctcgatgtggtcggggaacgacacgccgtcgtagccggcggcttcgatggatgcaaggagcgcggggagctcggcgagctgtgtgctcgcgccaagttggacgacgaagtgtgggcgcgtcacgagacgattccttcgcgagggctggagagcggggagtcctggggcatggtcgggtgagcacctagactaccgctaggaggcttcatgaacgcgcttgacgacgccggttggcagccgtgggactggcagcagcgtgtggccgcgcagcagcccgagtggcccgatcccgaggcgttggacgcggtcatcaaggagttggctcagcgcccagccctcgtggtcgccaaggacgtcgaccggctacgagccgcactggcgcgtgcggcccgtggacgtgccttcgtgctccaagccggtgactgcgcggagagcttccacgatcactccgcgagttcgctgcgcgccaagctgaagatcatcttgcagatggccgtggtcctgacctactcgtcgggcgtgtcggtggtcaagatcgggcgtatcgccggccagttcgccaagccgaggtcggcgcccgtcgaggtcgtcgacggggcgaccttgccgtcgtttcgcgggcacatcgtccatgatgacgccccgacactggacgcgcgtcgtcccaaccccgaacgcctactctgggcctacgatcagtcccgagcgacggtgagcgtgttgcgagccctcaccgaggggggcttcgcggatctctccggggcgcatcggtggaacctcgacttcgtcgcctcgtcgccggaagggcagcgctaccaggcgatcgccgatggggtcgatcgggcacttcgcttcatggcaggctgcgggatcgatctcgagcgcgaggccgttctgcaccaagtgaacgtgtggacctcgcacgaggcgctcttactgccctacgaggcggcgctcacccggcgcgatcctgcctcgcagcgctactacgacctctcggcccacatggtctgggtgggcgagcgcacgcgccagctcgacggcgcacacctgcgttttgcatcggggatcgccaatccggtcggactgaaggtcggccccacgatggagcccgacaccctcgtcgaggcctgccggatcctcgatcctgatcggacgccgggtcggctggtgctcatctcacgcatgggtcacgacgccgtgcgtgatcgcctcggaggtctcgtcgaggccgtacgtgaggcgggctatccggtggtgtggctgtgcgatccgatgcacggcaacaccttcgtctcccagtcaggctacaagacgcgccgcttcgaggacgtgatggacgagatcgccggtttcttcgaggtccatcgacggcttggtacccacgcaggtgggatccacctcgagctcaccggagaggacgtgacggagtgtcttggcggctcggaggcggtgctcgagtcggaactgtgtcgtgcctacgacaccatctgcgatcctcggttgaacgcgcgccaatcactcgacttggcgtttcgcgtcgctgaactcctgatccgctgagttctgctcagctcagatccccatccgttgtgcgaccacgccgcgccgggtggcgcggggcgccgctctcgagctacgcgttggcgaccagcgtggtgcggccccggcgtacgaacacgacgagcacgccaagcaaggcgacggtagggacgagcacgacgacctccatccctcggtaccctgcggcactcgcgatcgccccgagcgcggccggtgcgccgaccccgacgatgttggagaacccgatcagataggagttcgccttcggtagcgcaatgggttcgagggtgtcggcgagcatggagagcacgatcgggaagatcgccccgtgcgggatgccaaggaccgccatcgcgatcgcaaagacggcgaacgacggagcgacgaccgcgatcgcgagtccggccacggtgagcaatccggagacgacgagcatgcgctgcttgtgcgcgatcgggctgcgcgcggcgacgacgccgcgtgatgcgaacgacgtgacgaagaaggcggtgaaggcgtactgtgcttctgcggcgctgacgtgagggagcgagcgcgcaatggccgcgccaaaggcggtcaccgcggcaaagggcaaggcgtacatgagctgagcgatcagtgcctggcgggccgctcgatggcgaaacgggtgcacgtcggcgatggcggcgcgctcggaggcgtggtcgttggcggatggtcgggagaggtggatggtcgccatggcgccgaccacgaccagcgggaagacgccgaagacgaggaggggcgcacgaacgtcctggtgcgcgacgaccaggatgcctgactcgatgagcggggcgacggcgagcgaggccgagagtacgagcgtgaagatggcaagctgacgttctcggtcgggtgccccggccgagacgagttggctcagtccggtcaggctcggcatcccgagcccgcccgcgatgccgacgagggccgctccgaggctcgccacggcgaggttggggctgagcgcgaggaccacgagccccgcgagcaggatcagggctgccgcgagaaccgcgtcgcgcaggcgcgatgggtgcaggcgcgacgagaacccgaggttgacgacgacggtggctgctccggcgatggcaccgacgacgccgatcgccgtcgcgccggcgtggagctgatcgcggagcaagagcgcgatggtggtaagggccatgttctgcgtcccgcggaaggacgccgtggcgccgaggagagcgacgggacgacgagaggactgagccatgattctgatagtgtagcggtcattacggttgcatgcgcaacgactatcttgcggtgagtagttatctggcagtgtgcagttgccgaggttggatgcgtcgccacagcgcccaggcgagtcgcggaccgaccaggaagaggccgaggaacgagccggccacggcgacgaagagccacaccacgccttgatggctgagaagacgcaacaccataccgagcgttacggtgctggcccagacgacgatccctcctggccagacctggcctgtacgtcgacgtacgagcaggaatccgacgagcgtcccgacgaggaacggccaccacgtgcgccagacgccgatcagctgctcgctgtggccgtgcgcgtggcgtccgatcacgacgaagatcagtgtcgcgacgatgtcccacgcaatccagcttcgccagcgcatgtcgctccccttcgcgtcgggttctcagcgtcgatcgacctcgggcgatgcacgatgacgcgtcgatcgctctcgacgcagcgtaggcgacctcgatggcgaggctgtccgacaccgttgacggggctctgtgtgctcgggctcgtcggtcctccggtgcggttggcggactgccatgcggcgcgggcagggcctcgggggcctcacggtgtcggtcccccgtgcgcgtgtggtgggggctcacatccttggaggctcacgcgctggcgtgcgagcacccagcgggcggagcgatcgtaggaggtccgtggtggtgctggaggagcgtcacggcctcgatgctctggtgcacgagtgcgaaacccgagccccgccagcgaaggctcacgacgtagtaggcgacgtgttcggccgcgttggagggggccgggccatagctgcccatgaggcagagggtgagcctggagccgttgtgggcaatccaggcagcgctcacggggacgggtggcagcgcgagcggctggtcaggatgcggggcgagaagcgttggcgtcacgactgccgtgacgtggtgcggcaggagcgcagggtacgcggtgtagagagcctcgacgagcgatgcctggtggtcgcgcgtggctcgaaagagcagaatggaagcgggcgtgatgctcgcgaagttggtggcttcgtaggcgagcacggcgaccgtctggcccccctccacgagatacaccggtcgttgccgcgacaggcgctcgtcgacgtgcatgaacggagggttcgggaccgggagcggaaggttgagccgttgccagtcgaccgaggaaaacgcggccgggttcggttgttcgggggccgcgggcgacgtcgagccgcacgccccgagcgcggccccgacggccaacgcgccgaggatgccgaggatgctccgggcccggtgcgctcgaaccgatgcgaacctgatcacctcggtggcgcgagccgaggcgcgaggctcgcgctgcaggtgcgaccgtgtgagcctcgccacctggaggctccggcgaggacgactcgacgtcgtgatcgacatgacgagactctagctcggcagggggaacgcgtcacggagcgtggagcgtgctccacgctcggccactcgtcaggatcaggggcgcgatgtcctcggctctgtcgacgggcgcacccggcgctcgagtcgttccgtcggcgaactcatcgcgacggccggtgagcgaagccgacggcgcgaggccgcggacgcacgcctccgagggtcgctgtggtggcacgatggagctcgggtggggggtgtgtgtcgcagagcgacatgtggtcacaagggggcacgggtgcacgggacgcgttccgggcgcccccggcaggattcgaacctgcgaccgactgcttagaaggcagctgctctctccactgagctacgggggcggcactcagcatgctaccgatccgatgtggcgacgtggcgtccaggttgtagcatcgccagccagatcaggaggagtatgcatgcgctgcattccgggtgagctgacccttgccgagctgcggtcgttgtgggcgggggaaacctcgttcgaactcgacgcgagtgcctgggaggtgatcgatcgcgccgcgcgtaccgtggccgaactcgccgatcgtgacgacccggcctacggcatcaatacggggttcggtcgcttggcatcgacgaagatcccgcgcgaccaactcgagctcctccagcgcaatctcatcttgtcgcacgcggtgggcgtcggcgatccgctcgacccgccgaccgtgcgactcgtcctcgcgctgaaggtcgcaagcctcgcacgtggtgcttcgggggttcgccgcgagctcgtcgaggctctcctcgcgctcctcgagcacgacgtgttgccgatcatccctgagaagggatcggtcggggcctccggtgacctcgcgccactggcgcacgtcggcgcgctgctcatgggtgtcggtgatgcgctcgtcgcgggtgcgcgcgtcccagccatcgatgcgctcgccgaggcggggcttgctccgctgtcgttcgctcccaaggagggtctcgcgctcatcaacggcacccaagtctcgacggcgatcgcgctcgcgggactgttcgccctcgagcgtacgctcgccgctgccgtcgtggcgggtgcgctcgccgtcgatgcggccgctggctccatggtgccgttcgacgctcgcatccacgcgctccgtggccatccgacccaagcagacgtggccgccgcgctgacgacgctgctcgcggggtcaggcatcgtccagagtcatcaggactgtggcaaagtgcaggacccctactccctgcgttgtcagccccaggtcctcggcgcggtgctcgatctcgtgcggatgcaggccgccgtgctcgagcgagaggccaacggcgtcacggacaatccgttggtcttcgtcgagaccggagaggtgctctcgggcggcaacttccacgccgagccggtcgcctttgccgccgatgtgctcgcgatcggcgctgcggagatcggcggcctcgccgagcgtcagctcgcgctgctcatcgaccactcgctgtcgggcctacctccgtttctcgtgcgcgagggcggtgtgaactcgggcttcatgatcgcgcaggtgaccgccgcggcgctcgcgagcgagaacaagacgctcgcacacccggcgtcggtcgattccttgccgacgtcggctaaccaggaagaccacgtgtcgatggccaccttcgcggcgcgcaagctccacgaggtcgtcgccaacacgcagacggtggttgcgatcacgctgctcgctgcggtccaaggcgtcgagctccgtcgacccttgcgcagttcggatcggctcgaacaggtgatcgcgctcgtgcgcgagtacgtgccacactacgacctcgatcactacctcgccccggacatcgctcgagccacagagctcgtacgggcgggcgccatcgcggagcacgcaccgttgcgcattctcgagcagcgctaggcggtcgacgttcagggagagggctgctcgagccgctcgatcgccgtgaccgagctcgggccctcatcgtcaccgaccacgacggtgagcggatcggttccccacagcgagaccgtggccgccgagcctcctggcagtgagcgcgggaactcgatgcggacatgggtcggtcccgtgagcgccgccgagaggccggcgcgccacagtgcctcttcgacgagggcgagatgaatggcgttgttgacgtggtcgacgatgtcgagatcgctgcggcgtaggtcgagatgccaggtcgcctcgggctcggtgtctggtgtcgtgatgacgaggctcgggcggacgcgacgaccagcggcggcctcgccatagacctcgtcgaagccatcggggagtgacgcaggtgccccagtgtcggggcgggtgttcacccagacggcggcggcgctgacgaggagttcgccgcgaaccaacaggtcggtacgacgctctgcccacgcgcgcccggtcccggagaccgccgtggcgaggtcgacggcgtcgagatagcgaggccaggagaagatctcgatgtcgatcgagcggatgacccatagacccttgtccaccagcggggcatcggtgttgtcgagggtcgcgatgtcgtggaggaagcgggcgatcgcgtcgagccgaagacgtccgtccggcgtcgtgtcagacagcagcacgcggcggtggtcgtcgtagcgacgaccctggtctggcagaggggcgagcggcacgcgcccacgctagtcgggaggggctgacgcgggcaatgacgagctgggacgctcgtcggccagcgatgcgagttgcgcccggagcaccttcttgtcgaacttgccgacgctcgtgcgagggatctcgtcgacgacgacgaggtgatcgggcagctgccaacgcgggacgccatgggtctcgagccacgcccgtgcggcggcgagcgagagcgaggtgccgggtgcgagcacgaccgctgcggcgggcctctcgccccatcgcgcatcggcgatcgcgacgaccgcagcctcgacgacgtcgggatgtcccatcagggtcgactcgagcagcaccgagctgatccattcaccgcccgacttgatgagatccttggtccgatcgacgatgcggagccggccgccggggtcgatggtgccgacgtcgccggtgcggaaccaccctggccgtgccgtgaacgactctgggcccgccccgtggaggtagccatcgagcacccatggtccccgcacgtagatgtcgcccatgtgcgcgccgtcgtgcggaacctcgctgccggtctcgtcgacgacggcgagggtgatgccagcgacgggagcccctgcgctggcgatgtggtcgagctggtcggccaaggggagctcacccatggcgtgcgggagtcgcgaggtggtggcgatcggggaggtctcggtcatgccccaggcctggagcatgcggatcccgtaacgctcggcgaaggtcgtgatcaacgagggtggcggcgccgacccgccacagaggagttcgcgtagtgctccgaggtcgccgccgttcgcctcgagcgcctctgccaccgcaatccagacggtcgggacgccgcccgccttcgtgacgcgctcggcgcggatcagctcgatgaggaccgcggggttgagggtcggtggcgggaagacgagcttcgcgcctgccgccaccgcgccgaagggcagtccccaggcgtagacgtggaacatcggcacgaccggcatgacgcactcgctgcgcgagagggccggcccgttgccggcgttcaccgcgagcgcggtgtggagcacgagggaacgatgagtcgaggccacgcccttcggccgtccggtggtgccggaggtgtagcagatgccggcgcgctggcgctcgtcgagggtgcgcgtgccgggggcgggatcggcgctcgtgacgagcgcgtcgtagtcgagcacctcgccaagggcgttcgcggccccggggtcgacgggaccgatggcgatgatccgtgggatctgtcgaaggcgcggtgcgatgcgcgccacggtcgcaaccagatcgccgcttgcgatgatgacctcgtcgccggcgtcgtcgatgatccaggcgagatcgtcgtcgccaagacgcggattgagcgtgtggagcgtcctccccgagagcgtgatgccgaagtaggcctcgaggtgctcggcgctgttccacgcgagcgtccccacgatggcctccggcggagccaggtcgtcgaggacggtgatgaggcgccgggcgcggtcggcgaagtcgccgaagcgagagcggtgctgctcggtgggcgagcgctgggtgacgatctcggtgtcggcataggccccttcggcgtgctcgaacaggagccacgtcgtcaacgcaacgtccatcatcatggcgacaccccccttcgccacttcggatggtagcgaagggctccgcgccctgtcagctcagtcggcctctggttcgtcctgcatcacgcagaactgtacgccgtcggggtcggcgaggacgcaccaggcgcccccgtcgacaccctcgcgtcggtcggagcgctcctctgcgccaagggcgagggcccgctcgcggagcgtctcgcggctcgcgccgtagaggtcgaggtggacgcggttggcgcgagggtccgccgtctcgatgcgctggaggaacaccggcggcagggacccatcgggcgccacgaggtcgagataggtgccggtgctgtcgagatcgccgatgcgatagcccaggaggcgtgcccagaacgcggccgcgcgccccgggtcgggggtgtcgatgccgatctcgatgcggcgcagatccccgtggtctgcgatgggaggtggtggtgagaacggggggcgccatcgacaggtgtcgcagctcgatcgaacctggcgccaggcgtcctcgatgccgtaccagacggcgtcgaggacggcgggatcggggccgaagcgctctgcgacctggaggtcgagcccgagcgcgcttgcgcgctccgtcgcctcttgttcggcccgctcgaggaggacgccggcgaacagccaccacggcacgaggaggacgctccgggccccgaggcgccagaggcgttccacaccctcaccgacgctgggttgggccagcgagacgaaggcctcttcgacgaggtcgacgccgagacgttcgccgacgaggcgcgcgatcgcggcgagctcggcgttggcgctcgggtcggtcgatccccgtcccacgacgagaacggcctcgggcggcatcggcgagaccgcacgagctcggcgtacggcgagctcgaggagctcgttcgaggcaccgagctggggggcaaggcgcacgtcggcgtcgggggcgagtgctcggatgcgcgccgcgaccgatgccgcgtcgtccttcaagtgacccgcaccgacgagcaccacgggcgcgacggtgatgcgtcgcgcgccagaacgagcggcagcgtcggcagcgtcggcgagggttgggtcggcgaactcgatgaagcctgcctcgacgcgggtcgggaggcgccgagcggcaagctcgacgaaggcgcggaactcagcctgaccgtgctcgagacgcgtgccgtggccgacgaggacgacgagatcggttggggcgcgatgtgtcatgtctcctccgtagcgagttcggcgagcgcattgagtgccgcggcggcgacgggactgcctccgcgacggccacggagggtgaggcacgcgaggccgctcgcgaggaggcgttccttggcttccgccgcgcccacgtagccgacgcagaagccgaggacgacgccgacgttgacggggtgctcgaggagcgccgagagagcggtcggggcgttgccgatcgccaccacggccgggttcgcgagagcggagagcgacgcgcgcatcgctcgcgccgagcgggtctcgacggcgtcaccttgctcgaccgcatcgagcgtcacgatggtcgggagccgcggagcccctgcggcaaccatgcgcgcgtcgacgaggatcggcgcgccggtgcgaaggagacggaccgcctcggtgacgaccgcctcgtcgagtacgaggtcgtcaacgagcgaggggtcggccgtggcgtggacgatgcgcgcggcgacgcggcgcgcgccgggaccgaaacgcgcgagatcgacctcggcgcagatgcgctcgaagctctcgcgagtgatgcgtgctccggcgtcggtcgtcatcgtcgctcccagctccccacgatcgcgtcggtggggcagacttcgatgcaggcgccgcagtcgtcgcaacgtgaggcgacgagctccgggcgccccggagcaggtcgaagggcgtgggtgtggcaggtcgggatgcacacgccgcacccgacgcaggtacccagtgcgatcgccacgctcatcgcgcaggctggtagccacggggtgtcaccgcgagtcctccgaggactcgggtcgccgactggcccacgatgacgatgctcgtcatgtcgacggtcgtgacgtcgaggtcgtcgagcgtgccgagttcgaggtgttcgtcgacgcgttcgacgttgcggccgacgaggacgggcgtcgtcgggggtcgatgtgccgcgaggatcgcgagcgccttctcgagctgccacccgcgtcgtcccgaacgggggttgtagagcaccacggtgagatcggcgcgagcggccgcttcgagccgctgctggatggtctcccacggcgtgaggaggtcggagagcgagatgacggcgtgatcatgggcgaggatcgcgccggcgcgggccgcggtcgcgagggatgcggtgacaccgggcacgacggacaccggcacgcgaccatcggccacctcgtggacgagggtcgcgagcgcgtagataccagggtcgccggaggcgagcaccacgactcgggcgcccgcctcggcgcgggcgaccgcggccatggcgcgctcacgttcggctccgagggcaaagccctgctggagagcgtggcgaccaatgagaggttgggcctggtcgaggtagccgtggtaggcgatcacgacgtccgcgttggcgatggcgccccgtgcccgcggcgtgacgagatcgagcgagcccggtccgagcccgaccaccgttacctcaccgagtggcgcgtcacggaccgccacggcgacggtgacgggcccgtcgatccgcttgggcagcacgagcgttgcgtcgggtccggcgagccgaagggccgcggcctctgccacggatggcgtgtgcacggcgcgctccacgatcggcgatggcgtcggtaccgccacctcacggaggacggcggcctcgtagccgacgatcggaagtccgagcgcgccgagcgctggatgcaagcggcggcggtcgatggtggcgagcgctgccacggcggctggctcgaggtcggcctcctcgagcgccgcgtcgatggcagcgcgcaggtcatcggccgttgcccgctgttccagcccgaccccgaccacgaccgtgcgcgcgatgatgcggggtgcggcgagaccgcgagactcaccgacgttgacctcgaccgctggggctcggcccggtcgtgcacggcgagcgagccagtcggagatcgcaaggccaggccgcggtgcgaagctgagggcagcgccgtcattgaggcgttgctggagccgtgcagggagcggttctgggccgagagcaggcagctcgtcgagcgcgggtgcatcgatgagatcggcactcgtcgtcacgaccgcgaccgcgcccgtcgcacgggagacggcctcggcgaggtcgttcgcacctcgatgggcgcccgtcagcacgacgcagtagcgccgggcgctgtcgagggcgacgatcgcgggcgtgacgcgcttcggggcgaggccgacctcgacgatcgcgcgtacgaccaccgggatcggggcgacgacgacgagcgcgtcgtagctgacgagcgcctcacggagcatggccatcgacgcgtgggcgaccgacgcaaagccgagcgtcttggcgaggtcagcgagctcggctccgatggcgaccacggcgccgccggcggcgccggtgacgctacgcgaactggggcatgaggtggacggggtggtctcgatggcttggcagcctacccgcttggcgagggcaggacgagggagcgcctcctctgcgaccgagatcgccggacgcccgtggcgatggcgggcacacggagcacctcgttgctagagtcgcgctgtggcgccgctgacgagctggatcgacacggatctcgagcacggctacggcctcgaccacctgccgctgggggtggacgccgagggcgtggtggtgcgcatcggggatgtcgccctacggctcgcgccgctcgtcgacgacgggttgctgaggagcgtgtcgcacgggctcgttgctgcacggacgctcggtccgctctttgcggccggctcggccaccatggcgcgactgcgagacgagatcgtggtcctcgcgagcggacgcccggacgacgccgtcgcacgtcggttggtctcgatcgatgcgctcgagctctctgtgccgatacgaccacgcacctacgtcgacttctacgcgtccgaggcccacgccacgaacgccggcaggatcttccgtcccgacggggatccgctgccggctgcgtggcgtcggctcccgatcggctaccacggccgtgcgtccaccgtcgtcgtgtcaggcacccccatcgtgcgcccctggggtctgcgccgcgagggcgagggtgtcgtgctcgggccgagcgcgatgctcgatctcgaggccgaggtgggattcgtcgtcggacgcgcgagcgagcgtggtcggccagtgtcggccggcgcgttcgcggagatggtcggcggcgtcgtgctcgcgaacgactggagcgctcgcgacatccaggcgctcgagtcgttcccgctcggccccttcgccggcaagtcgttcgccaccagcattagcgcctgggtcaccccactctcggcactcgacgcagcgcgggtgacgccgccggtgcaagatccggcaccgagtgccaacctcgtcgatccggacccatggtgcctcgatcttcggctcgagcttcgcctcaatggaaccgtcctcacgcgtccgccggccgccacgacctactggaccccgggccagctccttgcacacctcaccgacaacggtgcacccgtcgagccggaggatctcttctgctctgggacggtgtcgggcgcggcgcccgacgaggtcggttcgctgctcgagctcacctggggtgggacgcggcccgtgcgcctcgatgacgggcacatgcgtacctggctcgtcgacggcgacgaggtcaccatcacggccacggcaccggccctcgacggcggcttcatccgactcggcgaggtgacgggccgggtggtctcggccatcgcgtcgccttggtgagtggctctcgggactcgctgctggcggcggagctcgcgcattaggctcgcccgcgtgcctgttccatcgcgcttgctggtcaacaccggagatggcaaggggaagtcgtctgccgcgttcggggtcatgggtcgtgcatgggcgcgcggctggacggtgctcgtcgtccagttcttgaagagcgggacctggaaggtcggcgagcgcaagctcgccgagcatctcggcatcgagttctacgcactcggggacggcttcacctgggagtcgacggacctcgagcgtactgcggaactggggcgcgaggcctgggcattcgcggccgagcgcctcgcgagtggtgcctacgacctcgtgatcctcgatgagctcacctatccggtgcgctacggctgggtgagcgaggatgcggtggtggaggcgttgcgctcgcgtccttcccgtaccaacgtgatcgtcaccgggcggggggcgcccgagggcgtggtcgagctcgccgacaccgtgaccgagatgcgcaaggtcaagcacgcctacgaccaggggattcgtgcgcgcaaggggatcgagtactgacccggggcctcatcgtcggcgccgcacgctcgggcgcgggcaagaccgcggtcacgctcgggctcgtcgcagcgctgcgcgcgcggggcctgcgcgtcggggtggccaaggcgggtcccgactacctcgacacacgcttgttaggtcgagccgctcgccgtccggcgttcaacctcgacgcgttcctgaccggtcgtgacgggccggcgcgttcgctcgcgttggcggcgcgaggtgccgatgtcgtgatcgccgagggtgcgatggggctgctcgacggcgcgccgaccgccagcacgccacccgtcgcctcgagcgcacacctcgcgcgcacgctgggactggggctcgtcttggtcctcgatgcgacctcaacggcgcagacggtgggggcggtcgcgctcggtctggcgacggcgtctggcgtcgcaccgctcggtgtcatcgcgaaccgggtgcgctcggcgcaccatggggacctcgtagctgaaggtcttgctcgtgtcggtatcgcgctcctcggtcacatcgccgagggagcgctcgacggtcttgcgcagcgacacctcggcctcgtcgacccgagtgagctcgacgggttcgatgcgtggctcgagcgtgctcggtacgtggtggaggagtcggtcgacctcgaagccctggtgcgtcgggcgcctgagctccgcctggtcgaccccgaactcggcgaggcgcggtcccgggtgccggtcgcactctccgtggggccgagcgcgcgctttcgctacgaggagaacctgctcaggctggaggcagcgggagctgagctgctcccgttcgatccgctcgaggaggtccccgacccacacgcacggctgctgtggcttcatggcggctatccagagcattaccaggcggcgctcgccgacaacgggccgctgtggccggcgctgcgtcgggcggcgaacgagatcacggtgatcgccgagtgcggtgggtatgcgctgctcgcacgctcgctcgagggttctcagatggcaggtgtcgtgcccgtcgccatgcggttgggctcgcgtccggtcctcggctatcggtcggctcgcctggttgacggtcctttcggggctcggtcgctgccggctcacgagttccactacctggtaccggaggacgacccaggtgagatcgacgtcgtggacgcccgaggcgagccgcgcccaggcggggtggtgagcccgaggctcctggcgagcttcctgcacttccacctcggtgtggacccggggcttgcgggcgatctgctgcgtcgtgccggcgggggtgggtcgtccgagacggcgtaggatgcgccccgtgagtgggctcatcagcttcgtgggtgcagggccgggcgcgtccgatctgttgacgcttcgtgcggttgagcgcttacgcgcagccgacatcgtcgtctgggcgtcgtcgctgatcccagacgacgtcctcggcttctgtgcccctggcgcacagatccacgattcggccctcatgaccttggaggacgtgctcggcgtctacgcggccaatcccgaggcggccatcgtccggctccactccggcgatccgtcgctctacggggcgatccaagagcagctcgactggtgcatcgccaatgatcgcgccgtcgagatcgtccctggcgttacgagcgttgcggcgtgcgccgccgtgctcggacgcgagctcaccgtgccccaggtcgcccagagcgtcgtaatcacgagggtggcggcccgtacgagcgcctcgatgcccgaacgcgagcgactgcgggcctacgcggcactcggtgggaccctggcgatcctgctctcgggtgcgcatcccgagcgtgtggtcgaggagctgctcgcggagggttcggccttcaccgcgtcgacgccagcggcggtcgtcgtgcgggcgagttggccggaggagcgcttcgagcgcaccaccatcgcaggcatcccggaggccgttcgccgtctcggggcatcgcgcagcgtgaccatcgtcgtcggggatgcgctcgtcgcgcccggagcccgatcgcacctctacgcaccttcgttctcgcatcgtttccgagcacgctcgacggcgggcacgacgcaggggcgcccgcgggcccgcctgcgtcgctccgttcggtgagggcgtcgtgccaggcctgcggaccgggttcacgaccggtacctgtgcggccgcggccgccaaggcagcggccatttggctcgtccatcgtgagcacgtctcgcgcgttgagatcgccctgccgacggggcggcgagtcgagcttccggtcgagtgggatgcgctcgggcgggcctacgtcgagaaggacgcaggtgacgaccctgactgcacccacggggctcatgtgacggtgtcgctgaccccgctcgccgaggcacagctgcgcttcgtggccggtgagggtgtcggcacggtcacgcgccccggtctcgggctcgaggttggtgagccggcgatcaacccggtgccgcgccgccagatcaccgacgccattcgcgaggtgactgacgagggcttcgcggtcgtcgtcagcgttccaggtggcgaggcgatggccgagcggacgacgaacgcccgcctcggcatcgtcggtggtatctcgatcctcggcacgacggggatcgtgcgcccgttctccacggcgtcgtatcgcgcaagcgtcgtgcagcagatcgacgtggcggccgccgccgggcttggcgagatggtgctcgcgaccggttctcgcacggaggcgagggccatggccgagcgttccgatctcgacccggtcggcatcgtcgaggtcggtgacttcaccggcgtggcggtccgacgggccgcccaccaccacatggacccgatcacgtggtatgccatggtgggcaaggtgacgaaggtggcccaaggtctcatcatgacgcacttccaccgcgccgacgtggacacgtcggtgctgcgggaggccgcgatcgcggcgggagctccggcggcggtggtcgaggctgcggatgcgaccaacacggctcgacacttctacgaggtctgtcgtgaactcggcgtggttgcgccgctcgagctgcttgccgaacgcgcggcggtcacgttgtccgaggcgatcgggggccgggccacggtcgaggtcgtgctgtgcgacgtggacgatgccgccgtcgtcgtgcggcgttcggtgcctggcgagcgatgagcgtcgtggtcggctgggtcggtgacgacccctcgaacttgacgggtcgccagctgggcgccctcgagcgcgctcgtctcgtcgtggcgcctcgacggttgcacgaggtgctcggctcactcgcgccgcaggcgacggtcatcgcttatccgacaccgatcaccgagctcgtcgatctcgtccacgagaacccggacgtggtcgtggtcgcgagtggggacccgggattcttcggcatctcgcgcgtgctcgccgatgcgggcctcgacctcgagatcctgcccggaccgacgaccgcagccgtcgcggcggcgcggctcgggcgctcctgggagggcgcgagcgtggtgtcgttcgtcggtcgtgaccatgacgtggccctccaggtcctcgacgaggtgctcgctggtgacggtccggtgatcgcgctcttgtgtcccggccaggcactcgtcgacctcgcgaatgctgtggcggcttcgggtcgacggtcctggctcgccgttgccctcgggacggcagaggaggtcctcgacgaggcgtggcaggcccgctccgaggcgccgcgtgtgccgagtctgctgtggatcgatggagctctctcgcgccgtgaggtggtccatcggatgcgcggtctcgacgtcttcgccgatcgacctcgagactcggacggcgtcttcacgagtctcgaggtacgcctcgtcgcggtcgcacgactcgctccggatcgactcccaccgggcgcgcgggtgctcgaggtcggcgcgggcacgggatacgtgggtctcaccctgtggcgcctacgtcccgacatcaccatcgtgcagctcgagccccgcgcggagcgtgcggctcgagcacgcgagcatgcgcgagcgttgggtgcgcgtgtcgaggttctcgaggcacgcgtcgaagagcatgctcccgagggcgactacgacgccgccttcgtcggcggtggcgggccgcgtgcgctgcgagcgacgctcgatcgcgtccgaggtgggggtcgcgtcgtcgccacgttcgtcgatcccggacgagccgcggtcgcccgagagctgctcggcaacctcgaactcatcgaggtcgcggacgcgtctcctgtcgcgccggaaggggtccgcttcgttccccgtagtccgatcttcctcgcgtggaggtaggagtcgggggagctggctcgagggccgaccgtgcgagctcgtacagtgatggatcgttgcccgcgctcgatggatcgtggctctcgcggttcgacgacgagccggcgcgcggaggcccgtgccgggctgagggagcggtcctcgctcaggtagccgttgtgggtgctgccacggtcgggcgtggccggtgacccctccagcgaatgttgacgggggtcagagggagctgggcacgcgcgtccgctccggcacggtgtcgacaggcacggccgaacggtggtggggctggaagcgagtctcgtcgctcctctctcgcgcggcaacgatgccaacggatcgatcgggtccgagacctctggcgaggcttcgtaccggcgcgacaaccgtgccgctacgcggctcgctgggggggaccggggaggtagcgatgcgtcacagtggctcgagcacgacgcctgcgtaaggtggggcttgccgaatgccgatagacagtgggtcctcggcggactcgcggatcaggggtgcgggtgcggttgcgaggtgccggaggaggtgcgcacatgacgtcgtggtacgggcggagtcggttgcacgctgggatattggtcgcggtcgcggggatcgggctcgccgcttgcggacaggcgacctcgtcgacgcattccacgagctcgtctcgctcgtcgtcgactccgaagcgttcctcctcgcagacttcgtccactcgctcatcgtccgggtcgtcatcgacccccgcagcggtcgccccatgcgatacggcggcgttgtccgcgtcactcggccaaccaagtggggcggcgggaacgacctactatccgctcctcctgacgaacgtgtcgtcgcggtcgtgcacgctctacggctacccgggggtgtcgctcgtcgtgtcggcgagtggttcgcaggtgggccgatcagccagccgcgtcgcggggagcgagcagacggcgacgctcgagccaggacagtccgcgcaggccatcctcggcatcgaagtcgcgcagaactacccgacctcgacgtgccagccaaccaaggtcggaggcgttcgcgtctaccccccggatcagacgactgcactgtacgtatcggcgcctgagctctatggatgcgccaaccgctcagtcgacctgctgaccatcgaaccgctgacacgggcccaatccggtaccggcagtggttcggggggtgcgacgtcctgaagcgtcgggatggggcaacagacgtggtggagaggggtcgcgaactgctccaacagaagtccgtgcaacccatgcgtacgcagagtcgagtgcgagcgtggccctgtgaacctgaccgagtgggcacgtcgccaggggatccacccgcagaccgcctccactggatccatgctggtggctagctccctgcaacgagaccccccgctctgtgaggagcccgaccagcatggacaggcggagggagcgcacatgaagggcacgaacgccacacctcggagcagatcctccggaggctggccgaagggggacgagagccaacgaggggccacggtcgccgaggtcgctcgcgccctcgcacatcaccgagacgacctggcagcggctggaagcagaccgacggccccatgaaggggcccgacgtgaagagggtgaaggagctctcggccgagaaccggcgcccgaagaagctggtggctgatctcgccctcgacaacgacagctctgaggagctggccgagggaaacgtctgaccccggaccgccagcggggagccgtgcacctactccgccagcggttcgcaggtcacctgagcgacagcgtgcgaggcgcaggtcgggcgggccacctgactgcaccttctcacagcctcggccaagcgttggaaggctgctacggtcgagagcatcggcgcccaacgggaccagcgagcggacgtgcgcgaacgtggtctcgcggggaaggcggacgtggttctggagccggccagcgacaccacggtctcgggcgtgacccaggtcggcagctgcctccggcgttcgactcgactgcctggttagagtgcttcctatggttgcacccggcatcgatctcgacgacctcgaccccaccgttcgccctcaggatgatctgttcggtcacgtcaacaaccgctggtttcaacggacggccatccccgacgatcgagcacgctacggcgcgttcagcgagctcgccgacgctgcagagatcgcggtgcgcgaactgtgcgagcaggcccgtgaggctccggccgggtctgaggagcgcaagctcggcgacctctacgcgagtttcatggatgccgaacgcatcgaagagcaaggcgccgcacccatcgctccgctccttgcggcgatcgacgacgtcgccgattacggatcgttctggcacctgctcggcagtctcgagcgcgatggtgtgcgcggcctcgtcgacctcttcgtcgacacggatcctggtgacccttctcgctatctcgtcttcgtctcgcaaggtgggatctcgctgccggacgagcgctacttccgtgaggaacgcttcgcatcggttcgtgccctgcatcgacagcacgtggcgacgatgttcgagcttgctggcctgacgaacgcggccgcgagggccgcagcggtcgtcgagctcgaggcggcgatcgctgctcgccatctcgacaacgtcgcgagtcgcgacgcgctcgccacctacaacctcatgacgtacgaggacctcgtcgggttggtcgcgcagggccaccgcgaggccgaggcgttcctcgaggcctggatcgacggtatgggcgtcgatcgtgcggtggtccgtgaggtcgtggtgcgccagcccgccttcctcggctcggtcggtgagctgttcgaggatggtcgaatcgatgtctggcgcgactggctggcctggcacgtcattgcccacagtgctccgctgctctcgacacgcttcgtcgaggagagctttgccttctacggcactgcactcaccggtgctccgacgttgcgggcgcgctggaagcgtgcggtgtcattcgtcgagggggcgatgggggaggcggtcgggcgcctctacgtcgcgcgccacttctccgagcctgcaaggcatgcggtgcgcgagctcgtcgaccacctgctcgatgcgtaccgtgagagcatcgcctccttggagtggatgcgcgaggagacgcgggccgaagcgctcgccaagctcgaggcgatcgtggtcaaggtcggctatcccgacgcctggcgtgactacggcgcgctcgtcgtcgacccggaggatctcatcggcaacgctcggcgcgcggcgtcgttcgccatggacttcgaactcgccaagatcggtcggccggtcgatcggtcggagtggttcatgacccctcagacggtgaacgcgtactacaacccaggcttcaacgagatcgtcttcccggcagccatcttgcagccgccgttcttcgatgccgaacgggacgccgcggcgaactacggggcgatcggcgcggtcattggtcacgagatcgggcacgcattcgacgatcagggctctcgttacgacggtgagggccgtctgcgcaactggtggaccgacgacgatcgggcgaacttcgagcatcggacgaaggcgctgatcgaacagtacagcgcgctcacacctcgacagatccccgagcaccacgtggacggggcactcaccgtgggcgagaacatcggcgacatcggtgggctcgcgatcgcgtggcgtgcctacgagctcgccctcgacggcgcggagccccctgtactcgaggggacgtcaggtggagagcgcttcttcttctcatgggccatctgttggcgagagcaacgccgtgacgaagaggcgctgcgattgctcgcgatcgacccacactcgccgccagagtttcgctgcaatcaggctgcgcgcaacgtcgacgccttccaccagacgtttcacaccgatccgtcgtcggggctctggcttgaccccgaggagcgcgtgcggatctggcgtgcctagctgaccgcgagaaccgagactgcatgcccgagtgacgtctcgcgggctgtcggccccggtgctaccatcggctcgagcacaggggggaccatgccgtactaccgtcgcgtgggtgaggtgccgcgcaagcgccaccagtacgtacgtgcgcacacaggcgcgcgtatcgccgaggagctgatgggcaaggagggcttcgcggcggagtcgtcgctgctctaccacctggggcggccgacggccatcgtggatgcagcacccgtcgcgattgcgggcaccaccctcgtcgcgaatcgtccactgctccctcgacaccttcgcacgcccaagctcgccggcctcggtggcgacgctgccacggaccggcacctcttgctcggcaacgacgacgtgtggatctcgtgggtggtggcggatcgtccgagctcgctgcagcgacacgccgtcggggacgagtgctactacgtccatcgtggtacgggcgcgtgcgagtcggtcttcggcaccatccgagtaggtcccggcgactatctcgtgttgcctgcgtcgacgacctatcggctcgtcccggacgaaggttcggtcctcgagtgtctggtgctcgaggcccggggtcatatcgagatcccggaccgctacctctcccagcggggtcagctgctcgaggcggcacccctgtgcgagcgagacctgcggggccccgagggcccgctcgtcgtcgagggcgaggacgtggacgtgatcgtgcgtacccgtctggacgccacgcgttacacctacgcgacacaccccttcgacgtcgtgggttgggacgggtgctgctatccgttcgcgttccagatccgcgacttcgagccgatcgtgaagcgattccacgcgccaccgcccgtgcatcagacgttcgccggaccgaacttcgtcgtgtgctcgttcgtcccgaggccgttcgacttcgatccggaggcggtcgcggtgccctaccaccatgcgaacgtcgactccgatgaggtcctcttctacgccgacgggaacttcatgtcgcgggcgggctccgggatcgaggcgggttcgatctcgctgcatccgtcgggcttcgtccacgggccccaaccgggttcggtggacgcagcacggggtcagccaggcaccgaggaggtggccgtgatggtcgataccttccggccgctcatgctgtcggagacggcactcgcgatcgacgacgacgcctacccgtggacctggtcgaggcgcggtcctggagcgcagtcgtgagcaccaagccgttcgcctcctcggcagacctcgcgcccaagcacgaggtcctcgagcatctcgccgatggtgtcgtcgccttgaccgccgaaggtgaccccaacgtcggtgcgatcgcgacgagcgaggggctggtctgcgtggaggcgcgtgcgacgccagtggcggctcggcgctggctcgagcgactgcacggcgtgctggatgggccggtgagctacctggtgctctcgcactaccacgctgtgcgggtgctcggggcgagcgccttcgacgcgggtgcgatcgtggcacacaccgccaccgccgaactgatcgaggagcgaggtgccgaggactgggccagtgagcaggctcgcatgcctcgactgttcgaagagccggcgtcgatcccgggcttgacgcggccgacgctcaccttcgccgacgagctgcgtcttggccgtgggggtggacgaggcgacatctggctgtggtggcttggtcggggccatacccgtggagacatcgtcgtgtggttgccgcgcgagcgggtgctcttcgccggcgatctcgtcgaggcccgggccgcgctctacacgggcgatgcctaccaccgcgagtggtcgggcccgacgctcgatgcgatcgccgacctcggtgccgaggtgctcgtcgggggtcgaggggccgtcgttcggggcagggaggccgtggcggcggcgatcgcgcagtcgcggcgcttcctccaggtcctcatcgacgagtcctcgcgcgcgctggacgccggtggcggcctccgcgaggccttcggcgcctgctacgaggctctcgcgccgacctatggctcctggccgatcttcgagcacaccatcccgttcgacgtcgcccgtgtcgtcgaggaactccaaggggtcgagcaccccacgatctggacgacggagcgcgatcgggccgtctgggacgagctgcaggggtcacggtgacgagggcctggccggtcgcgatcgtcggtggcggtccggtcgggctcaccctcgcactgtgcctcgcgcgccagggcgtgtcctcggtgatcctcgagcgcaacgacggcgcgacgggcgagggctcgcgcgcgatctgtcagcagcgcgacgtgctcgatacctgggacgcggtcggtgcgtcggcgatctggcgagagggcctgacgtggtcgagggggcgtacgtacgtgcgcgatcgggaggtgcgcacggtcgagctcgccgatgtgggtcgcagcgagctaccggcgttcgtcaacatctcacagctgcgcgtcgagtcgatcctgcgcgcgctcgtcgctgagcgtccgatgatcaccctccggactgggttctgtgccacgagcatcgtcgacgacgacgcgggtgtgcgcgtcgtcgggtctcgcggtgaggtcgtcgaggcagcgtgggtcgctgtgtgcgctggcgcgcacgccgatggcctgcgacgtgcactcggcgtcgagctcgctggcgagacccaccccgatcgcttcttgatctgcgatgtgaaggtggatctcgacaccgagagccctgagcgtcgcttctggttcgatcccgagtggaaccccggccgacaggtgctcctccacgcccagccggacggcctcgtacggatcgactggcaggtacccgaggcgttcgatctcgaggccgaggcgcacaccggccgactcgacgagcggatccgagccgtcgttggcgaacgcccctacgacctcgtgtgggcgagcgtctatcgcttccatagtcggctcgccaccggtttcgtcgtgggacggagcgcgctcgtgggcgatgcggcgcacctcatggcacccttcggcgctcgcggtctcaacagcggggtgcacgacgcggagaatctcgcgtggaaactcgccgcggtcctgcggtcgacagctcccgcgtcgctcgttcgcacctacgacgaggagcggcgccaggccgctcggcgcaacctcgaggtgaccgctgcgaccatgcgctttctggcaccgagggacccccacgaccgccagcgacgcgaggcgatcctcgccggcgccttcgctggcgacgccgaggcgatggccgcggtcgactccggtcggctctacgagccggcgtgctacgacggatcgtcgctcaccaccgacgatccccggcgcgcatggttgggctatgacgacgccggtcgacccatcggtccggcggcgggcatgctgctccccgacgtaccgacggccgacggtacccgggtgcgcgcgcagctgcgcttcaccggcgggatcatcggaccgggctgggttcgcgaggcaaccgagcgagtgcacgcagacctcggcctcgcgatggtcggcctcgagcgggctcacgccgaccccgacggcgtcctcgcagacgcgctcggactcgaccccgacgaaggggtcgtcgtgcgtcccgactgccacgtcgcgggctttgcgaccagcccgtcgtcggcggtcgcggtcgccgcacgcgcttggggctggggaggaggtgtcggcgggtcgtaggctgggccgacgtgactggcgcgctgctcgtggtcgggaccggctcgaacgtcggcaagtcgaccatcgtcaccggcctcgtgcggatcctcgcgcgccgtggggtcgcggtcgctccgttcaagggtcagaacatggccctcaacgccgccgtcaccgtcgagggaggcgagatcggcagagcacaggcggtccaggcgcgtgcggcgtggcgcgacccgagcgtcctcatgaacccgatcctcgtcaagcccaccggtccaggccgcagccagctcgtcgtgctcggcaagccggccggcgagctccgtgctgcggcgtggctcgagggacgtcgggggctgtggccgatcgtgctcgacgccttcgacgagctgcgcagcagcgtcgacgtggtgatcgccgagggtgcggggtccgcagccgagatcaacctgctcagtggcgacctcacgaacctcgccctcgccgaggctcgtggcgtgccggcggtactggtgggtgacgtcgaccgtggtggcgtcttcgcgtcgatctacgggcactacaccgtgctgccgccctcgctggctcgccacctgcacggcttcgtgatcaccaagctccgtggtgaccccggcctcctcggcccgggcgttcgcgagctcgaggatcgcctcgcgacccgttgctacggggtcgtgccctggcacgagatcgccctgccagcggaggactcgctcgtgcgccaccgcgccacggcgccgcgggcaccagggcagctccgtgtcggggtggtggcgctcccgcacctcgccaacgagaccgatctcgatccgctcgttgccgagggggtcgcgctgtcgtggatcgacgacccgagtcgtctctcgggtgtcgacctcgtcatcgtgccgggatcgaaggcgaccgtggccgatctcggctggctccgagcctcaggcattgcggccgccctcgaggaccaccttcgtgagggcggatggctcttggggatctgcgctggctaccagatgctggtcgacgtcatcgacgatccggtcgaatcgggggaggggaccgtggcaggactcggcctcgtgcgagggagggtgcgttttgggcccgagaaggtcctcgcgctcgtcgaagggtccctgcggtggccagaggctgcctcggttcgtggctacctgatgcaccatgggcgcgtggtgagcgaggaagagccgttcgtcgcgctcggcgacggtcagctcgagggtgcccgacgcggtcggatcctcgccaccgccgtccacgggatcctcgacgacgaccgggcgcgccgggcgctcctcgaggccgtcgccgaggatcgaggtcgcacgctgccccctccggtggccttcgccgcctaccaggaggcgcgcatcgacgaggtggccgatctgctcgaggaacacctcgcgctcgacgcactctgggggctcctcgggtcctaggctcgctgggccgtagggtggccacgagggggccacgaggggagggacgcatgcgcatcacggtcgcgacgaacgccgacaccgaggtgcttgcgctgcgcatggcctgggaggatctcccctcgaccatcgagctccacgtcgccgcgctcggcgagctgctcgagacctggcatcccatcgagggcgacgtgctcgtcgtgcgcgcgctcggcgggatcgcggcggtgcccgacccggcacagctcgcgaccagggcacgcgctggaggagctcacctcgtcgtccttccgggcgaggcgaccttcgacgtaccgacggcacaggcttccacggtgccgatggccgtcgtggagcgcgccttcgcctacgcccgtgaggggggtgctgccaacctcgcgtcgctctgtcgctacctcgccgtccggctcggcggtgtcgaactcgacgtcgcagagccggtgagtatcccgttcgtcgggagcatgggccacacgtcctggtgcgagcgtcatagcgggccgcgcatcgcggtcgtggtctatcgcgcccatctcatcgccggcaacacgcagttcgtcaccgatctcctcgacctcgccgagcagacgggcgtcgcgctcgaggcctggtgggcctactccgcacgcggagaggcgggtcaggtcctcgcggccgagctcgaggcgtccggtgtcgacgtcgtcatcaccacggtgctcgcgggcggcgagaccgaggggctcggttgggatgcgggtccgctcggcgggctcgacgtgccggtcgtccaggcgccgatctcgaccgtgtcgcggcaggagtgggcggcctctgctatgggtctcgtcccgttggacgtcgccatgtcggttgcgattcccgagtacgacggtcggatcatcgcggtgccgatcgcctacaaggagctgatcgatgccgacgaggtcttcggggcgccggtgcacgcctatcgcctcgatcgcgagcgagcgcatcgtgtcctcgaacttgctcgccgcctcggtgcgctgcgccgtcgcgccaacgacgccaagcgcgtggccatcgtgctgtcggcgtacccgaccaagcgctcccgcatcggtaacgccgtgggtctcgacacgccccagagtctcgtgcgcctgctgtcgatgctcgcggagcggggttggcggctcgagacccccgacgatcccgacgcactcatggcgcgccttggtgcgttgctcgatcccgaggccccgagcgagcgtgctcgcggaggcgcgaccctctcgatcgatgcctacctggcgtggtacgcgacgctccccggtgagctccgcgacgaggtcgaggcggcctgggggccgccgccgggctcgcgctacatcgcggagggatcgttgtggttccccgcgatctggatgggcgatgcgctcgttgcgatccagcctcctcgcggctacggcgagcacgagatcgcgatctaccattcgcccgagctcccgccgtcgcatcactacctggccttctaccactacctcacggcggttgctggcgtcgacgccgtcgtgcacctcggcaagcacggcacgctggagtggttgccgggcaagagcgtcgggttgtcgtcgtcgtgctggccggacgtcgcgctcggctcggtgcccctcgtctacccgttcgtggtcaacgacccaggtgagggcgtgcaggcgaagcgtcggagccacgcggtgatcgtggaccacctcgtaccgccgctcacccgagccgacagctacggagccatcgccgatctcgagtcgctgctcgacgagcaccagcgggtcgcggccctggacccatcgaagctccccgagctgcgagcggcgatctggtcgctgctcaccgagtcgcgcatccacgaggacctcggtatcgacgaggccccgagcgtgcgcgacgacgccttcgacgacctgctgctcgacgtcgacggctacctgtgcgagctcaaggacgccacgatccgtggtggcctccacatcctgggcgcgccaccggtcggcgaggcactcgtcgatctcgtggcccagatcgttcgggtgccgcagttggacgtgccgagccttgccgaggagctcgatcgcctcgaaggccgtctcggcgacgggagccgtgcggcgcgcgacgcctctgacgggcgcctccacgagatcctgtgggccctcgccgagcgcgattgggatccggaggtgctcgatgacgccgagtggtgtgcgagcgtcggtcttgaggccgccccggacgacctgcgtacggcgctcgcctgggtcgccggatcgctggtgccgaggatccgcggggcgagccgagagctcgcggccgttgcggacgcactcgaggggcggccgatcgcacccggtccggctggtgcgccgtctcgagggatggcgcacgtcttgccgactggtcggaacttctacgggctcgatccacgagcggtgccgagtcggctcgcctggcgtaccggccagcgtgcggcagccgcactgtgcgagcgctttcgacgcgacagcggcggcgagctccgtcacgcgagcatcgtgctctggggtaccgcggcgattcggaccggtggtgacgacgtcgcgctcgccctcgcgctgctcggggtggagccacgatgggacgcgatctcgggccgtgtggtcggcctcgagctcgtgccgctcgaacggctcggccgagcgcgtgtggatgtgaccgtgcggatctctgggctgttccgcgatgccttcgcccacgccattgcgctcatcgacgaggccgtcgagttggtcgccaaggcagccgacgagggcgatgcgaacccggtggctcagagcggggcgggccctcgcatcttcggcccaccgccgcgtgcctatggttcgggggtgctcgagctgatcgagcacggggcatgggagagttcggcagatctcgggcgcacatgggtgcgctggtcgcagcatgcctacgggcgcgggcgcagcggcgaggaggcgactggggcgctctgggatcgacttcgtagcgtcgaggcgatcgtgaaggcgcaggacaaccgggagcacgacatcttcgactccgacgactacctccaagagcacggcgggatgatcgccgcggcgcgcgcagccggcaacgtctcggttcggggctacttcggtgacacctcgcgaccggatgcacccacggtcaggagcatcgaggaggaggctgcgcgggtcgtccgtcagcgggtcgtgaacccgaagtggctcgaggggatgcgccgtcacggctacaagggcgcgttcgagatggcggcgacggtcgattatctcttcggctacgacgcgaccgccggggtcgcgcgcgactggatgtacgacgcggtgacggatgcgttcgttcgcgatcgcgagaaccgatcgttcctgctgcgcgtgaacccctcggcgctcggggcgatctgtgcgcgcttgctcgaggccgctcggcgcggcctgtggcacgccgacgacgaacgcctggctgcgctcgcggagggcagcctcgaggcagagggggccgaggagtgatccgcatcgacagcgtcgagggcaacgacgaggccaagctcgccatcgcactgctcgcggtcgatccgaccattggcggcgtcttgttcgtcggacctcctggcgtggcgaagtcgacgctcgcgcgttcgctcgccgaccttggcgaggacgcccccttcgtcgaggtgccgctcggtgcgaccgaggacagggtcaagggttcgatcgacgtcacgagtgcgctgcgcgacggcgacgtggtgctgcgccgaggtcttctcggcgctgccgacggtggcgtgctctatctcgacgaggtgaacctccagcccgatcacatcgtggatctgctgctcgatgcggcggcgaccggcgtcaatcgcgtcgagcgagacgggctgtcggccacggagccggcacgtttcgccctggtcgccaccatgaaccccgaggagggggccttgcgtccccagctacgcgatcgcttcgccatgctggtcgaggtcgggccgccccccacgcgagaggcgcgcctgcgggcgcttcggcgagcactgcgcggcgagaacccgagtgtcgacgccgaccgcagcaccgtcgtcgccgcacgagaacgtctctcgcaggtcgacatcggcgacgccatcgaggcagcggtcgacgccgcgatcgctgccgacgtagcctccttgcgtgcggacgtcgcgatggtgcgagcagcacgtgcgcacgctgcgctctcggggaagacggccgctggagccgacgacgtgagggcggtcgcgcccctgatcgtacgcgggcgaacagggagcgcaccacgcgtctcgtcggcgacgggagcctcccgcgctccgtccacgacgccacctccgccagcggtgcgttcgcccggggatgctcgcggtgagctcggcggtggggcagcggatcgcggcggctcggcgagctcggtgacgtcgtcctcggcgcgtcgaggtcccgatgaccgcgagggggtctcgtccgagggggtctcgtccgagggggtcgcgtcgacgagtgcgggtggcgaagccggcgacgctgccggcaccgataccgatggcgaggctgtagctggggagcgatgggcggcgggccagcgccacccgctggtcgggggagcgctctcgcgtgtgcgcgctcactcgggggcgttggggcgcgaggcccacgaactcggtgcctccaacgacgccggtgccatttcggtggcgcggagcgtgctcgcgcgactcgagcgtcaagggggaggcccgctgggtccggaggacctgcgccgaaccgagcgagcacgccgcgaggcgcgctgtgtcgtgctcctcgtcgacgcctcgggctcacaggctgccgaggtcgcgttggagatcgcttcgcaggttgccgaggaactgctcctgcatgcctaccaggcgagggcacacgtcgcggcggtggccttcggcggcgacggtgccaccgtcgtgctgcggcccacgcggtcgatcgaggtcgcccgggcgcgactcggtgcgatcgagcgccgcggtgcgacgccgctcgccgctggtttcgacgtcacggccgagctcgtggtgcagctgcgccatcgaggcatggagccgctcgtggtcgtggtgaccgatgggcgtccgacggtcggtgggcgcgggctcgggccgatcgaagcggccctcagcgctgctcgcgagctgggtcgcctcggtgtcgacggagtgatggtggaggtgggtcgcgcgtcgcgtgatggcctcgaactcgccgcgcgactcgcggccgaggccggtctcggtcacgtcgtcgctgctgatgcgtgagccagggcgtcggcgagcacggtgtcgagcatggctggcgtgaggcgtcgaggcgcggtgttctgcggactcgggtggtagctcgcgaggacgaggcggccacgtccgagttcgatgcgttctccatgtcggaaccggccgagcggctcgccgagcgctgcggccagagccgaccatgcgatcgcaccgagcgcgaccgcgcttcgccacggcacgagctcgagctcgcggacgaggtagggtctgcaggcggcgagctcgccagcacgaggccggttgtcggggggtgcgcagcgagcggcggcgctcagccagacgtcggtgaggacaaggccgtcgtcgcgactggtcgaggtcggctgattcgcaaggccgagtcgccacagcgctgcggtcaagaaggcggccgacgggtcgccggtgaacatgcggccgtgcgcgttcgcccctcggcgcgacggcgcgaggccgacgacgaggatgcgagcagccggatcgccgaagcctggcaccgggagggcgacccagtcggattggctggtggttcgccgccactcgacgagacgatcgcatcgacagcacgtgaggatgtcctgagcgagctgctcgagtgccgtggccatgtgcggagcctatccgtcgcggccggaatggcgacggccgcgcgagtgttacagacaataggcacaccgttgaggtacgaaaggagacgctatgcacgtccttggactcactgtgctggtagcacttggtatttggatcatcgtcgcgcttggagcacggtggtacaggtctgccgttgaggcccggtcgctggttgcgctggtgctcggcgtcgtcgtcgcctggctcgccaacatcgatctgtggcgcttgtggtcgctgcccgacctccgctacggctgggtgggcgtgacgctcaccggcctcgcactcggcgggctcgccctcctgtgggatggcgtgatcggactcgtgagcggcctgtaccgcaaggtcgaggacgaggccgagaccttggagcgacgtgatctgaagcgcgtcgcctgagccgaagctccacttcagcgggcgtcgtcggacgacgagcgtccagatgccagtcccgaggcggcaggcgtgtgcctgccgcctcgctcgcgtcgagcgcccgatcgcctcgcggggttcgtgcgctcggcggtgatggcagcgacgaggcgctcgagtagctccttgaggccgacgggttcgtcggcccggccgcactggtgttcgtggacctcggcgagctcctcgaagctcgcaagatcgccgtagcgtccctctcgctggcggagccacgaggcgatggggcagcgctcgtcacgctggtgcgcaaggggccgaccggcgcgtgctgcgacgaggctcgccagcaggggcaggtcgtcgagggggaagggcgcgatggaggcgaggagcgcccgtgcaccggagcggagcctggtcgggaccgtcggttgtggacgaccgagtccgtagccttggacgaagcgtcccccaatcgctcgccacatggcgaggtcctcggtggtctcgatcccttcgccgacgacctcgaccccggcgtagctcccgagcgcgagtgcagagagcgagcttgcgaacgaccgtgggtccgtcgcgagggaggccaccagcgagcggtcgaccttgagctggtcgatggggaggctgtggacgtaggccatcgacgcccagcctcggccgaagtcgtcgatcgcgatgcgagccccgagggcccggatcgcctcaagccgactcaccgcgctcgcgagatcgtcaccgagcgagtgggcctcggtgatctcgaggacgaggcgctcggtcgatgcggtgcggatgacgcgcgcgacgtcggccgcgaaggtgggcgtgaggaggtgacgcgccgcgatgttgacggccacggcgggcagtgaggggcgctcggcgaggagcgtgcaggcgtgctcgagcgcgtccaggtcgaggcgtcgggccaggtatgcatcgcgctcgaccacgtccatgaacgcatccgcggggacgacctctgccccgtcgtaccaacgcgcgaggagctcgacgccggcgagacggcccgcgacgaggtcgacctggggctgataccagaagcggacctggtcggtgccgatcgccgaggcgagcttcgtgcgcagacggtggcgacgatcggcaagccttgccatctcgtcttcgaagatgcgtgtgcgacctccaccctggctcttggcgtggtacatggcctcgtcggcgtgcgcgagcagcgtctccacgtcgacgccgacaggaccccagagcgcccaaccgaggctcgcgctgagcggtccgccgggggtgggcacggcggccgcggcgtgcaccgcctgcgacagggtcccgagatccatgctgtcgaggcgcgcgaggagtccgaactcgtcgccgccgaggcgcgccacgtagagctcaggagggagtgcggcgagcgacgcgccgacctcggcaaggatgcggtcgccctcggagtgtcggtagacgtcgttccattccttgaacccgtcgaggtcgaggatgccgagtgcgaggccgacaccgtcctcttcgacgcgacggcagcgtgcctcggcttcttcgaggaacgcccgtcggttcggcaggccggtcagcgcgtcgcgcagcgcgacggtccgttgggcatcgcgttcggcgcgcaaggtcgcctcgaggcggatgcgtgctcgctgggccgcgaggctggcggcaacgcgctcgagcagcagcaactcgcgattgccactgaccgggctgcgcacggctcgagcgcacaggacgaggtcggtggcgtcggggaccggggtggcgaacagccagtcttcggcaccggcacgggcttcggcccatcggacgggtcgtggcgagaggcggacctgtccggagtgaccttcgcgtcgcactcgctcgcacagacgtgacaaggcggtgcggcacggggcggcgaggtcgcgctcggacgagcgcgagagcccgagcgtcgtcgaaccggcgacgagcgccgcaaggtcgaagacgcctgtgtccacgaggctcttcgtcgtgacgtcggcgagttcggtctcggtccgacaggcaaggaggcgatccgagccggttgcgagcgcgtcgaagagtgccgcgagcgccacgcgttctgcgaagccggccgcggtctcgagcgcctcggtcgccgtgcgtccgatctgctcgagcagcgcggcgatccgttcggggtcgggcgccccgggttcgacgagcgcgacgagcactgctcggacctcgtcggcgaggacgagcgggatcgcgaccgcgagcggcacctggcggaggcgtggttcggctcgccagtggtcggggagctcgaggtgggaggccggtcggcgcaccacgtagcagcggcgcgcgtcgcgcgcgaggtcggggatggtgagctgtgtgccgtcggttcgtggttcggggagcagtccgacgacgctgcgcatcgtcccgtaggtggcgaggcgctcgaagcgtcgctccccgtcgctcgtggcgagcgcgtcgacagcaccaacgccgggcagctcggcgaggtggcgcgcgagctcgaggatcgtcgactcgggaggttggtcggtggtggagcggagccaggcgaccagtcgatccgtcgccgcctcgagctcgcgcgcccgcgcgcgacgctgctcttggtggagctcggctgcggcctgggcgagggcgtcgagcaccagcgccgtctcggggggcaggcgcgccaggtcggagcggtagagcgagaggagatagcgggtcccgtcgtcgcaggccgcggccgccgagagcgaaccttcgatgccgaagggtcgggctcgctcacgccagggcgcaaagatcgcatcgtcgaccgtggccacgacgggggagagcgaccggagggtcgtgcccgccggcccctgccccgagagcgaggtggggtcgtcggagagctcgaggtccgcacagtacgccttggccgtgccactggtggcgagaatggtcgcgtggtgctctccgggatcgaggcgcgcccagaacccggcgagcgtgggtgggacacacaaggtctcgagggcgtcggcgaggcgttcctcgaagcttcgtccgtcggcgcgccggagcacccgctgggcctggaaggcctgcagcacgagctcgaggaccgctgacggtcgctcgagcgcggggtcgacgacgctcatggtactcctcgcatacgctgcaactcagtatcgtacgccccagggcgctcttgagccctcggcgacggtcgagccctcggcgacggtcgagcccccggcgacggtcgagccggtgcggtaggctcccaccatgaacaagaccgagatcgtgcgagctcgcatcgacgacgacgaggttcgagcgccgatcggcacacttctcgtcgagctcgtggggcgcgacgtcccgcacgtgtgctatcacccgcagctcggcaccatcggtacgtgcgatacgtgcctcgtcgaggtcgatggccagctggcgcgagcctgtgaggtgtcgctccgcgaggggatgcaggtgcgtacgcgaggtgtggatgtgcgtgcggctcgcctgcgtgccgccggcgccctgctcgccaaccacgagctctactgcaccgtctgcgacaactccaacggcgactgtgtgctccacgagagcgtccgcgacctcggggtgaacgaggagctggtgccctttacgcccaagccctacgaggtcgacgcctcgcaccccatgtatcgctacgacccctcgcagtgcatcctctgcgggcgctgcgtgcaggcctgccaggaggtgcaggtcaacgagacgctcagcatcgattggtcgctggagcggccgcgggtcgtctgggacgggggcaagcccgccggcgaatcgagctgcgtgagctgtggccattgcgtgagcgtgtgtccgtgcaacgcgctcatggagaagagcatgctcggtcgcgccggcaccctcacggggctcggccgagctgcgctcggtccgctgatcgagctcaccaaggcgaccgagcctgcgatcggcctcgggcccatcttcgcgctctcggacgccgaggcgcagatccgtcgcggcctcgtgcaacggaccaagaccgtgtgtacctactgcggcgtcggctgcagtttcgatgtctggacgcgaggccgcgacgttctgcggatcgcgcccgagcgaggccccgccaacgggatctcgacctgcgtcaagggcaagttcggttggggcttcgtcgacgcgccagaccgcctggtgcggccgctcgtacgacgtgagggccacttcgaggaggcgagctgggacgacgcgctcgacgaggtcgccggccggttgcgtgcgatcgtcgccgagcacgggcctgacgccgtcggcatcatcgcctcctccaagtgctcgaacgaggaggcctatctcgcccagaagcttgcgcgggccgtcatcgggacgaacaacatcgacaactgctcgcgctactgtcagtcgccggccaccatgggcctgtggcgaaccgtgggctatggcggtgacgccggttcgatcagcgacatcgccgcagcagatctcgtggtcatcgttggctccaacaccgccgagagccaccctgtcatcgcgacgagggtgaagcgcgcgcacaaggaggggcgatcgaagttcatcgttgccgacctgcgccgccacgagatggcggagcgagcggacctgttcttgcgtccccggccgggtacggacctcgtgtggctggcggccgtgacgcgactgatcatcgaggagggactggccgacacgagctttctcgacgagcgcgtcgagggtttcgacgcctacgtcgagagccttgcggccttcgacctcgcgaccgcgacgcgcctcactggcctctccgaagagcagctgcgcctcacggcgcgcatgatcgccgaggccgaacgcgtgtgcgtgctctgggcgatgggagtcacccagcacgagggtggttcggacacctcgacggcgatctcgaacttgctcctcgtcaccggcaactatggccgaccgggcacgggggcctaccccttgcgtggccacaacaatgtccagggcgcgagcgactttggcgccatgcccacgtacttgcccggctatgagcccatcgccgacgacgaggtccgccagaagtggtcgacgctgtggggtgtggaggtcccggatcgacccggactcgacaaccaccagatgatcgacgcgatccacgccggctcgctgcgggcgctcgtcgtcatcggcgaggagctcggcatcgtggatgccaacgcgacctacgtccaagaagccctcggctcgctcgagctcttggtggtggctgatctcttcctgtcgcgaacggcgtcgtttgccgacgtcgtcctcccggccgcgccatcgctggagaaggaggggacgttcaccaacaccgagcgtcgcatccagcgcttctatcgggcgatggatccgctcggtgaggcacgtgcggactgggtctggctctgcgacctcgccaaccgcctgggcgccgggtggagctacgaccatccaggggccgtgatggccgaggctgccgcaggggctgcgatcttcgctggcgtcgactacgaacgactcgaggggtatgcgtccctccagtggccggtggcggccgacggaaccgattcgcccctgctctataccgagcgcttcgcgttcccatcggggcgcgctcgcctcgttcccgtgccctgggtcgagcccaccgagcaggtcgacgatgacttcgatctccatctgaacaatggccgcttgctcgagcacttccacgagggcaacatgacctatcgcaccgccgggatcgccgaggtgacgccggggcccttcgtcgaggtgtccgaagagctggccgccgaacgacacatccgcgacggagcgctcgtgcgcttggtgtcgcgccgaggtgccgtccgggttcgtgccctcgtgacggaccgtgtgcgaggacacgagctgtacttgccgatgaacgggcgtgccaacgaggaggcggtcaacgtcttgacgagctcgtcgaccgaccgggcgacccacacgcccgccttcaaggagctcgcggtgcgcctcgaggtgctcgacgaccccgtcgccgtcgcgctcccgaggcggaactggcgctacggccagcggacgccgcaacgaggcgtggacatcgccgctcgccgtgcccgacccgactacgtcgatcccacactgatccaaggaggtcgtcgccgtggctgaaccgctgacacgtgtgcccgcccgcgcggtggcgagctcgctggagcgcgagcgagccgacctcgcgcgtctcgtcgagacgatgggcgccccagcacgcgacgccgtcgcagcactcgctgcacggctcgacacgcccgcaggacgtcggggtgtcgagacgttgtcgtggctcgtacggctggtggtgacgctgccaccggagatggtcgctggacttgcgcgaggcctcgcagcggcgaatggcgccctctcggactcgtcgccgccgacggtcgccgagctcattcggctggcgagaagccccggggttcgtcggggcgtcaaggcgatcctgagcatcgtccacgagctcggcaccgccgaagcggcgcgtcggctgtaaccgcggacgcgtttcgaacgtcggacaagaggtgctgtgtcgaccgatgtcgtcgaggtgacatcgagcggcaacagggcgccttgcccgagcggcgttctctggttaccatgaggacgtggctcgggcggtggtgatcccacgcccgcggcccaccagcgcgggcggctccgcacagagcgtccggtggcagagcccagaaagggggtcggagccgatggaggctggcacgatcgaggagcagttcccgctcctccagcgcctgaacgaggatggtgaactcgtcggcgatctcggtgtggtcgacctcgaccgtctcgccgaggtctatcgccacatggtgatgttgcggcgcttcgacgagcgcgcgtggaacctccagcgtcaaggcgtcatcgggacctacgcgccctacaaggggcaagaggcggcgcagctcggtgcggcccacggcctcgcggagcaggactggttggtgccgacctatcgcgactgggccgcctcctgggcacgaggggtcccactcgagcacggcctcttcttcgcaaagggccatccccgtatgggcctggtgccagaggaggcgaccgtgctcccggcccaggtggtcatcgctgcccagacactccacggcgtcggtgtggcctggtcgctgaagctccgccacgagccgaaggttgcactcgtgacgttcggcgacggggccgccagccagggcgacacgcacgaggccatgaactttgcatcggtgtttcgagtcccgctcgtgttcttctgtgagaacaaccactgggcgatctcggtgccgctcgagcggcagatgcattctgagaccatcgcccagcgagccgtcgcctacggcatggagggcttccgtgtcgacggcaacgactacgtcgcggtcgtcaacctcgttcacgatctcgccgaacgcgcgcgccagggcgagggcccgttcctcgtcgaggcggtgacctatcggctcggggcgcacaccaccgccgacgatccctcgaagtatcgagagagcgcggaggaagagcgctgggaggcgaaggatccgatccggcgcatcgagcggctgctccagcgagagggtcgcctcgacgatgacgccatcgccgctgcggaggcgagcgctgccgaggcggtcgaaggcgtgctggagcggttccacagcgcgctcgacgacgagccggccacgctgttcgaccatgtctatgccgagctgaccccgcagctcgcggcccagcgcgatcggttcgtcgcgcgggtcaaggaggtcgagcgctgatggcgaagctcaccatggcccaggccctgaatcaagcgctcgcccaggcgctcgagggtgacgagcgcgtgctgatcctcggcgaggacgtcggacgcgacggcggtgtctttcgcattacggacggcctgatcgaccgattcggtcccgagcgggtcgtcgacacgccgctcgcggagtccgggatcgtgggaacgtccgtcggcctggcgatgggcggcatgcgacccatcgccgagatccagttcttcgggttcatctacgagaccatggaccagatcgcctcgcaggcggcccgcgtgcggtttcggtcgatggggcgcttcagcgcgccgctcgtgatccggaccccctacggcggtggtgtcaaggccccggagattcactccgattcactcgaggccttgttcgtacacacgccgggtatcaaggtcgtcacgccgtcgaacccctacgacgcgaagggtctcctgctcgccgccgtcgacgatcccgacccggtgctgttcctcgagccgatgcggttgtaccgtgcgttccgcgacgaggtgcccgaggaaccctatcgggtgcccctcggcgtcgcgaatgtcgttcgcgaggggcgcgacgtcaccttgatcggatggggcgcctcgatgcccgtggtgctccaggccgccgacgagctgatcgcacgccacgacgtcatgcccgaggtgatcgaccttcggacgctctctccgctcgacgaggcgacgatcgtccagagcgtgcagcacacccagcgagccgtggtcgtgcacgaggcggtgcgcaccgggggactcggcgcggaggtcgctgcgctcgtccaagagcgcgcgttcttgtatctcgaggcgccggtcggcagggtctcgggctacgacacgccctaccccatgaccatgttcgaggacctgtggctccctgacgcgacccaggtggtgagcgccgcgctggcagcggttcgctactagcccacgggcgctgggactcgtcgtcgggatcgttgcggccgtggcgccgcgtgagaggagcgcgcatggagtggaagtttccggacgttggcgagggcctgcacgaagcacaggtcgtcgcctggcacgtccacgagggcgacgcgatcgaacgggatgccccgctggtcgacgtcgagactgacaagtcggtggtgaccattccggcgccggtggccgggacggtcgagaagatcctcttccacgagggcgacaccgttcacgttggtgaggtcgtcgtggtgttcggcgacggcagcgcgccggcgccatcgccgctccagccgacggcgtccccggctcatgtcccggcaccgccggttgctccggcgccgacgcccgcgagtgagccgctagcgcgtggggtcgatcgaggcatcgtgctcgcgacgcctgccgtgcggcgcctcgcgcgagagctcggtgtcgaccttgcgagcgtcgtcgggagcggagaacgcggccgagtcctcgccgacgacgttcggcgcttcgcggcgtcgcccgagagcaccgagtcggccgtggccgcggtgtcgacgctgtcgaccggggcgcctcgcgccgatcgaggcgccggcgacgacggtgtcgcgccgctggccgtcgaggccgacgagcgtcggccgctggtcgggatccgcaagcgtatcgcggagaacatggcgcgttcgtggtcgcacgctgtgcaggtcacggtcgtcgaggaggtcgtcgtcgacgagctcgtggcgctccgtgagcgcatcaacgcccacctcggcgagcaacgcatcagctacctgccgattttcgtgaaggccgccgcgagcctgctggcgcgcttcccagagctcaacgcatcgctcgacgaggaggcatccgagctcgtctaccacgcccatcgcaacatcgggatcgccgtcgacgatccccaaggtctcatggtgcccgtggtgcgcgatgccgatcgccgctcgatcagggagctcggcctcgagctcgagcgcctcatccaaggtgcccgggcgcacaccttggggccgcgggacctgaccggctcgaccttcacgatcacgaacttcggttcgatcggcggcatcgtggcgacgccgatcatcaactatcccgacgtcgcgattctgggcgtcgggccgattcgccgccgtgctgtcgtgggcccggacgacgtcatcgtgccggcgtcggtgctgttcgtctcgttgaccttcgaccatcgcgtggtcgacggcgggacggcctcgcgctttctcgtcgcgctctcggagctgctccgagacccggctgccctcgtcgcggagctcgtgtgatggtggtcggggagctgatcgagacggtcgatctcctcgtcgtcggcgggggtccgggtggctacaccgccgcactccgagccgcacagctcggtcgggacgtggtcctcgtcgaggagggcgccatcggtggcgtctgcttgaacgtcgggtgcattccgtcaaaggcgctcatcgagacctcacgcgcctggcacggcctcggtgagctcgccgagcggggcgtgatggtcgcagacgcgtcgctcgatcgtgcgcgcgtccgccagagcgtcgaggcggcgcgcgatcgcctgacgggcggggtcgcgcagctgctcaaggcggcgggcgtcgaggtcgtcgagggccgagcggccttcgtcggcgcgaaccacgcgcgcgtccagagcgcgcacgaggcgacccaggtccagttccgtcaggcggtcgtggcgacggggtctgcggctcggcgtgtgccggggctcgaggtcgaccacgagcacatcctcgactcgacggatctgctgttccgggacgcaccgatcgagcggctcatcgtggtgggcggcggctacatcgggctcgaactcggcgcggcgtgggctcgtctcggtgcgaaggtcaccatcgtcgaggcgatggacgatgtgctcatgggggccgagccggaggtgcgtcgcgcgctgcgcgacgggctgggtcggctcggggtcgaggtgcggacccgcgcggtggtgtcgtcggtcgaggcggtcgccgacggggtcgtcgtcgggatcgagcagggcgcgggcgtcgacaagctcgcagccgacgtcgtcgcggtggtcgtgggtcgagagcctcgcctcgagccagagctcggcctcgaggctgcgggcgtcgcggtcgccgacggcagggtcgtggtcgatgtggcgcgccgcaccacgaaccccgcgatcttcgccatcggcgacattacgcccggtccgatgcttgctcacaaggcctacctcgaagccaaggttgcggccgaggcggcgagtggccacccgagcggcttcgatgctcgcgtcatcccggccgtcgtgttcgccgaacccgaggcggcctgggccggactcggagaggccgaggcacgggctcgctacggatcgatcgtcgtcggtcgcttcccgtatcgggccaacggccgggcggttgcggtgggctcgacctggggcgaggtcaaggtgatcgcacgcgccgatggcgaggtggtcggggtctggatcgtgggtgcggacgcctccaatctcatcagtgaggcagccctcgccatcgagatgggcgccacactcgacgacatcgcgctcaccatccacccgcatccgacgctgagcgagatgctgcccgaagccgcagaggtgggtctcggccggccgacgcacatcatcgtccgtacgcagtcgggcggtcgttagggggttcccggcgcatagctccgggggcggctatgcgcgcccgtggtcggcgcgagcgtcggctgcgagttcgtcgcgagctcgcggatcggcgaccatggtgatgatgcgttgcgcttgttcagtcgcgctcgcgccgaagaggtgggcgacaccgtgctccgaaacgatcgcggagtgctggaacgacgtcaccggcgtgtcgaggcaggcgcgcacgttcgaggcgtcggttggggagtgccaggagcgcagtgcgatgatggactggccctcgcgcgcatggagcgcaccgacggtgaagtcgggttgtccgccaaagccggagatgacgcgagggccgaggtggcacgcgttcgcctgcgcgaacagatccacctggagggcggcgttgatcgcggtcatgcgtggctggcgcatgatcatggcagggtcgttgatcgtctcggtccgaaggagacggagcctcgggttgcggtcggcccacgcatagagttcagccgagccaaagaggaacgacgcggtgatgggctcgctccgatcgagggcggctcgccgctccagggcgaggacgccgtcgctgatcatctcgctccagatcctcaagccacgtcgatcctccaagcgcgccaggacgcgatcggggatggcgccgataccgagctggagcgtggcgccgctcgggacaagacgtgcgacgtgctcggcgatggctgctgcctggggatcgtcggcgttgcgcgcgtccggcgaggacagcggcgcctctgcctcgatggcccagtcgatggcgtcggtctcgatctctccgtcgccgaagacgtagggcacatgagggttgagctgggcgatgacgaggccaccgtgcgagcgaacggcctcgatcgccgcaggcaagatgttgacctccgttccgagtgagacccgacccgcgatcggaagggacgtctggaccatcacgacgtcgggtacgagcgtggtggcgaggagggtcggcaccagcgacaggcgcatgggcagatagcgcagggcgtcgccttggtcgcggatggctgggccgaggaagggcgactcgtaggtgatgcccgggcgagccgggatcgggtgctgggcgttcaggatgaacaggcgccagcgttcgagttcggcctcggcggcgccgaggagggccgttggggtgaggaagttcccgcctgccacgatgcgcggctcacgacggccgatggcggcgagccgcttgcgtaacgtgtcgtctccgatgatctccatggcgggtgctcctacgggattggtcaatggttgggatcgtggtcggacacgtcggggtcgggtcggccgaggttcgggtcgatccgatcgagctcgagcgtcacgtcctcgccgcgctggacgcgcagtgagacgtaggcggcgacgccgacggggatcgggagccagaagttgaagatccgccacgtgaggacgccgaggatcgcgacacctcggggcgcaccgaatccggtcaggagggtgatcgcgagggtctcgacgaccccgagtccgctcggcgtgagcggcagcaccgcagcgacgttggcgatgccgtaggcgacgatgagcgcgaccgggttcatgagctggccgaacgccgccagcatgatccacagggtcgttgcatcgaagagccagttggcgagcgcccacgctgacgcgcgccggaggagctgcgggtcgcgcccgagtgcgcggagtcgctcggccgtttgagcgatggcgtgttcgatggagcgacgacgatgggcgagcggagggacgtggtcgatcaccgtaccgaccgcgtgctgggtgcgacggttgccacgggtgagcaggatcacgaccgcaatggagatcgccatcagcgcgacgccgaggacggcgacgacgaggtagacctcgttgaagccgtagaacgggagcgacacgagcagggcgagccacagcagtgcgttcaagatgagggcagatccgacgctctgggtcgcgagcgcgacaccggtgtcggccccgcgaacccccaggttcgacagcagccgcgcggtgagcccgacgccgctcgcggagccaccagggaggacgtgcgagaccgcaaggcccgcgaggtcgaccttggcgagctgcccgatgctcggcgtggggcgcgggagtaccgtctcggtgagcttcgcatacgcgaacagcgacagagcctcggccaaggcggcgagcggtaccagccaatagttggcgcggtcgaggagcgacagcgtcttgcgaaagcccgcgaattcgggaacgacgaggtactcgatcacgagcaggatgacgaaccctgcgagccctcgaatcgcgaagtgtcgtatgagcttgccgaggctcctacgggttccgcgcaggaccggtcgcggtgatgctgagtgtgatgccgcacgcgacgacgcagatgacgacccagaacgtgatgacgcagcgcgcccgagcgcgggaagcgtcagaccgagccacgaggggccgagtcgagcacgcggcgatgccccccgtccttcggtgctcacaacctcgtcagtctaacctgtcgagaggcgtcttggggcaatcggcgaggaggactcgatggtcgagcgacggagcctctcgctccgtgacctcctcatcgccgaggccgtggccgccgggctcggcgtcgcggtgtgggcgttcgccgtgcttcgtcacctcgagctcgagatcgtcgtggcgggtgttctcgcgctcgtcatcgaaccgatcgtctcgaggctcgtgcgtctcggactgccccgtgtcgtcgcggtgctcgtcaccgcggtgttggtgctcgccgcgctcgtcggcctcgcggccgcgttcgtcgttccgctcgtgaacgccggtcagcggctgctcggagatctcccgggcctgctcagccgcttgcgtgcccatcgagccgcgatcgaggcgctgctcgtgcgccttcacctccagcacgcgctcgacgtgggtgcgcagtcgatcgcccacgcggcgcagttggcggtgaccccggcgctgtccgtggcgagcggtgcggtcggttcgctcgccacgctcgcggtgatcggcacgctcgccgtgttcctctcgctcgaggcgccgaaagcgatcgcctggctggtggcgcagctcgatgcgtcgcggcgtcctcgtgtcgagggcgtcctgcacgacgtcgcgatcgcggtggcgggctacgtgctcggcaacctcgcgacttcggtggttgccggtctggtgatcggggtgacctatgcgatcctcggtctcccggacccagcactcatcggactgtgggtcgggctcgtcgatctcctgccgttggtcggtgggctcgcaggcggagtaccggcggtcgcgctcgcgctcgtcggcggacccgaggacgtcgtcatcgtgctgatcgtggtcctggcctaccagcagatcgaaaatcacgtgctcaatccggtcgtctatgcgaagacggtccggttgagtcccctctgggtcctcgtggccatcttggtcggcgcacaggctgcgtcgctgccgggagcgctcatcgccataccgatcgcgagtgcgatccaggtgatcgcgcgtgagacgctgcgcgatccgttgcggcgttggcttgggcgtggctcaggcgccgtggtcgcgcaggggaccgatctgccaaccccgagcacggacacgggcgacgagctcgtccaggctggcgagggtggcaaggggagccccgggggcgctggtgacgtcggagtcgtgcagcagcagcgtggcaccggggccgagccggtgcgtgaggtcggcgaggatcgaggtgctggacgcggcaaaccgccagtcgcgcccccagcttgaccaggtgacgaggcgaacgccttgctcgtgtgctgccagtcgcgttcctcgactcacgaccccgtaggggggtcggaaccacgtcggacgctggccgaccacctcttcgatcgcaccgacggcgcgggcgaggtcataacgcaccgagcgcgcggaacgcccgagatggttgcggtgccagtggccgtgcacggcgatctcgtgtccgcgctcggccaccaggcgcgcgacccatgggtagcgctcgacctcagagccgagcaggaagaaggtcgcgtggacgtcgagccgctcgagcgcgtcgaggatccgaggcgtggtcaccggactcggtccgtcgtcgaaggtcaaggcgacgtggtcgtcgaggccgatgccagcgacggctgggttgagccgccgtgcgatccaccagtggtgggtgagcgccgggccagcgtggttgacgagcgctgccgtacccacgacggcggcggcatggccccacttcatgggtgcgacctcacgcgctcagctccggggcgcgcgcgagctcgctcaccggagcgccgacgaggtggcgtgctgccagcgcctggcgggtggacgccgcgagcgccagtgcactcgcgacggaggcggtgggatcagcgacttcgacgatggaaccgggcgcgatcgtgcttgcgagcgctcgtggcgggatgatgcgggcggggatcacgctctggtggtgcagcgccgcccaggcgagatcgaccgcgttgatggtgttctgcggcacgtacacgttgacggggctgccaaggacggcgctgagcgccgcgcgtccgagctgaagatcattgacggggacgatgaggctgaggtcgccgatacgcgaacccgcgcccccgttgacgagcgcgacgcccgctgctccggccatcgccacggcggctgggtcacgacgaaccccgcgttcggtcacgacgacggcgatgtggtcgttgtgcagggcggcgtcgagtgccggcgacgcgaggtccggtgtcggcaggagcgccgcgagataggcaacgtgggtcggccgtgcggctgcggacaggttgaggccctcgtagccgatgaggcccgatgcgacgttgaccgcgacgaagacggacgcggcgctcgcgaccccgacgagtcctcgacggagcacaacgcgctggggggagagtgctggtcgcggcggagcctctgtcagcaggtcgaggatgggtgcttcgggggttgcctggaactgtgcgagcgccgggagcgtgagctcttcgggcgcggaggcgtagtggacgaccgcgtcgcggagttcgcgtacgttgcgtgcccagaacgtcacgccgctctcggccatcgcggcgacgttctcggcaccgtggccgacgatcggttcgtaggagatcaccggacggcgtgcggccatcgcctcgagcgatgacagtcctcccgcgttctggacgaccacgtccgaggcggcgagccagaggtcgacctcgttcgtccaaccgacggcgacgatcccgtcggccgcggctgcgcgcgctcggagctcctcgttgtgaccggcgagcacgacgggcaggacgtcgcccgtgctggccaacgctgcggcggtctcgacgagtttgcccaccccccacgaaccgccgacgatgagggcgatgcgcgcgtcaggcggcaagccgaggtggcgacgcgcgctggctcgctccggcagcatccggaagcgctcgtcgacgaagggcccgacgcgcacgacgggtccacgcaggtggccgcggcgcttggcctggacagcggcggtctcggcgaccgcgaggtggacgtcgatgtcggggtggatccacatcggatggacggagaagtcggtgaggaaggtgacgaggtggcggtccgcgacgcacgggtcacgccgcctgcggaactcgccgagcagctgcgcggggaagggatgggtcgcgatgacgatgtccgggtcgatcgtctggagccattcgcgaaccttcgcgccgaaggctcgtcggaacactgcgcgcgcgaccttggtcagtgcagggatgtgtgaccagagctcgaattcgagccgatacgcccagggcgcacgctcgacctcgacgcggaagacggtctcgagcatcgtgccgagacgtggggctgcgtcgaggaagtcgacgatgctgacgtcggcgccgtgacggccaagatgatcggcgatggcccttgccgccccgtcgtggccgccgccaaggcgcgcggacacgatcaggacgcgtggttgggacatcggggccagtgtatcgcatcgccgtacactgggcgaacagtggctctcttgctcgctctcggcgcggcgctcgcgtttgcgggggcgaccgtgctgcagttcgaggcgagccaggctgcgccgcgatcggcgtcgttgcggatcggactcgttcgccatctggtcggcgatcgtcgcttcaatctcggagcattgctcgacgtcgccgggggtgtggcacagttcttcgcgctcaaggtggggtcggtggaggtggtgatgccggtggtggcgagcggtctcgtgatcgcgatcgtggcgcaccacgtccaacgtcggctcgcgatcgtcccccgcgacgccgtggcgttggcggggtcggtcctcgcgctcgtcgtcgtgttggtcgtggcgccccagggaggctcgcgcctgggatcggtcgcggcccagctcgccgtcgccgcggcgggactcggtggcggcgccgtcgcgttgacggtcgggcgtcgggtgctgctgcgtcggggttggtacctcgccgcggccggcgggctcctgctcggggtggtgagtgtcgtggaacgctcggtcgggctcgtgtggagccaacggggaacgctcggcgtcctcgagagctggcagctgtggacactgctcgcagtgggtgcgctcgcgctcctcgtcgtccagagcgcgttcggcgctgcacggctgctcaccgtggcgccgatcgtcgcggtggcagagccgatcgtcgggagtgcgctcgccgtgtgggtcgagggggctggtccaggctttggccctggcaggctcgcgatcgtgttcggagcgatcgtgctcgaggcggtgtcgatcatcgcgttggcgcgaggagcccgcgacgagggaggggtccggtgagcggagtgcgcaaggtgctcgcgctgcacggtcagccgggttcgggtcggagtttcgatcctgtggccaggtggctcgggcgtctcgaattcgacgctcccgaccgaccgggatggggatccaatccattggcgcctcgggagctcgtcgcgcaggcatcgtgggccaaggagcggatcgacggcccgacggtgctcgtgggctactcgttcggtgcggcgatcgcggcgctcgtggcgccgacgtgcccggcggtggccggtgtcgtgctggtggctcctgccgtgacccgcgccgcgttggtctggagcgatcgcctcctcgccagggccggcgtcggacacgtcgcgggatcgttgatcgccgcagtggcggagcggtccgtgccggcggcgctgagtgcgcgggctcgccaggcgttcctggtcgagcagcgatcgctgctcgacaccatcgaccaggtggagacgtcgcttcggcggctcgacgtcccggtcatcgtcgtcgcgggtgctcgcgaccgcgtggtgcctccgcgcggcgccctacggctcctcgagtgcgtgccacaggctcggctcgtcgtctcccgcggtggtcacgatcagcttgcggacgaggcggccgtcgtcgccgatgccgttcgatccctggcctccgaacggagtgcgtgaccggggtgggaggtcttctgtatacgaatgggatccgccggctcgggcgatcggataacattggtacggacgaccggagcagtgggggcgtgctgcggacgtcgtggtgcggggggcacctggagcggcgaaggagccgggtgtcgtggagtcgatgaagctggcgacgtgggactgcgaagattggcgggtgcgtgcgcactgtcgcgacgttgatccgggtttgttctttcccgtgggcgtgacgggtgaggcagaggtccagatccgccgggccaagcgcgtctgtgcggactgtgacgtgcggctcgaatgcctcgagttcgcgttgcgcaccaaccaggagttcggtatctggggtggcaaagacgaggaggagcgtcgcgtgatacggcgtatccgtcgtttgcagcggcgagccgtgtcgcgagcgatctagccggcggcccggtttcgcctcgggcacgcggcggagccgtcgcgggtcctcgggccctggcgcactgtgatgggagcgcgggcgagtccgtcgaccgatctggacagcgctgtgtgcgtccgctgcgatgcgtgcggttgcgcggagacgacggcaaccgctgacgtcgggacgtcgccccgcgagtgtcaaggaggtgagcgccgcacggtaggacgtcgcgctggcgagccccaggtgtcgacctcacaacgtcggaaccggtgctccgtgcagtcggacacggtcggcgtgcgcgtagagacgaaatccctcggcacggagtccgccgacgaggacgatcccggcgtcctcggctgtggtgatcgcgcggtggctgggcgagccgagggcgatcaccgatcgggccccgatcgccgcggccttcaagacgagatcggtgccgatgcgacccgagaggatcacgtccgaaccggtcgcaagcgtgccggccagtgcagcgtgaccgatcgccttgtcgagggcgttgtggcggccgacatcttcgcctacagcgaccggcgacccctgtcgtgcaagaatcgccgagtgcgcggcacgtgtcaaggcaaacaagccgtctgcctcgctcacgagctcgtggagcgcgagaaggtcgtcgacgtcgatcggttccccgtgcggcgacgcggagacctggtgcaggcgccgttccagatcgtcggtaccgcaccagccgcacgagctcgtccgtacgctcggctgaggtgggacggcaaccgggtggcggaggacgaccgtcgcctgacggtaggcgggttcgcccgcactcggtggcggacagagcgacactccgacgacgtcgcgtggcgagatggcgagttcggtcacgacgagacccacggcgagcgcggtgtcctcacctggcgttcgcagtgtcgtggtcacaagctcgggcgctgcgtcagggcctttgacgaggatcgcaagtggctcctccgcgatcacccgctcggcgcggagccgaacgccacctgtccgatcgacaagtgtcacgcgtcttcgtggcgacgcgctctcgactgaccggttgcgctccaccgcaccatgctagctcaccggctcgatagcctgatgaccatggatcagctcgagctcttcgtcgacccggtctgtccgtggacgtggctgacctcgaggtggctcgagtccgtggaggccgagctcggcctcacagtgcgctactcggtggtctcgctcctcgagctcaacggcgacgatccgtcgaatccgtggatcgaggcgatgcgccagggtcgacgcctccaacgagtcatggtgcggctgctggcggccggtgatgacgctcgcgtgagcgcgctctaccgtgccgcaggtcgcgcgacgttcgagggtggtcgtacgctcgacgccgagctcgtccgcgagctcggggagggcctggggctgagcgatgaggacatcgcggccgcagacgatggtcggctcgacgccgccgtggtcacagagcaccagcgcgcgatgcgactcgcaggtccggacgtcggctccccgatcctggctcgtcgcggcggcgagaggggcttctacgggccgatcgtcgaccgccccctggcgccggacgaggcggttcgactctggcacatcgtcgaaggagtgctggataccccggcgttgttcgagatcaagcgcggacgggccgtcgagccccgattcgcctgaacgagcctcctcaggtaactgtggccccgaccaggtgaccaatcccaaaggtgacggcggcggccaacgcggcgagggcaagctgtcgaagggcactcgagacgaccggccgagccgacaacgctccgagcgcgcccccgaggccgagagccgcgagaccggcgagcccgatcgagagtcccgtcgcgagggtgccctgcgtgaagatccagggaacgagcggtacggctgcaccgagggagaacagcgcgaacgatgcgagcgccgcctggacgggagatccggtggcttcgggagcgacgccgagctcctcttgggcgtgaatgcgcagggctacgtcgggatcgcgcatgagatagcccgcgacggcggcggcgagatcgctcgggacgccacgctgctcgtagagctgctggagctcgagtgtctcggcttcgggtcgatgacggatctcggtgcgttccacgtcgagttcgcgctcgaggagttcacgctgcgcacgcatcgacacgtattcaccaatgcccatggagaacgccccggccacgaggccggcgataccggtgaggagcaccgtgtgccctgcgtgggaagccccgaggacgcccaggatcaacgcaacgttggtcaagagaccgtcggaagctccgaacaccgcagctctcgcgccgccaccggtgacgtcgcggtgctcgacgtggtgtgcctccatagctcctgaggctagccgcggaggccgagttcgccgagcgattcgtgccgcggtaggctgggcgtatgcgtgaactgaagctgatcgatcggtcgcaacctcagacgctggtgatcgcgtcgatcttgctgtatctgaacgccttgttcacgctgttcgagatgctgttcgtggggctctcgccgctcgagctgttgaccatggtggtgctcccgatcgtgggcgcgtacggaatcgcgaactctcggcgcatcggctactacctcgcgatcgcggctgccgcgatcccgttgctgacctacctctacttcggcatcctcggcgggatcggaaccatcctgtcctccggcgtgatcatcatcatctttgcgatcgtcccgttcgctctgttgctgcacccgatgtcgcgtgagtatcagcgcgtctggttccactagtcctcttcggcgcccctcgctggcgccatgtgaggccgacgaggcgtccgtagcctctgtctgcgtaccgacgggtgggggcgccggctcgtggtgcattcgacggtgtctcttcacaggccgctggtcacgggcagccgtgcagccccgcgcgcatgcttggcgtgccttcccacctgacgcgagcgtggcggtagcgcgatgagccccgacggacggcttcgccgagctcggctggtggcctcgagggcgttggatggccgcggtctacggcgccgcggagcgatcgacgggcggtgggagggcggcctgggtggcgccgcgtggcgtccgctcgccgtcggcgctctcggcaccctcgacgatctcggcgcgcaggcgtggcaggcaccacggataggtgcgctgcaggtaggcgatcagccgctcacgaacttcgcactggagattccacgacgccgtggagtcccgggcgctcatgaggaggcgcagctgcatcgtggacgtcccgaggctcgtgacctggaggcgtgcggtcttgccgtcccagtcgggagagtcagccacgatgtggaggaacgcctcgcgaatggcgtcgacgggagcggtgtagtcgacctcgacgtgcacccatccgaggatgtcggcggtggtcttcgtccagttctcgaaggcgttggaggtgaagtacgagatcgggagcacgaggcggcgcaggtcccagacccggaccaccacgtaggtcaggttgatctcttcgatccgaccccagtggccgtccacgacgacgacgtcgtcgaggcggatcggctgggcaagcgcaatctggatgcccgcgatgacgttggaggcgatcggtcgcgacgcgacgccggcgacgagggagacgatgccagcgctggcgaggaggccggctccggcgatgcgaacgctcgggaacgagaacagggcaagggccagtgcaacgatgacgatcacgacgaggaggatccggcggaagacgcgcagctgcgtctggaggcggcgggctcgaaggttgtccggaccctcgatgtggtagtggtacaagatggcgtcttcggcggcttcgagcaggcgagcgagggcccaggttccgaccgcatcgagtgcgagttcgatcccgtgggtgaggtcgccgatggtggcaccgggcaagcgcagcgagcgcaccaccatggccatggcgaggagcgggatcccggagcgcaccggtccgatgagtcggcgcagcgcggcggtgcgcacgctgttcgggtgccgacggttgacgacccgggtgatgcgcacgagggcagcagcgatgacgagccccacgacggtggcggcaccgagcgacggtaggatcaccaacagctggtgggcgatgctcacggcctgctcctttggctcgcacctcggcggcatcaggctagcgttggcatcacggctgacgaggcggcttcggagcggcctgctaccatcggctcatggcgtcaacgtctgtcgactcgctcgaagcgctccacgggctcgtcggtacccatctcggctactcggcctggttgacgatcactcaagagcgcatcgatcagtttgccgaggccacaggtgaccaccaatggatccatgtcgacccagtccgagcagcgtcgggaccgtttgggaccacgattgcccatggctacttgacgctgtcgctggtctcggccttgttgccggaggtgctcgacgtacgaggcgtcggtatggtggtcaactacggcgcgaatcgcatccggtttccagcgccggtgccggtcggatcgcgggttcggcttggggcggtgctcgcgagcttgagcgaaattgccggcggtgcgcaatcgcaggtcgacgtcacgatcgaggtcgagggatcgaccaagcctgccttggtcgccgagatcttgtttcgctactaccaggtctgacgggacaccgagccagcagctaggctcgtgtccgtgaagcggcgcgtgctctcagctgctctcgcggatgcgaccctcgtgccgcctcgccagggacgatctgaccgtatcgacggtgtcgatctggatcgcaccgaggccaagcgcctgcgtgcctgggcgacccgtcacatcacggcgcggcaggaggccttgtgggccgaggggcgacgatccctccttgtggtgctccaagggcttgacacggcgggcaaggacggcacgacgcgagcggtgtttcgcggggccgatccacaaggcgtgcgggtcgcctcgttcaaggctccgaccgcactcgagcttcgtcacgatttcctctggcgagtgcacgaggtcgccccagcggccggcgagatcgtcgtcttcaatcggtcgcactacgaagacctcatcgtgccgttggcgaacgggcagctcgacgacgcgggactcgacgagcgtgtggccgcgatcgaggcctttgaacgccatctccttgactcggctacagcgatcgtcaagttcttcttggacgtctcctacgaggtccagggcgagcgactgttggctcggttggagcgcccggagaagcactggaagttctctgagggtgaccttgccacgcgagagcgcttcggtcggtttcgggcggcctacgacaccgtgctggctcggaccagcttcgacttcgcaccgtggcgtcggatcccggctgatcgtcgctggtatcgcaacgcggtcgcggccgccatcgttgcccacgtcctcgaggtgatggatccggcgcctccggccgtggcgatcgagcatctccaccacatcgagcacgtcttgcgttccgaactggcgacgccgggagctgagccgtgatcgggttcgtcgttcgcaactggttccgtgactcgctcgagaccatgttcgtgatcgctatcggtggcatggtgacctcggtcctgcgccaggcccggcgtgggaacctgccgatctatcgctgcgaggcctgtggcggtgtgacgtcgcgtgcgtacgcggtgtgtcgtcactgcggtgcgccggtgcgctcctgaccgttgtggccgatgcgcaggaatgccacgccgggtgcgtaggttggcgggtctgatgagccaactgatcccgcccaagttcgagtcgcccgacgcaaagttgcgcgcggtcggcgcgatgttcgatcgagtcgcacctcgctacgacgcagccaatcgtgcgatgacgctcggactcgatctcaggtggcgtcggcgtctgctgcgtgagctcgccctggcccccggtgcccgcgtcctggatctcgcctgcggtacgggcgatttcttgcgcctgctcgccgaggagggtgccgcgccgatcggcctcgacctctccggtagaatgttgcgtgaagtccctccccacttcgatcgggtccaagccgcgggtgagtcgctcccgtttcgcgatgagagcttcgatgctgtggtgacagggttcgctgttcgaaactttgcgtcgccagaagcggtgttctcggaggtggcacgggtgctacgaccgggtggagcgctcgggatcatcgaggttgccactccacactggaggccggctcgtgccgttcatgcgtggtacttccagcgcgtggcgccgatcatcggctgggttgtcggtcgcgaccgtgaggcgtatcggtatctgcccgcgtcggtggcgttcttgcccgagccgttcgcgttcgctcgcatgctcgtcgaacgggacttcctgccgccgaagcggatgctggtcggcatgggtgcttcccagttgctcgtgacgcacaagaggcacggatgaggcagctcgtcggcctccgcgaggtgcgctcgctgggagggatgcggtccctctacggcatcatccatcgggccgagcagctcggtcggcccttcgaactcgtggaactcgacggtggtatcgtgctcggactcggggagccgagggtggccgagtccggagctccgggtccacggttccatgcgctccggttcggcgagtcgaccctcggccctggtcgctggtatcccgtggtcgtcgcggcggattggtcgcgcatcgccgtggtcggctacgaggccgaggacggcgcgttctcgagcgagcctgcggtctgggacatcgaggagcttgcctacgaccgagcgccgctcgtcggagcgttgatcgaccacgacctcgcgggtgcgcgagcgcgcatcgaggcggccatcgaaatggtgcgccagggcgcgctgcgcaagatcgtggttgcgagttgggcgtgctggcaaccctcggagcgtttctcgatcgctgcggcggcatcacgcctgaagcgtgagcacccgcacgcgcacctctatgcgagcccccactgggtcggtgcgaccccggagctgctcgcgaagacgtcggggtcgtgggcgcgtctcgagccactcgcggggacggcgcgtcggggggcgcaggcacgcctgctcgcgtcccgcaaggaccggctcgagcacgagctgatggtccagcagctcatcgaggatctcgctcaggtggccaaggagctgaagcgccccagcgcgccgttgctcttcgatgccggcccgtttgtgcatctcgcgacacccatcgcggccacgctcctgccaggtctcggttacgccgacctgctcgcggcgatcgtcccgaccgcagcggtcggtggtgtcccgcgtccggtcgctgctgacctcctcgccacgtgggagccgtggcgagggcagtacggaggcgccgtcggcgtgagcgatccgtctggtgacggcgagttctacctctcgatccgaggtgcgacgatcgacgacggcgggtgcgtccgcgtcgcagccggcggaggagtcgtcgagagctcctcggtcgatggcgaactcgccgagaccgtcgcgaaaatcaatgccgtcgctggcgtgttgggcgccgccaccttgtatgcctgagtggatccgcgttcgcggcgcgcgagagcacaacctccagaacgtctcggtggacgtgccacgcgatcgtctcgtggtcatcacgggtctgtcgggctcgggcaagagttcgctcgcgttcgacacgatcttcgccgagggacagcgtcgctacgtcgagtcgctgtcgtcgtatgcccggcagttcctcggtctcatggagaagcccgacgtcgatgtcatcgatgggctctcacctgccatcgcgatcgaccagaagtcggcttcgcacaatccccgctcgaccgtcgcgaccgtcacggagatctacgactacctgcgtttgctctacgcgcgcgtcggtcatccccactgcccatcgtgcggacgtgaggtgagccggcagacgccccaggacatcgtggactgggtcctcgcacgttatgagaacaggcgtttgctggtcgtggcgccgctcgttcgcggccgcaagggaacctacgacgagctgctcgaccgactggcgcgcgagggatggtcgcgcgtgctcgtggacggggtgctgtggtcgctcgacgaccgaggctccatcaacctggcgcgctacgaggcgcacaccatcgcggtggtcgtcgaccggatcgtgcccaagtccgccgaccgccagcgtctgaccgagtcggtggagacggcgctcaaggccgctggcggcgtcgtcgaggtcgtgccggtcggcgacgacggcgagctcggagcgggcgagcgcttctccgagacgctcgcctgtgccgtctgcggcatctcgctgggcgagctcgaacctcggagcttctcgttcaacagccccttcggtgcctgtccggcttgtggggggctcggggtccgcttcgtcgtcgacgaggatctcgtcatgcccgacccgaatcgctcggtcctccagggcggcgtcgtcgcgctcgggacgctgcgggccgatctcgttcgtcggcagatggagcgcgccctgcgcgccgcgggtttctcgctctcgactccggtcggcaagcttcccgaggcggcccgacgcctcatcctcgagggcgcttccgagccgatcgaggagcgctgggtcgatcgtgccggtcgtgagcgcagggcccaggtgacgttccagggcgtcgccgccttcctcgagcgacggcggagcgaggccgagtcggaggtggctcgtcagctcgccgagagcttcatgcgtgaggtgccgtgcgatgcctgcggcggcacccggttgcggccagaggcccggagcgtgaccgtcgatggggtgagcctcgacacgctcgtcaacgcctcgatccgccgtgcggtcgaggtggtggatgcgatgcgcttcggggagcgcgaggcgaccatcgccacccctgtgctgcgcgagattcgcgcacggctgcagttcctctgcgacgtggggctcgactacctgacgctcggtcgggcggcgagaacgctgtcgggcggggaggcccagcgcatccggcttgcctcgcagatcggctcgggcctcgccggggtgctctacgtgctcgacgagccgtcgatcgggctccaccagcgggacaatcgacgcttgatcgacacgctggtgcacctacgggatctcggcaacacggtgatcgtcgtcgagcacgacgaggagacgattcgcgccgcggactgggtggtcgatgtcggaccgggcgcgggcgagcacggcggcacgatcgtgcacgccggcacggtcgccgaactcgagacggtcgagtcctccctcaccggtgcctacctctcggggcgccgtgcgatcgacgtgccggtggctcggcgcatgcccgagcggggatggttgcgggtgctgggcgctcgcgagcacaacctggccgacatcgacgctgcgttcccgatcggccttttgacctgtgtgaccggggtatcggggtcgggcaagtcgacgttggtgaacgagatcttgttccgggcactcagggcgcagctgcaccgctcgcacgacgtccccggtcgccacaaggccatcgagggcatcgaactcgtcgacaaggtgatcgacatcgatcaggcaccgatcggccgcaccccgcgctcgaatcctgcgacctacaccggtctgttcgaccacgttcgccgtctcttcgccgagacacccgaagcgcgggctcgtggctatcgaccaggtcgcttctcgttcaacgtcaagggggggcgctgcgaggcgtgccaaggcgagggaacggttcgcatcgagatgaacttcctcgccgacgtgtacgtgacctgcgatgtctgtggcggctcgcgctacaaccgtgacaccctggagatccgctaccgtgggctcaccatcgccgacgtgctcgcgctctcggtcgaggaggcgttggcgttcttcgcgaagcagccggcgatcgcgcgccacctcacgacgctggccgaggtgggacttggttacgtccgtctcggtcaggcggccacgaccctttcgggcggcgaggcccagcgcgtcaagctcgcaaccgaactcgcgcggcgagcgaccgggcgaacggtctacatcctcgacgagccgacgacgggactgcacttcgaggacgtgcgcagcttgctcggggtgctgcactcgctggtggatcagggcaacacggtgatcgtgatcgagcacaacctcgacgtgatcaagacggccgactggatcatcgatctcggacccgaaggtggcagtggcggcggcaccgtcgtggcgcagggtacgccggaggacgtggcccaggtgcccagctcgcacacgggggccttcctcgctccgttgcttgggcgatgatggaccgtccggatctcgcagcgattcccgaggcgccaggcagctaccagttccgcgatggcgaggatcgggtcatctacgtcggcaaggcgcgcaacctgcgcgcgcgggtcggaagctacttccaagacccccgtcagctctcgccgaagacgcgggcgatgctcgcggtcgcgagccggctcacctggatcgtggtcccgagcgagcaggacgccctgctcctcgagtactcgctcatcaaggaacaccatccgcgctacaacatccgcctgcgagacgacaagtcctacccgatgatcgccgtgacggtcggggagcgctggccgcgcgcgatgatctatcgaggcaagcgtcgacgtggcgcccgctacttcggaccctacgccgacgccggggccgctcgcgaggtcctcgagctgttgcgtcgggcgttgccgctgcgcacgtgctcgccggccaagcttgcccagcacgaacgggccgggcgtccctgtctctacttcgacatcggacgctgcgtcgggccctgcatcggcgccgtggacgaggcaacgtaccgaggcctggtggacgaggtgacggggtttctcgagggccgagccggctcgctcgtcgacgccctcgagaccgagatgcacgccgccgcctcccgcctggagttcgaagaggccgcgaggctccgcgatcggctctcggcgatcgaagcggtgctcgagcgccagtcggtggcgctcgggcacgagcgagacctcgacgcgatcggggtgcatcgcgacgaactcgatctctacctcgaggtcgtgcgcgtacgccacgggcgcatcgtgggcgtgggtggcgcgcgggccgagcgagactcgggtgcgatgctcttcgacgaactcctcgacctggttcggagctactacgacgaccaggccatcgacgttcccccgaggatcgttgcgcgggtcgaggtcgccgaggcgagggaggcgacggacgccctgacctcgctccttggacgcccggtgcgcgtcgtgacgccgtaccgtcgtgagctcgccgtgctcgtcgagatcgccgagcgcaacgccgccctcgcgcaccagcgtgcccgcagagaacgcgccactgacctcgcgacgcgttcgaggggcttgaccgagctcggcgagctggcgggccttggggcgcctccggtccgcatcgagtgcttcgacatgagccacctgcaagggcgctcctacgtggggtcgatggtggtgatggaggacggcctcatgcgccacggggcctatcggcacttccgggtcagcgtgccgcacaacgacgacgtcggggccatgcgcgaggtgctctcgcgacgtctcgatcgtctcgatgaccggcgcttcggtgggcgccccgacctcatcgtgctcgatggcggggcaccgcagctcaacggcgtgctgcggctgctcgaggagcgcggcatggccggcacggtgcccgtggtcgcgctcgccaagtcgttcgaagagctctatgtccccgatcggagcgagccggtgcgcgtacctcgcgggacgctcgcgctctacctgctccaacagctccgggacgaggcccatcgcttcgcgatcacctatcaccgccggcgccgccagctcgatgccgagcgctccacgctcgagtccatcccgggactcggaccggcgagacgggcgcgcctgctcgccgagttcggatcgatctacgagatcgccgaggcaagtgaggcggagctcgtccgtgcgggtgtgccggctcgggtggcgagtgctgtccgcgagcgtctcgggccgctctatcgtcgagagcctgagagcgaccccgatgaggaggtcagatgaacctcgaggagttccgggccatgccggacgccgaggcgatggtgcgcgacctgtgggagacgcacgctcgctggtggcacgaccacttcaccgagggcgctgacgtcgagtacgtcgatcaggtgatccccgaggtgctggctcgggtcggtcaccctcgtcgcgtcgccgatatcggtggcggtgaggggcaggtcgcgagggcgatcgcgcgcgcgaccgcggccgaggtcgtggtcgtcgagccaagtggagcccaggcggccgcggcacgttcgcgcggatcgcaggtcgtccgtgggagcgccgaggccgttccgctcgcgtcgtccagcgtggacgtcgtcaccatcgtgctcgtgctcgagcacgtcctcgaccatgcggcggcgatgcgcgaggtcgctcggatactgcgaccgggaggtcggctcgtgttggcgctcaaccatccgatcatccaggtgcccgactctggactcgtcgaggacgtcgacgcgggcgagacctactggcgctttggtcactacctcgcgagcgacgcatcggtcgaggaggttgccgacggggtgtacatcccgttcgtccatcgtcccctcgaggcctacgtgcgggccgcgctcgatgcgggtctcgtgctgcgcgacttccgtgaaccggcgccgccggagcgatggctgcgcggccagagcggcggcggcttgctcgctgcgttgccgcgcctgctcatcaccgtgtgggagcgtgcgtgaacgcggtcgccttcgtcaccggcatgtccggagcgggccgctccacggtggccgaagcgctcgaggatgccggctggtacgtgatcgacaatgtgccgctctcgttggtgtcgaaggtggtggagctcgcgacccagggcggtgaggagcgcctcgcgctcgtcgtcgggcgcccgtacggggccgagttcgtgcggctcacggaactgctcgacgagctgcgcgctgccgacgtcgcggtgcgcgtgctgttcctcgacgccgaggacgacgtcttggtcgctcgcttcgaggcgaccaagcgccctcacccgcttggcggctccggcgggatcgccgccgccgtggagcaggagcggcgcctcctggagcccgctcgcgaactcgccgacaccatcgtcgacacctccgagctctccacgcacgagctgcgggcacgggtgctggccttcttcgagggccccggagagcggccgtcgctgcgggtcctcgtgtcctcgttcggtttcaagtacgggacgccccgtgacctcgacctcctcttcgacgtgcggttcctgcccaatccctactggcgccgcgagctgcgagcgctgagcggacgcgaccaggcggtgagggagttcgtcctcgagagcgccgatacgcgtggtttcctcgagcggctcgatgggctcctcgccttcgtcgtgccgcgctacgtggccgaggggcgggcctacctccacctcgggatcggatgcacaggcggtcgtcatcgctcagtcgtggtcgccgacgaggttgcgaccatgctgagcgctggggggctctcggtcgaggtccgtcatcgtgacatggagcggggctcgtgaacgcggtcgtcatcggcggtggccatggcatcggtgcgaccattcaggccatgcgggcgctcggcgcctcgatgagcgtggtggtcggggtagcggacgacggcggttcgacgggcctgctgcgcgctcgcgaaccggcgctccccgggatcggcgatgcgcgccacgcgctctcgagcttgatcggtccggacgagccgttcgcgcgcctcctggagcaccgtgttcgccacgcgtcgctccagccccatcccatcggcaatgcggccctggttgcgctctgggagcagacgggctcgctcgtggaggcactccgcgtgctcggggacctcgctggcgtgacggagcgactgctgcccgccgcagaggcgccgctcgtgctgcgagcgacgacggccgatggcgggaccatcactggtcagctggccatccaccttgcccggggcgttcgggaggtctcggtggatcccgcggacgcggtgtgtccgctcacggtggatgccatcgtgcgtgccgatgtcgtggtgctcggtccggggtcgctcttcacgtccgtcctcgcggccgcggtgtcgccggggatccgcgaggcgctctcgatcgcccgggcccgcgtcgtgttcgtcgccaatctcgcgcgccaggaggccgagacgatggagctcgatgccgacggtcacctcgagcgggtcctcgcacacggggtgcgcgtggatgccgtggtcgcggaccacggcttcacgccgagggctgcacgccatcgcgacgtgctcgtacgctcgtggcgtcttcgcggccaggagggcgcgcacgaccccacgcggctcgccgaagcgctcggggaagtgctcgacgcgctcggcgtccatcgatcgggggatcgcaaggggtagcgcgctgcgacgccacgtggtgtcaccaccgtgcttgactaaccttggggcggcgagtgggccactcggctgctcgagggaaaggagaggcgcatgcgggtcgcgatcaatggctttggtcgtatcgggcggatgttcctgcgcgcgatcgagcgaaccggttcggatctcgaggtggtggccatcaacgacctgacctcaccggccgtcaacgcgcagctgctgcggcgcgactcgacgcatgggccgttcccggcgcacgtggcgatcgagggcaacgatctcgtcgtcggagagcggcgaattcgtgtgctcgccgagcgtaaccctgctgacctgccgtggaaggagctcgaggtcgacatcgtcgtcgagtcgacgggcatcttcaccgacggcgacaaggctcgggcgcacctcgaggcgggcgctcgctccgtggtgatctcggcgcccgcgacgaacgtggacggtacgttcgtggtcggcgtgaacgacacgctctacgaccccgaacggcaccacatcatctcgaacgcgtcgtgcaccacgaactgtttcgtccccatggtcaaggtcatcaacgacgcgttcggtatcgagcgcggtctcatgacgaccgtgcacgcctacacgaacgaccagaacctgctcgatctgccgcacaaggacctgcggcgcgcacgggcggcggcgatcaacatcgtccccaccagcacgggcgcggctcgcgcgacgtcgctcgtcatccccgagatgcaggggcgtctcgacgggggcgcgatccgtgtgccggtcgtcgatgggtcgatcaccgacgtcaacgtggtggtgcgggccgaggtcggccgcgacgacgtgaacgaggcctttgcccgagcagctgcggcgggaccgctcgtcggcaagctcgtctactcggaggagccgctcgtctcgagcgacatcgtcgggtccccggcctcgtgcaccttcgatgctccgctgaccatgacgatgccgctcggcaacgggacgacgctcgtcaaggcgttcggctggtacgacaacgagaccggctactcgcaccggctcctcgacctcgtcgagatcgtcgccggtgggctcggagcgcgttgatggagctgccccgcatcgaggacctcggtgacctcaggggacgtcgggtcctcgttcgtgctgatctcaacgtcccgctcgccgtggaacgcggtgagtgggtggtggccgacgacttccggatccgcgcggcgttgccgacggtggagttcctgcgcactcgcggggccgacgtcacgctgtgctcgcacctcgggcggccgaagggtatcgatgctcgctactcgatggcgccggtcgccaaggttctcgagcagctcgcgcctggggtcgaggtactcgagaaccttcggttcgacccccgagagaccgcgaacgatccgagctttgcccaggagctcgcccacggccacgatgcgttcgtgctcgatgcctttggctctgcccaccgagcccacgcttcggtggtcggggtcccagcgctgctgccatcggcggcagggctgacgttgctggacgaagtagagcacctcagcgtgctcctcgaggacccgcctcggccctacgtcgcgatcgtcggtggcgcgaaggtctccgacaagctcggactgctcaccgcgcttgccgagcgtgtcgacgcggtgctcgtggggggtgcgatggccttcacgttcctcctcgctctcgggcacgaggtcggggactcgctggtcgaggaggaccatgtggaggcgtgtcgtgccctgatggaccgcgcgaccatccacctgcccgaagacctcgtcgtcctcgagagcaccgagccggtcggggccgaggtccacggccctgccggcagagtggtgggccgtgacgtgccgcgtggcacgcgcggcctcgacgtcggtcctcggacggtcgagcgcttcggcgaggtgatcctcggggcgcgctcgatcctctggaacggcccgatgggcctcttcgaggatccgcgcttcgccgtcggcactacgggtatcgcgcgagcggtcgctggttcgtcggcctacagcgtcgtgggtggcggcgactcggcgcgagcgctgcgcgaggctggcctcgccgaccaggtgagccacttgtccacgggcggtggggcgtcgctcgagttcctcgaacacggtgatctaccgggcctcgccgcactgcggcaagcggcggagcggcgtccatgagtcggcgggctcccgagcccgagccccaggcgggatccggacgggtgcgtctcgtcgtcgccaactggaagctgcaccacacgcacctcgaagccatcgcgttcttggagcggctgtggcacctgttggatgtcgaggactaccggcgcgcggagatcgcgatctgccctgcattcacggcgctgcggtcggcgcagctgacgatcgagaccgatggcatgccctatcggctcggtgcccaagacgtcttctgggaaccctcgggggcctacacgggggaggtgagcgtccccatgctcgccaagctggacgtcaagtacgtgatcgtggggcactctgagcgccggcgcttgttcggcgagaccgacgacgtggtcgccaagaaggcggcggcggtcgcgtccggtgggttggtaccgatcgtgtgcgtgggtgaggtcgccgaagagcgcgctgggggtaccacggaggccgtgctcgagcgccaactcgacacggtgctcacgacgtatccggtcgaggcgctcggagagctcgtgatcgcctacgaacccgtctgggcgatcggttcgggaacgcccgcgacgcccgaagacgccgagcacgtcgctcgcttcctccgggaccgcctcgcgcgccgggcgagcgaggcggtggctgctcgcgtccgcatcctctacggtggctccgtcgacgtgggcaatgcggtcgcgttcctcgcgcaggccgacatcgatggtctcctcgtcgggggtgcctcgctcgatccggagcgtttcgcgcagctgctcggcggccgaccccgcatcgcgtcgacgtcctagactgccattgttcgcagggaggaggactcatgttgaccgtcgtgctcgtcgtcgtgcaggtcgtcagcgcgatcgggatggtggtcttcgtcctgctgcactcgggcaagggtggtggattgtcggacctcatgggcggctcgagcttgagctcggccgcgagttcgtcggtggctgagcgcaatctcgaccacatcaccatcgtgctggcactggcgttcgccctgtcgagcatcgcgctcgggctccgcctgtagcgcgctcgggctccacggcgtgcgctggcgctgtcgtgcggctgtggcgggttctcgggtccctagggttgcgggtactgcggcgtgcgtctgctccggcggccagcgggtgcgggtcgagcagcacgggagcacggcgcgaaggtgtcctctccgccggcgggcatctctggggcgttctcgtccgaggtgcgcggcggggtggtggctctggcgggtgctgtcgcacgggtaccgacgccttcgggcgatgccacggccgaccgtcgtgggtgaggcgagatccgacgtcgcgcatgctcgtggcgaccccggtgagcagggtattgttggtgctttgcgactcaacctttggtgaaagtcgtcgatacgtccactatggaagcgttcgaggcatacctagctcggtgcccacgcgcactggtgctcctcgaggaggggctcgtgcgctgggtgaacgaggccgctgcccgattgcttcttcgtgacgcgtccgcgctgatcggtcagccattggacctggtcggaggggttcgcctcgaagagcttggcgatacgagtgtcgaggttgcgctgtgggcaggcgatggatcgctcctcgactgcatcgccgaggtcaccgtgctgggagaggcggtcatggtcgagctggacctggtcgagctgagtggtgtcgacgatgccggtcgagcactgcgggcgctcgccgatacgttgtcgctcggcgtgttcatctccgatcggggcctgcgactcgggtatgtgaatgcggggctcgcgacactgctcgccacgtcacgtgagcgactgagcggagctggctgggtggacatcttcgcaccggaggatcggcctgtcgttcgggagctggcgctgcgcgcactcggtggtgagcgcgtggaggcgatcatcgacgtgcagctcgagtccggtccacggcgtgcattggaggtcacgatcatgccggttcgtgcgagcgatggacgtttgagcttcgtcggcacggtcgctgaccggagtgtgcagcggcgagacgacgagcttgggagccggcccgcgacacgacaaggatgagcgtccatggagattcgcttcgatatcacctccggggatgcggtcgtcctcgctcgcttccttcggaccctcggcgatgacgaggccggcttcgccgagctcgctcaggtggcggctgcagaccccgggctcgctgcgagcatcctcaagctcgcgaactcgtcgtactatggactcgccggctccgtcgagcgactcgagttcgcgtgtgcgatcgtgggcatcctggggcttcgctcgctgaccgtggccgaactcgcgcggcgccaggggccctatcccgaggggcttgcggccttcacgacgttgctggccgcccagatggcggagcgctcgccccacacgagcgtcgacccgcaagtggcgctctcgaccgggctcgtggcgacgctcggttggatcctcgccgcgcagcaagatcccgtcggctatgcgacgtggcacgacctcgcgctcgaggatcgtcgagccttcgaggtggagcgttggggacgaccacttgcgagtctctcccaagaggcgcttcggcactgggcgtttcccgaagtgatcctcgatgccgtcggcgaactcgacgcggccggcgacgtgtcgaccctcgggcgtctccttcgagagagctggcgcgcggcgagcgagcgtctcgggcccgatggggccatgttgatgagcgtgtgagtccaaccaggcacgcggtcgccggaggcggcgtgcctagctcgggagtaccgtcaccagcgtgccgatgtggacctgcggatagagcacccccgcggtcgcgatgggcagctcgacgcagccgaggctctggggaaagccgtacgaggcacgggggaacccgtgcacggcgacggagccgttgaagtagttgatccagtgcacaaggtcgtggtagggggtgccgttcgggttcgtgccgctcatgtagttctcgacgaagcggaggtagatcggccaggtgccgacgggggtgttgagcccagcgatgccggtattgaccggactcgtcagcgtcacctgcccgttcacgtacagccagagcgtctccggtcgaaccttggacacgaggatgtaggagtagggatgcggatccatcgtccccgtcatcgcgtcgtgaatcagggtgggccagaggagcggattggagagcccggtatcgtcgaggccctcggcgtgctcgaacgacatgatcgcaccttgggtcatcaccgtgtcctggccgggctgccacaggctcgtgagcgcactcggcatcgtccagcgccatgagaacgtgccttgtggcgcgtccacgctcgcggcggcctgcgccgccagcgtcgatggggccgcctgggtcggcgtgaaggtcaaggggaggtagccgagctgagcgagcagctcctggaggcgcaggatcgacggggacgctccagcgagggtcacggcgtcggtggtctggccgagcgtaccgctcgagctcgccaacgtgacggcgtgagggaggtgcagtgtgaacgtctcaccgggccagaaatcgggcgtctggggggtgaagacgagggtgtagggggtcggtcgactccaggatcccgagaccgggtcggcgccggcgacagttggcgtgatggtggggttggtcgcgccgaagaccgtcgaggtcggggcggacagcgtgatcgagatcggcgtcgacggcgtgagaccggaggttcccggggagataatcgcgatcggagacgccgacccggtgcggaagaacgtcagctcgctcggtgcggcgagtgactcccacggggctggggcggccgcgatcgtgacgacgccagcgtgcaggccgctcgccgacgacacgacggtcaggcgccgcgatggctttgcgaggtggatgacctgcgaactcgtcggcgtcgtgatgcgcacggtactaacgggcgtcgagaagtagccagcgatcgacccatgggtcgagatcaccacgggatcgaggaggcgcgtcgtcggcgcgatgatcgtctgggtgacgttggtgcgggacccgaggagccaacgcagccagctcggcggtgcgagcgtcgcacgcacggtgatggtggtgccctgcgcgatggcgacacgggggacgatgcggccccggcgatcgacgacggagatggccttgccattcgcctcggccgagatcgccacgatgcgctcggcgatgccttgatgttccaggcgtacgatcccacgctcgctcgcactgagggacgttcgtggcagttcgagatacgcgatgccagcggcggccgcggcaacaacgacgccggccccgaccacgatgcgggtgttgcgccttcggacacgtctcgaacgatgcacgcccctcggtacctcctcgtcccctcgcgcagtcaacggcgcgggtggagtgtcgttgctagtgtaacgacactcggtggcgatttcctgagagacagggcggctgggaggggatgtggtcacgaagttcttcgtcgaggctctggtgacgttgctcgtgatcatcgatcccatcggcaacatcccgaccttcctggtcgtcacccgtggtcgggaccagcgtgcgcgccggcgcctcgccacggaggcggtgctcgtcgcggcggcggtgctcgcggtcttcgcgctcgccggttcccagatcctcgactatctcgggatctcgattcccgctcttgaggtgtcgggaggcctgttgctgctgatcgtggcgctcgagctgctgaccggtcggggtgggtcgatcggtaccacggaggagggtatctcggtggccgtggttccccttgcaaccccgctcatcgcgggtccgggcgccattgctgcggtgttggtgctggccaagcgagctgcgacagcgccactttcggtggcgctcgctggggcgttggtcggttcgatggtcatcttgtgggtcgtcttgcactacgcctcggccttggtccgcatcctgaaggagtcgggcatcgcgctcttgtcgcgggtgttcggcttgctcctggccgccatcgcggtccagctcgccgccgagggaatccgcggcttcgggctctagctggtccacggcggcctcgcgcggagccctcggtctggggggtcgggcaagaggacgtcgaacgagtctcgctggcgctgtggagtcgcctgtgatcgggatcgaggacgtgccccgatcggcccgaccgcgaccttggtgcgcggtgacgtacatccatggcgcagcccatcgaggcgagcgcacgagcgtgggctgggcgcagcgtgccacgttctcacgggaccgcgacgctgatcgcgtcctgcccacccgttcggcgagcacgcttgccgggaggtcgtcgaactctgcgcgcagggcccttatccgggtctcgtcgctcgcgaaggatctgtcggtcggggttcgccgagagctcggcggctcgctccgagcggccagcttgatgatccttgtgcgcgagatccccagacgcgcggcgatgcgagccttggggacgccctcggctaccagccgcctgacgagtgctcagtcttccacggtgatcacccttccctgttcgggtgttcactgttcaccggcgaagtcgttcagtccttgaacggctcgacagtcgcggccgggggccacccgtgtggggccgtgacgatgaccccacggcgtcgtgggagcgaggctctcgcgacgatctgtgcccgagcctggtgtctcggtgcgctggtcgagccgcgcgcctgtgtgctggtgaggtggccgggtgctcgcgcacgacgatgctcgcgcgccgcagcgagccatgaggtcggggcgccagctcctgggccgtcgagagcacgccgcacgcgccccaggcagcagcgtccctggcgtcgctcacgatcgcgcgtgcatgcgcctcgatgcggtcgcgcacgcgtcatctcagcgaggatggcgcgagccgcgatctgcgctcagaaggcctcatgagctccggtcggcgggtgggagcccgtgcggcgcgatctggtcgtgcgacgatgtcgaggctccgtgggaggctgcctcgcaggcgtggcattcgaactcgagcgtcgcgtgggtgatcccgtgcgcacgcgcgagccgttcgcggatcatgtcggcgagcagctgcgtctggtggagactgagacccgagcgtgcaacgatgtgggccgagagcgcattcgtctgttcgtcgaggcgccacaggtggaggtggtgcgccgcgatgacacccggcgtcgcctcgatcgtggctcgaactgcgctcggcgcgacaccacgtggtgcgagatccagcgagagtgcgacggcatcgcggatcatgcgccatgacgtggcggcgatcgtcgcggcgatgatggtggcagccgccgtttgggcgtcgtgaccgaggcgcgtctgtgtgagggacgctgcaaccagtgttgcgactccagccgcgaggtcggcaaggccatggaggccgagcgctcgcgcggttccggatgtgcggtggagccatgcctgcacgatcagcggagccgcgggcgcgagtgagagaacgcctgcgacgacgaggaccgagacggtgctcggcgtcgcggcgcgagcctgaacgacgacgccccacacgctcgcgagcgtgagggcaagggcaagggtcgcgcccacgaacgcgtccacgcgatgccagccgaaggtattgcgctcgtcgggcccgtgctcggcgaatcgtcgcgctgcgaccccgagggcgagcgtgccgaggtccatcgccacgtgcaccgcgtcttcaccgacgagcgcactgtgggctccgatcgcgagcaccacgagcgcgacggccgcgacgacggcgagcatgacgctcccgatggcactcgcgtggcgatgcatggctcttctagtctaggtcgtcgccgtgggcgacctcggggaatgatcggccgcgaccatcccgcggcgcgtgtggccccgccttcaggtgggagtggagtcacggtcgcgaggtggttgctcccgcgcacgagcgcgtgaatctggtccgtacgcagcgggctaggatcgtcgttggtagatgtccgggtgagccgacgaaaccctaggaggatcgcagtgacagcagatgctcagacgctgggcgtgatcaagcttggtgatattgcgcccgactttgaggccgagacgacgaagggcaagattcgcttccacgagtggctcggcgatgcctggggcatcttgttctcgcacccgcgcgactttacgccggtctgcacgacggagctcggtgaggtggctcgcctgcgctcggagttcgagtcgcgtggtgttcgtgtcatcgggctgtcggtcgacgacgtcgagtcccaccacacgtgggaggccgacatcgccgacatcgccggcgcggagatgtggttcccgatgatcgcggatccagaccggacggtgtcgtcgctctatgggatggtgcaccccaacgagctcgactcggcgacggtgcgctcggtgttcatcatcgaccccgccaagcgcgtacgcctcatgatcacctatcccgcctcggtgggtcggaacttcgccgagatcgtgcgggtgatcgatgctctccagcggacgtcgcgctacccagtggtgaccccagccaactggacgccaggccaacgtgtcatcctcgcgacctcggtgccgaccgatcaggcgcgtgcggcggtgggccacgacgccgaggagattcggccgtacctgcgtctcgtcgccgacccaggcaccaactagtcgacgacgctcgagcctctctccgtcgagtcgtgccgcggggccgtcccgcggcacgacggtattcggggcccctgcgaggtcctggaggcgtgggcgctgtcgtggcgctggccgagtcgttcaccagtcggttccagcgcgccgggttgcccaagcccagggctcggcacgtgctagcgtcgagcgcggagaggaggggcagtgcgtatcgcggcccaagtcgactacgccggggacgtgcgccaggcggccgacacggtcgctcgctgggaggatgcgggcgtcgacgtcgccttcgtgccagaggcctacggtcaagatgcgatcagccttctcggttacctggcggctcgtaccgagcacatgttgctcgggcccggcattcttccgatcttctcgcgaacgccagcgctgattgcacagactgcggtcggtctcgacgtggtctcggggggccgtgcggtgctcgggctcggtgcatcgggtccgcaggtcgtggaggggtggcacggggtcgcctacgatcgcccgttggctcgcacgcgagaggtcgtcgagatttgccgtacgatctggcgccgcgagcctctcgttcaccacggcatctacgaacttcccgcgaccgggcccggcacgacggggctcggcaagccgctcaagctcatcacccacccgccgcgcgagcggatcccgatctacctggccgccatcggggcgcgcaacgtcgcgctcgcggcggagatcgccgaaggttggcttcccatcctgttctcaccggagcgtgcggatgcggtgtggggcgagtctctcgaagccgggcgtgcggcgcgcgatgcctcgctcgggccgctcgacatcgtcgccggggggatcgtctcgatcggtccggatcgcgaggcgctccgtgatctcgctcggccgttcgtcgcgctctacgtggggggtatgggcgctcgcgggcgcaacttctaccacgacgtgctcgtacgttacggattcgaggaggctgcggacgcgatccaagagcgctacctggcccacgatcggcacggcgccgaggcggcggtgcccgaggcgttgctccgcgaactcacgctcgtcggtacggaggcagaagttgcggcgagactcgatgcctgggcccgagctggggtgacgacgctgctcgcgacgccggtcggtccggacccgctcgggacgctgaagcgtctcgcagcgctcgcgcggtagcggtgacgagtcgatcggtgctcgagcgctctctgggtgtgctcggcgtcgtggcaggtgcgtgtggtcttgctcgacttggcgatccgttgcccgtggcacgcgagacccctcgcggccatgtggtggtggccatccctgctcacaacgaggcacgacacatcgatgtcgtgctcgcctcgatccgacgacagcgctgcgagcacctcgatgtgcgcctggtcgtggtcgacgacgcgagcgacgacgagacggcggagcgcgcgcggcgcgccggtgcacacgtcatctccgcgggtcccgtcgccgacggcgtcaatccgaaggcagccgccctcgcacacgtcgacctcggtgatgccgactgggtgctgtttgtcgacgcggacgtcgagttcgttgcggacgacggcctggcgcgcttgatcgcgatggtggagaccaacgatggggggctcgtgtcggtccagccgcgcccacgcctcgacggctggtgggcaccactgacggcctggctgtggctggtgccgatggttgcgagtggggccttctggccgggtgcgcgccatcggtcgcgggtggccttcggcccggtgctcgcgatgcggacgtcgacctgtcggagcatcggtggtcacgcggcacttgcgagtgaggcggtcgacgacgtcgcgatggcggcggcggtacgtcgtcgtggcgagcgcgtcgtggtctgggctgggggcgatgccgtgcagatggacccgtacgagggcctcgccgagacggtggctggtctgcgcaagaacatcgtcatcggcgccggtgcggccggtgcgctcccatccttcggtgcggtcgcttgggtggtcggcacgatcggggcactcgctcgactgcgccgcggtgactggagggctctcccgacggcgctcggaggtcttggtgtcgcggtcctcggagcgcgtcggcttcgacttgctcgttggaggcacgtgtgcctggtcaccgcgggcctgggcctcctcgtcgcgacgaccgcgctgtcggtcgtcgacatgctccgggggcagacacggtggcacgggcgacggctacggcttcgctagcgattcgcgtcgctctcgccatcggctggtgggtgggcctcagcgtcgtggtcggctgggtcgcgtcgcgcctccggccccgaggcctcgcgttggtcggcaccttcttggcgactcgttcgttcgagggcgacggccatggctacgaacggctcggggtgcgtcgctggaagcgcctcttgcccgatgccggcggagccttcggaggccgccgcaagcgtctcttcgggccccgtgggaccggtgggcgcgaggcgctcgcgcgcgaggtcgaccgcgccgaggcggtgcactggtgcctgctcgtcgtgcaatgggctccggcgctctggttgggtccgctgtggtggctcggccctgcgtatgcgatcggtgcgaatgtgccgttcatcttggtcctccgctacgtgcgggcacgattgaccgcgctcgggcgcagacggccctgagtcggcgctgcagttccatgcgatcgtgcgagcgaccgtggcttcgcgtcgtcgagcagggctcgcgcgtgccctggccgccgcgtactgcgtccgccggcgagcgagggaggcggctccggcgcgctgatcgtggccgggctcctctgtgcgcgaggagtcgaacgtcctccgaccgactccggcgccggtgcacgtctcgatcaactctcggaggaggcgaaggtgacgactccgggaacgtcgagctcgccgtgtctctctacgacgattgaccgtctctgtgcagacggggctcggcggcttgctcattcctcgccgtctagcgggtagcaacccggagaagtgttggccaaccaccgggtgcgtccggtaggtgagcggtccccacagccagacgccccggtgcgagcccgggatccccacgccaactctcgctggtgccgctgagcgccgatcaggtcatgggtgcgcagtgacaccagtcactgcgacggcgaggacggaatcgagaggagggcctggttggcgggtccagatccttgcttgccggtgtcgcagacggcttggccgttggcggtgcggtgacacgcgccgccagggagcttggtctggatgacggcccggggtgacgggagcagcctcggaggcgtcggtctcggccggaacgtcccatgcgtgcacgagagagtcgaagtccccggccccgaggcgaggcggtgtcactcgcctcgtgcgtcgacctgtccgccttcgcgagggcgcagcatagagctgcggtagtagcgcagctcggcgatcgagtcccgtacgtcgtcgagcgcgcgatgcgcggggttcttctgcggcatgtgctcgatgacctcggggtaccagcggcgcgcgagctccttgaggctggagacgtcgatcgatcggtagtggagcagggcctcgaccttgggcatgtggcgcgcgagaaaccgacgatcggtgccgatggagttgccgcacaggggcacctggtggggatcgggaagatgggccttcaagaaggcgaggacggtcgattcggcctcgtcgatggtgagcgacgctcgccggacgtcttcgaggaggtggttggcagagtgcatctgcacgacgacgggctccatcaccgccagctcctcgtcggttgcgtggaggacgagcgggccgagctcggcaacggtttcgagttcgtcgtcggtcacgatggcggcgatctcgagaatgacgcaccgctcagggtcgagacctgtcatctcgaggtccatccatgcgagcacgcgcccaggctagccaacgaccaggctaccctggcccgtgggtcaaaggaggacgcgtggaggaggtgccgtcgtcacgaccatgggtcgtgatcccgacgtacaacgaagtcgacaacatcgggcccatgctcggagcggtgctcgcggcggtacccgaggcgcacgtgctggtggtcgatgatggctctcccgatggcaccgcggcggcggtgcgcgccgtctcggagcgggacgagcgcgttcgtttgctggcacgggaacagaagacgggactcggcggcgcctatcgagacggcttcaaggtggcgatctcggagggagcgaccagcgtggtcgagatcgacgccgacttttcgcacgatcccgcggcgattcctgcgctcctcgcggcgctcgacgacggtgccgcgctcgcgattgggtcgcgctacgtgcttgggggtcgctcgccaggattgtcgagagagcgtcttgcactgtcgcgcgggggcaatctctacgcggcgttcatgctcggcctaccggtgcgtgacgcaacggcagggtttcgcgcgtatcggacggacgtcattcacgaggtcggctttcgttcctcgcgtgccgatggctacggcttccaggtggaactcacgcgcctcgtcaacgacgcaggctatcggatcgtggagattccgatcacgtttcgtgatcggcgagcgggcacatcgaagatgtcggccaagatcgtggtcgaggccatggtgctgtgcacgatttggggtatcggacgtcggttcccgtggctcaacgagcaacggcaggaggcgctcatcgaccgcctcggcgccgtcgtcgatcggggagcgcgcctgtggtcgacgaggcgttgagtctgcgggtcaagcggctcagtcccggcgcagtgctgccgtcgtatgcacgggcgctcgacgcggggctcgatctcgccagcatcgaagagaggacactggcgccgggggagcggcacgggtttcgaaccggtctcgcgctcgagcttccggtcgggacgctgggactcgtcttgccccggagtgggagggcgcttcgagagggcctcacggtggtgaatgcgccgggcctgatcgacgcaggctatcgaggcgaagtactcgtggcgctggtgaaccttggcgaggctccagtcgtgattcggccgggcgagcgcatcgcgcagctcgtggtgctgccgttcccgagcgtacgggtgctggaggtcactgaacttgcggcgagcgaacgcggatccggaggctttggccacagcggctgagctcacgtgtgaagcaggctgccgacgcagctgttcgatcggccgggggcctcgctcgctatactgaggggcgctgcggacgtggctcagttggtagagcatcaccttgccaaggtgagggtcgcgggttcgagtcccgtcgtccgctctcagacgacctgcagcgatgcgggtcgtcgttcgttgtgggctgggcctgctcgtgagcaggcgtcgtgtgacgcgcggggatgccttacgccggcccgtgatccacggaagccggccgctgtgtcgttcgaccgctgtcgccgtgatgtggactgttctgcggacaccgcacgcactccttgcgccggagggcgtggccgtgacggtcgcgtaccgcgatggagcggccgtggctcggcgctcgctcggcgcgtcgtggcaggccattcaccgcccgaaccagcctggcgagtgtaacgggcgtgttacgttcgtcgggtggccttcggcgacgctgtggatcgtcgctagggtcttctcgggagggtgagggtggatgcatgtagatgatgcgcaggccgcgacggccacggttgatgatgagtatcgggcgtttcgggtcgagtcacgaggtatcgagctcatcccggagacggagcgacccatgcggccggcagacctgttctggatgtgggctggcggcatctggaacgtcgaatacctcgtctacggcgcgctcatcgtttctttcggtctgtcgttcgctcaagcagtgctggcgatcatcgtcggcaatgtgttcttcgcgttccttggtctcgcgtcgttgcaggggccgctcgcgggcacgactgcgttcggtgtgagccgggcgccctttggtcggctcggcaaccggcttccatcgctgttcaattggatcacccaggtcgggttcgagatcgaagggcttgtgctcatcgtgctcgtcgtcgaggcgatgttcgcccacgaaggcgtgtcggtcggcaccggcctcaaggttgcgctgatcgtggcggctgtgctcgtccagttcatcgtgccgttcctcggtcacgcgacgatcgccaagctgctcaggtacctctcgatcgtcttcatcatcgtgtttgcggtgatgggcgtgctgattgcgccgcacgtccatccctcgagcgaccacaagcatgcctcgtgggccatctggacgaccgccgtcgtgctgttggtctcggctggggggctcgggtggaccgagaacgccaacgactactcccgctatctcccctcatccaccccgaaggcctcgatcttctgggcggcgacccttggcggtgcgatcccagcgatcttggtcgagctcctcggtgctgccgcgttcttggtgagtccgcaggcgacggcggtcaccggcgtcccctcgtcgtttgcgagctggttcttctggccgttcatgatcctcgtgcttccgcaggtcttcgcgatcaactcgctggacctctactcgtcgggtgtcacgctgcaggcgcttggcatcccggtgaaccgctggggtgcggtgatcatcgacaccatcatctccgggctggtcacggcgctcgtcatcttcaagggaaacttctataccgatctgtcggggttcctcgactacatcgtcgtctggctcgcgccgtggttcgccatcgtcttcgtcgactatctgctgcggcgcgggcgctacgaccgtgcgggtcttgccgccgtacgcggtggtgtctattggcgcaatggcggcatcaactggcgtgcgatcgctgcgctcatcgtcggcatgggtgcggcgctcctgtggatcgatgcccagttctacgtcccctcgttcctcggaccgatctcgcgtgcgaccggcgggtctgacctcagctgggtgctcgggatcgtggtgggcggtctcgtgtactacgcgcttgcgcgaggtgaggtgcgccgggaggtcgaagcaaccgagcgaggggtggccggcgcagaggcggtggagtaggacgcgacgcggttcggcggggtcggtgctcgggcgatcgagggtcgaggaaggtcgctgacgcatgtcgccggagactcgctaaggtcctgttcgtcgagggaccagacggatcgcaggaggagttgacggtgggactgaccgctcgcgttggacgcttgctcggacgagtcgcgctggcgcccatcttcatcgtcgctggcttcgaggccctgcgagaccctgggcatcgtccggaggtcgccgcgaaggcgggcctcccgagcccggagctgctggtgcgcctcaacggggctgcgatggtcgcaggcggtcttggtctcgcgaccgggctacggcggcgtctcgcagcccttgggctcatcgcatcgctgggagcgacgacggtcgtcggtcatccgttctggcgcgaggagcccgggccaggccggacgatgcagcgagtgcagtttctgaagaacctcggacttctgggcgggctggccctcgtggtgtgcgatcctggtcgcgaccgcgacgcgtgacgtgtcgttgatggggagccacgtgggtgctccgcgacgttcgctggctgccacgatcgcgacgagttgtgacgctgcgttcacaggatgggactcggccggccttggtgtcggctctacgctggcggtgtgaaggagtggtcaggccgagcgcgtcgccagcaggctcgacgtgctggcgcatcacccgttggcggggcggggatggttggcttaccggcgcgtgccgtcgtctcagcggtggcggcggtgagctggatgatcgtcggggtcgtcatcgtggccgccgttcacgcgagctggcatgtcgaagccggactgttcgcgttcggcgtcggcgtcgtctgggcacggggggcgctcagagccgtcaacgcgcgttgagggcggaggtggcgtgaaccacgccgagggatcggtggtcgatcacttccagctggtggcactgctgggggtcggaggtttcgcggaggtgtggcgagcacacgatctcacgaccggtggcgaggtcgtcctgaagttccccactccacagctggttgccgaccccgtcctcttccagcgctaccagcgggagatcgccatctggcggaagctcgaccacccgggggtcgtgcggtgcgtcgacgatggccaacggcggagcgagccgtatctcgtgctcgagttcgtcgacggggtcacgctgcgacggtggctgaacgatcatccagggccggttccggtgaccctcgtcgtggcctgggctcgtcagctcgccgaagccctcgactacctgcacgggcgtggcgtcgtgcatcgcgacctcaagcctgagaacatcttggtgtcgtcgtccggggtgctcaagatcggcgatttcggaactgcggtcagtcgaggggcgcggaggctgacctgggggcagttgtctccggccatggggacacccgactatatgagccctgagcaggtgcggggacggcgcggcgatgagcgcagcgatctctatgcgtggggtgcgatcgtctacgagcttgcgaccggtcgacctccctttcgtggtgattcgtggctggcggtgatgactgcgcacctgcagcaggcgcccgaaccattgcgccaacggcggccggaactgccgccgggcctcgaggccatcgtcctccatgcgctgcggcggttccccgagcaccgttaccagcatgcacgtgaggtgctggaggatctcgaacgcatcgatgagcttggcagcgatacgtactcgttggcgccggagcagccgatcggtgacgtcgtggccgcgaccacgagcgggcgtcggctggtgtggttcgtggtcggggtcgccgtgggctttctcgcgctcgccgcggcggtgctcgtcgtggcggcgcaccactagggcgagccggttgaaggagggagcagggtgacgggacagcgaacgtggatgcgggcgtgtttcgtggatctctttggcgagctgcgctcggtgacggtgtcgggggtggaggtgacgagccacctggtggtcgatgcgtcggccatcgagggcgggatccgcgtcctcgagtctgactgctcactggatctcaccgccgcggctcgcctcgtaggtccggagggggagcgtctcgtcggcatcgtgcgctcaccggacggggtgccgtcgccgttggatacgcgcgccgcactcgcgcgcatcagtgcggagctcgatcccgagacgcgttggcgcgggatcgcggagctcgagtggtactgcttcgacgagcacggcgatccggtggacgaggcgggctacttcgacgatgtggtgggcatcggtggcgcgatcgcgcgagccgcctacgccaggttgtccgacagtggcataccggtgctagcgtcgcaccacgaggctgggcccggtcagtgggagctcgatctcggcccgctcgatgcgtgtgcactcgccgatgccgtggtgctcgcacgagctgcagtgcgtgacgctgccgtggagttcggggccacggcgtcgttcgcggcccgtccgctgccgggacaaccgggttcggggctccacctccatgaggtgctcgcgcccgaggtgaccgagtcgctgatccgcgcccgtgttgggggcctgctggatcatgcccctggcctgtgcgcgctcgccgctccgacggtcgggtcctatcggcgtctccacgccggcccggaggcaccgagcgcggcgctgtgggcgcacgagcatcgcggtgcgctggtgcgggtcgcgacggcggtcgacgggacccgatccatcgagtaccgcggtgcggacccgtcggcgaacccgtgcatcgcgatcgcagggatcatcgtcgcggcggcccatggcgcccaggagggtagcgaccctggcgaggcgatggacgaagatccggagggcttcgatcccctggcccgaacggcagccttcacgccgctcccgaggagtctcgatgaggccgtcgacgcgctcctggccgatgacgtgctcgtggacgcgttcgacgaccggctcattcatcgcatcgtcgatgccgagcgggcgcttgcccgccgcgcactcgcgggaggtcgtgatccagacgtgcgcccgggatcgatgtcgacgcgtgtgatcgatcggtaacgagctggtaacgctacctcgatgggtggcgtgtgggcgggtctacgatgcgcctagctccgctgcgatcggccgaccaggggagcgaggccagacgccgcaacggcgcggcctggcggtcgtccgaagggtgtcaccggaggtggcgtcctgatcgcgtaccgacaggtgaggagttgtgccatggcagcgagcgagcagcagatgcaccgaacgctcacgctcaccggtgtcacggtcaatgggatggccttgatcgcgcccggagcgtttctttggacaacgtttcaggaacaggcggcccagacgaaccacggtcagccgacgggccttgacatgtggacagggctcctcttcgccttcatcctcgccatgctgaccgcgtggagctacagccagctggctcggatctatcccgatgcgggcacgggctcgacctactacttcgccgaagccgccttcctcgaccagaaccacccgcgcttcaccgccaccgcgagagcggtgaagttcgccttcggctggatcagccacctgtactactggatctatccgggcatcatggtggcgttcatcggtaccctgatcggctacatcatcggcgcggtcggaggggtcacgctgtcgtggctcgaactctcggtgatcgccgtcgtcgccgccgcggggatcggctacatcgcctaccgtggcatcacggggtccacgatgacggcgctcgtcatcaacgtgatccagatcgtgaccctcgtcgcgatgacggctctcttcttcatcgcgttccgcgtcgcgcacccggacggtggctacgtgcaagcgagcgcactctcggtcatcctcccacacagcttcgtgaacctgctctaccagtcgaccatcgccatcttgttgctcgtcggcttcgagtccatcacggccctcggcgccgaggcgcgcaatcccgagcgcgacatccagcgtggggtcttgatcgcgctcgccatccagggaggcttctcgtacctgttggagtacttcggtgcgaacttcgcactcggctctgcgaccatggcaggtcaaccgggcgcaaacgtctttgccaaggccggcaacgatgcggcgccgatcggcacgatggtccagaacgctgccgatcgcatgttccatggcggcggagaggcggctgcgttgatcgtggccgccacggtcctcatcgcactcatcggcacgacgctcgcgtgcatcaacaccgcagttcgcgtgagctactcgatggccagggaccgtgagctgcccagcgtgatcgggtggttgcacgggcgcttcgccacaccccacggcggcatcctcgtgatcagcgcgatcagcgccgtggtggcgatctacggggtgcacacggtcgacaacctgacgcagatcacgctggcgtccaacatcgggacctttctggtctatggcatgacgtgtgtgatcgcgatcgtggcgttctcccgtcgcgccgatcgttccctgctcgctcatgtgctcgcccctggccttggggcgctcatgaatctggccgagctcgctggcgtggtctatctcgccatcgctggcggcggctcgggtgcgaccgatgcggtgaaggccatcggtgtggtgctggcctggaccatcgttgggctcgtgtggtactgggcgaacccgcaccgccatcatgccaagagcatcgtcggcgagcgcgccacgaggcgactcggcggggccgggcgcggcgtgtcggccgcggcggagacgccatagcgttcggtgctccggggggagctgccagctggtgatgcctctggcccgcaagggctggaggcatcacccatgaggaggagacgatggtacgacgctcgctcgaggccgacgagacgagtgggtcgcttcgggcccacgacggctcggtggcggcctgggtgagcgtgcggggtgtggtgcgggctgggaacgaggacgcggttgcggtcgtcccccctggcacctctggcgaggtgctggtggcgtgcgtggccgatggtgtcggcgggcaggcggctggcgaggtcgccagccaggcggccatcgaggcggccacgagcgcgatggggagcgggcgaggggcggtgcgggctcgggtgcgagctgcggttcgggctgcgaacgcggcagtcatcgacgcgcaacatcgcgagcgggctcggatggcaaccacgctcaccctggtcggggtgagtggccgcgacgtcgtcattggccacgtcggcgactcgcgtgcctatcgtgtcggcgacgagcggatccatcagctgacgcaggaccatacccaggcggccgagctgttgcgggcgggcttgatcgatcaggaggaggcagctcggcatccagcgcgctcggtgctgacgcgaagcctgggagcacagatggcggtggcgccggatctcgtcagcgtggcgctggaggatggggagcggatcctcgtctgttcggacggcttctgggggacggttccgcgcggcgcgctcttcgaggcgctgcgcggcgcgcgagagcccgacgcgctcgagggtgcgctctggcgactcgtcgggcttgcctacgaggcgggtgcgcccgacaacgtctccgtcatcgtggtgatcccgagtccgacggccacgagttcgggcgcgagcgtgcgcacctcgtggtggcggaggagccgaggaacctaggcaaggccgacgatacgcgccgccgcgtctcgtgcacgctgagcatcgctcgcggtgcggaccgcttctgctgctcggcgagcggtcgtacgctcgacggaagcgagcagacgggtgacgggtgcgatcgcgctcggcgtcatggacaagctcgtgatgccgaggcccgccagccagacggcggcgaggggatctgcggcgagctcgccgcagacaccgatggggatgcgaccgtcgacgtcgtcgacgaggcgagcgaggagtcgagcgagtggcggcgagaagggatcggcgagggctgcgaccgccgactcctcgcggtcggcggcgaagaggtactgcgcgaggtcgttggtgccgatcgagacgaagtcgacgctgcgggcgagctcgtcgccgagcaggcacagagcagggacctccaccatgacgcctgcactcgggatccctgcggcgtgggctcgctcgaccacctcgcgcgcttcgtcgatcgtcgtcaccatcggggccatgagaccgacctcggcaccggtcgcgcgctgggcgtcggcgatcgctgcgatctgggtgtcgatcacggccggcgccacggcgcgtgccctccatcctcggacgccgagcgcggggttggccgagcgaggcagatcgatgaacgcgagtggcttgtcggcaccggcgtcgagcgtgcggacgatgcaacggcggccccggaatggggtgaggatctcggtgtaggcctcggcttgctcggcgcgagagggagcctcgtcgcggtcgaggaacaagaactcggtgcgcaaaaggccgataccgaccgcgccggcgtcgatcgccccctgcgcgtcggcgacgccggcgacgttggccatgatggcgacggcgccgatggcggcacggtctcgagggagcgtcgttcgcgcgggcgtacgctctgcggctcgcagcccagtgacatcgtcgtcgttggggttcacgatcgcgaccgcgcgcacggtatcgacgagcacggtgtcgccgtcgtgcaccccgtcgaggcccaccacgccggtgagggcggggatgccgagtgctcgggcgaggatggcgacgtgggcggtcgggctggcgccagcgagcaagagcgctgccggccgttcgtgctcgatcgcgaggagatctgctgggccgagctcgttcgcgacgacgaccttgccttcgagcatcggtccttgggtgcccctgaggcgggcgatgaggcgccgttcgatcgcgccgaggtccgccgctcgttcggcgatcgcgccgccgacggaacggaggacgcctgcgacctcgtcgaaggcgtcgtggaccccgacggtggagggatcgtcggcgaggtgacgctccacggcatcgacgagcatggggtctcgcgcgatggctgcgtcggcggcgaggatctgggacagctcgccgctcgcacgtcggctggaagcctcgaggtcgtcggcgacctcctcgagcgctcggcgcacgctggcgggatcgacctcggtgcgctcggcgaccgcgtcgacgcggacggctgtcccgacgccggctccctgggagcctggttgaccgcgaagggtgtgacgttccggcatggaccctcctctccgggcgaggcgcctcgggaccaaagacccttgacgtcgtccacgacgcctgtcatgatacgagcgggcagagtgcacgagagcgcccggacgtgagaggtcgcgtccgggcgctcttcgtgttctggcccgggagcgatgcatgacagggggaaggaggccgtaggtggccacaacacaggcgcgaccggccggcaagaccggctggcgcgcaacgacatggggagagctgctctccgaatatctcggtacgttggtgctgctcgccttcgggacgggctcggtcgcggttgcagtggtgggcctcaccatgtccggccgcaccgtcgtcatcttccagggagcgggcggctggctgctgatcacctggggctgggccatggcggtcgtgatgggcgtctacgtggctggcggggtgtccggcgcacacctgaacccggcggtgacgctggccatggcgatcaagggctcgctgccgtggcgtaaggtgccgggctactggatcgcccaggttctcggggcattctctggcgcggcgatcgtctacctggactactacaaggcgatcgatgcgtggaaccttgcgcaccacgtcacgcgcgccagcgccggtgggttgacgaccttctcgatctttgccacgttccccgcgaagtacttcggcacgagcctcgtcgggccattcatcgaccaggtgatcggcacgttcttcctgctgctgttcgtgctcgccatcaccgacgcgacgaactcggggccgggttcgaacatggcaccgttcctcgtcgggatggccgtcgcggcgatcggcatgagctttggtacggacgccggttacgcgatcaaccctgcgcgtgacttcggtccgcggctcctgacgtggttcctcggctggggacacaacgccttcgccggtctcaacggttactggtgggtcccgatcgtcggtccgctcgtcggtggagcgatcgcggttggggtctatcgctggttcatcgaggacacgattcgtgcgcgcttcgcgcgccagagcacggaaggaggggcgcagtgaccacccgtatcctcgctcttgatcaaggaacgacgagctctcgagcgatcgtcttcgatctcgacggcaccatcctcggcctcggccagcacgagttcccgcagtactacccgcagccaggctgggtcgagcacgaccccgaggagatctgggagtcccagcgccaggccatcttcgacgccctgcgcgccgccggcatcgcgccaggggacctcagcgcgatcggcatcaccaaccagcgtgagaccaccatcgtgtgggatcgccaaaccggcaagccggtcatgaacgcgatcgtgtggcagtgccgacggacggcgccgatgtgcgacgaactccgtgcggccggccgcgaggatctggtccgttcccgtaccggtctcgtcatcgacgcttacttctcgggaacgaaggtggcctggatcctcgagcacgtgccggaggctcgtcgcctggcggacgagggccgattggcctttggcaccgttgatgcgtggctgatttggaagctcaccggcggacgggtgcatgcgacggacgccaccaacgcctctcggaccatgctcttcaacatccacaccggtgagtgggatcccgaactgctcgagatgctgggcgtgcccgcgtcgatgtgcccgacggtcgtcgactccgcaggcgtggtcgccgagacggaccctgagatcttcggtgccagggtgcccatcgccggcatcgcgggtgatcagcaggccgctctcttcggccaggcgtgcatcgagccgggcatggcgaagaacacctacgggaccgggtccttcctgctgcagaccacgggccacgatgcggtcgcgtcgcactcgggcctgctcacgaccgtggcgtggagcatcgggggtgagcgcacctacgcgctcgagggctccatcttcgtgaccggagccgtcgtccagtggctgcgcgacggactgcgtctcatcgcgcatgccgaggacaccgaggcgatcgccgccgaggtccccgacaccggtggcgtcgtggtggtccctgccttcgtggggctcggcgcaccggtgtgggacccgtacgcgcggggcaccatcgtcggcatcacgcgcgggacgacgcgggcacacatcgtgcgggccgcgctcgaatcgatggcctaccagacgcgtgacgtcgtcgaggcgatggcggccgactcgggccagcgactcgccatcttgcgggtcgacggcggtgcggtgcgcaacaacgtggtcgcacagctccaggccgacgtgctcgggatcccggtcgagcgtccgaaggtcaccgagaccacggcgctgggtgctgcctacctggcggcggtcggcgtgggtgcggtggcaggtcctggggggctgcgcgacgtgtggcaactggagcggcgcttcgagccaacgtgggacgaggcgacgcgagccgcggcctatcgcacgtggcagcgtgcgcgggaccgcgcccgagcgtgggtcgaggcgtaggctgcgagagggaggtagtcggatgaagaaggtcatcaacgaggtcgaccacgtcgtcgacgagtctctcgatgggctcgcggccgcgttcgcaccgtgggttcgccgcatcgagggtacccacgtgctggcgcgcgcggtcgcgaagccatcggggcgcgtcgggctggtctcgggcggcggatcgggccatgagccggcccacggcggctacgtcggtgagggcatgctcgacgccgcggtggccggcgaggtcttcacctcgccgacgcccgatcagatcctcgagggcatccgcgccgccgaccacggcgcgggggtgctgtgcgtcgtgaagaactacaccggcgacgtcatgaacttcgacatcgccgccgagctcgccaaggaggaggggatcgaggtgcgccaggtcgtcgtgaacgacgacgtcgcggtcgaagactccctgtacacctcggggcgacgaggcatcgccggaacggtgttcgtccacaagatcgcaggcgcagcagccgaacgtggggacgatctggcgacggtggcggcggtcgccgagcgcgtgatcgcgaacgtgcgctccatgggcctcgcactcgcaccgtgcacggtgcccgcacgtggagagcccaccttcaccttgggcgaggacgagatcgaggtgggcatcggcatccacggcgagcctggggttcggcgcgaaccactgcgtcgtgccgacgacctgaccgacgaactgctcgatcgggtgacgagcgacctcgggctcgagagcggtgcatccatcgcggtgatggtgaactcgatgggagcgacgccgctcctcgagcttgggatcgttgctcgccgcgtctaccaggtcgcggccgagcgcgggtggcacattcgcaccgcctgggttggcgagtacatgacgtcgctcgagatggccggctactcgatcacggtgcttcgactcgacgacgagctcgccgcgctgctcgaagcccctgcgtcgacggctgccgttcgggtggcacggtgagcgagcccggttcgctcgcctggtggcacgacgtctggcgctgtttcgcggcgtcggtgcgcgaccagcgcacctggctggacgatctcgacgctgcgatcggcgatggtgaccacggtacgaacctgaaccgaggtctcgagcgcgccctcggggccctcgagacctcgcagacgccgcgagcggggctgaggagtgttgggatggcactgctcggcacggtcggcggggcatcaggcgcgctgtggggctttggctggaccaaggcctcggcggcagccggcgacgggaccggcgccccaacgcccgacgaggtcgtggccacgctgtcgctattccgggacgcggtgctcgagcgtggccacgccgagctcggcgacaagaccatggtggatgtcctcgtgccggcgctggcgtcgctcgctgccgagctcgggactcagcgctccttcgccgaggcagccgctaccgccgcgtccgtggcctcggagcgtgccgagtcgaccatccccctcgtggcgcgcaagggccgcgcgtcgtatctcggggagcggagcgcaggtcacgaagaccccggtgcggcctcgatggctctgttcttcgcatgccttggcgaggtgagctgaggtggtgggcgtgctggtggtgtcgcactcgcggcgattggcgcagggggcgtgcgagctcgtcggcgccatggccaagggggttcggctcgagtggcgaggaggtgagccccccgagcttggcgtgagtgtcgagctggtggcagatgcgctcgagggcctgctcgaagggggcggtgaggtggtcgtggtcgccgacctcgggtcctcggtcctggcggcagaagcggcggtcgagctgatcggggcaggcccacgcgtccgcgtcctgcgcggcgtcccgatgctcgagggcttcatcgcagccgcgatggcgctcacggtgggcggaggcctcgccgaggccgtcgccgcggccgaggcggcctgtggtgcgctcgagggcgggcgatgacgcgccgccgggtcgtcgtgatcggggccggggccaccgggctcggcgtcggcgtggatttggccacccgtggcatcgaggccgtcgtcgtcgagcgtcacgcggtgggggcagggacgtcggggcggttccacggtcttgcacactccggcggtcgctacgccgtcaccgacccgctggccgctgccgagtgcgcccgcgagctcgcggtgctgcgccagatcgcccccggtgccctcgaggccaccgggggatggttcgtacgcacgagcgacgatgacgccttcgagcaggcgtggctgcgtgggacggcgtccgccgggatcgaggtccgcgaggtcccgctcgacgtcgccagggcgcaggtgccggcggcggcggcgcgagctcggcgggtgttctgggtacccgacggtgtgctcgaggggttcgagctcctgcgcggcctcgtgcgaacgctgcgacgtttcggtggcgacgtgctcgaggggtcggaggtgatcggcctcgtgcgcgacggtgccagggcggccggtgtggtcgtgcgccaaggcgatcgagaggtcgtcgtcggtgccgacgccgtggtgaacgcggcgggtccactctcgggtgtcgtcgggcgtcggctgggcgccgaggtgccggtcgcgccgtcgttcggcacgatgttgatctttgccgatcgccgactcccgctcgtggtgaaccatctcgagcgcccatccgacggcgacatcttcgtaccccatggcgagactgtcatcctcggtaccaccgacgtcccccacgaagacggcgaggcgctaccgccgagccggcaggaggtggctcggctcgtggagctcggtgcgcgcttcgtgccggaggtgcgcacctggcgaccgatgcgggccttcaccggcgtgcgccccctggtcgccgatccgggtgcgggcgggccgcgaggtctgtcgcgcagtcacaccatcgtcgaccacggcgcgagagacggtatcgccggcctgttcgcgatcatcggtggcaagtggacgacgtatcggctcatgggggagcagaccggcgacgccgtcgcctcctacctcgaggtcacggcaccgtcggcgacgcggtcgctcgtggtggtgccggcgcgagttcggggacgcgcgccgacgtcgtcggagacgttgtgcacctgtgagggcgtcggtcgtgacgagctcgtcggcgagggttcgctggatcgttggcgcgtcgagcattgggcgacgatggggccgtgtcaggggacgttctgcgcccatcggttggcggctcgcgcagctgaactcacgggcggcgccctcgagagcgaggcgctcgatgcgctgcgtgccgagcgcgcgcggggggtcgatgcggtggcctatggcgcacaggcacgccttcgggccctcgcgtccgagcagcgtcgctggtgggggtggggctcgtgagcgtcgtggtcgtcggggcagggccgagcgggctcctcgcggcgtcgctgctgctggacgagggtgcgtcgccgatcgtcgtcgcggccggcgagggttctcttggcttgtggccgggttggctcgcggccccacgggacgatggcgccgtcgagcgggccgtcgcgagcttgaatcgggccgacgcacgactgtcgagcgtcgacgagcgcgaccgactcatcggcccgctcggggtcgcgcatcggttcgcctgggctccgccggaactcgcgagagtgggacccgaggacgtcgtcggcttctgcggcttcgccgagatgaccgagacgcgggctgccgtcgcggtggcgacctggcagagccagaccggatcggcagccgtcggcttcgacctcgcgccgtggggccggcgggtgccgttcgaactcgctcgcttcctcgggcacctggagggggcgcgagcgctcgggcgcgccctcgcgccccgggtcgacggcgccgtgagcgtcgtcgcggtaccgggactgctcggtatcgaggatgcgacccgggcgctggcggtgctcgaggagatgctcgagcgccgggtcggcgaggtaccgctcgtcacgcctgccctggctggttggcggctcgatcgtcgggtgcgcaccgcacttgcggctcggggcgcgacctttcggcgcgccagggtcgtcgaggtcggtcggggaggcgtacggctcgcggacggtgcgcacgtcgacgccgacgcggtcgtgctcgccactgggggcgttgcgggtggcggcatcgcaatcggtccggatggctcgctcacagatagcgcgcgcggcgtcgcgatcggcgaccctgcggcatggatgatgggagaagacgtggggctgctcggttatcgcgaggtcgtcgtcgacgaggaggctcgggtcgtcgcggtgggcgcgctccgtgcgcacgaaggctccgggttcgcccaggttgcccagagcgtcacggaggcggtcgaggtgcttcggtcatggtgagcacggcaacggcgctcagactcgacaacgccgatgcttgcatcaagtgcggtctgtgtcagctcgtctgtcccgtgctcgaggtggacccggcctttagcgggccgaaggtgctcgggccggactggcatcggcgcttcgtagctggcgagcgggtgacggacgacacggccgcgcgctgtacgttctgccagctgtgcgagtcggtgtgtccggtgggtgtccccatcgcgcacctcatcgcggagcacaagtcgcacctcgaccacgacccgcgctcgaggatgcgagatgcggtcgtggtccggcccgatgtgctcgcgcgctttccgtggctgacccgggtgccgaggcagctcgcgccggtcgccggcctgtcgtcgacgacacggtggccgcgtccgcaccgaccccgggccgcgtcgagtgacggcgggacctctcgcgtcggcacggtcggagtcttcgtcgactgcttcagtcgggccttcgacggtgccacgatcgatgcactcgtcgtgctcctcgggcgtgcggggatcactgcacgtctggtgccggcggacacctcggtgtgctgtggcgccgcagcgtgggcgagcggtgctccgcacgtggccgaggggcgcgcgcgcgaggcagcgcgtgccatcgaggccgacgccggcgatctcgatgtggtcctgagcgtgaacgcaacctgcgaggcgacgatgcatggcgagtggcacgacgtcttcggcatccagacgtcggtgccgagcgtgagcgcggtcgattggctcctcgacactggtgtcctcgctgggctcgtggagcggcggcgaaggggcgatcggccgaagcggctcgctctccacacgacctgtcgcgcgacggtggccggagaaggcggcgccgacgtcgccgcgctcgaagcggttggctacgaggtcgtccagaccgagctcagctgctgtggcgcggccgggagctatgcgttcaaggccgagcatgccgagcgtgcgcggcgtatcgggtcgcgggtcggaccgccggccgagatcgtcggggtcgcggtcgactctgcgacctgcgcgttgcacctgggggacctctggggcgtgcgcgcgacacacccactcgtgtggatcgaggaggcgatgcggccgtgacggagaccccacgtgcgattctcgccatccgcgatcctgagctcgcccaggctacgaccgctgggctcgcgcctgggtgggtgatgctgctcggagggccggccgcgagcgtgatcgatgcctccatgaccctctcgctcgagggctgggtcgtgttcgtccacatcgacatggtgcgcggtctcgggcgcgacgccgacggcctcggggtgctctcgcgcttcggcgcaccccagggcgtgatctcgacgcatccgagcgtggtgcaggcggcacgggatctcgggttcgccacctccctgcggatcttcctggtggactcgggctcgttacgctcggggatccaacaggcacagcgcaccaagccggacttcgtcgagatcctcccgggtgtgctgccgcacctcatcgcgccggtggctcgagcgacggggctcccggtgatccctggtgggctgatcacgactccagcggatgcgtgggcggccatcgaaggcggtgcgctcgcgatctcgacgtcgtcgctcgaggtctatcgggcggtagtggaggcgccggctcccctggcgcacgagaaccacgtgcagcgctcgaggggtcaccgatgagtgacgtcgttcggcgccagctcatcgtcatcgaccccctgggactccatgcacgcgctgccgcggcggtggtcgcggcgctggggccgatcgcgggcgtcgtcatccgagcaggtgagcgtgccgtgcccgccacgagcgtgctggcgctcatgggactcggcatcgaggctggcgacgtgatcgtcatcgagggtcccgtcgaggcagagggagcgatcgcagaggcgctggcgacgatctctgcggtggcccagcccgtcgtcgagggcccgagtgacgacgagggacaccaggggcagtcgtcgtcatcatgaaggccgtgtaacgattcccgcctcgtgcatggattcccttgcgccgaccggacgcgacgagtaaagtagcgccacacgggccgtttcgacgcggaaagcgtgtcggaacggggagcctggatcaggaggggtggccagggtgcaacggtctcgagggcgcgcagctacggtgcgctaccgatgaccaccctgacccgtcgcctcgaggccgagcctggcccacgagccgttcgccgagacggtgcgctggcgcgcttcctcgccaatcgactcgccgtcggcgcgctggtggtgctcgtggcgatcgtcgcgttctgcttcgtcggcccgatcgtgcacccggtgtcggacgcagccaacctgctgcacgccaaccaacctccctccggccagtacctgctcggcacgacaccgaacggccgtgacgtcctcggacgtctcatggtgggaggccagtcgacactcgagctcggggtggccgtcggcgtgctcgcgacgggcttcggtctgctctacggcaccgtcgctggtctcgtgggcggtgtcacggacgcgatcttgatgcgcatcgtcgatgccctgctctcgatcccgttcctcttcttcgtcatcttgctcgcctcgatcgtgcgcccgacgctcggactcatcatcctcgtgatcgccggcgtgagctggctctcgacggcgaggctcgtccgagccgagaccctcaggctccgaaccctcgactacgtcgacgctgcccgtggtttcggagctcccccctggtggatcctcgtgcgccacctcgtgcccaacgtgctcggtgtgctcgtcgtgaacgggaccttgaaggtcgccgatgcgatcctcacctttgcggcgctcggctacctcggcctcggcgtgcccccgcccgcgacgaactggggcgcgttgctctcggcgggcgtgaacaacttcttcgacggctactggtggcagctgtggccagcggccgtgctcatcgtcgtcaccgtgctcgcggtgaacgtgctcggcgacgccctgcgcgacgtcgtggagcggaggctctcgtaagtgggtggaaggagcaaatggtggagggatcgatgatgaggcagctgcgtcggacgaggtggcatcggagcgcggcgtggaccggttcgctggtggcgctaggcatactggcggccgcatgcgggagctcgtcgggggcgtcgacgtcgtcgtcggcggcgaccggactgccggcgaactacgcctcgtttgcgctgcactcgggcgacacgttctcgtgggttctcccactgccgaaccaggccaactacgagccatgggaccagaacgcggagtacgggatgtaccgaccgctctacgtcgctggcaacgggtcctccccgaccatcgacgaggcgacctcgatggccaacccgccgacctacaacgccaccgacacgcaggtcacggtgacgttgaagccgtggaagtggtcggacgggaccccggtgaccgcccgggacgtccagttcttcttcaacatctatcgggccaacaaggcgaacatcgcgacgtacgtgccggggaacttccccgacaacgtcgcctccttcaccgtcgactcgccaacgagcttcacgctcacgctcacgcatccggtcaacccgacgtggttcaccgacaacgagctcaccgacgtggtgccgctgccccagcaggtctgggaccgtacctctcccggtggcaaggtcggcaactacgacgagaccacggcgggtgccgtggcggtcttcaagttcctcacgaagcagtcgaacgatctgtcgacctacgcgacgaaccctctgtggcaggtggtcgatggcccctggaagctccagagctacgacccgaccaccggtcgcacggtcttcgcacgcaacgatgccttcaccgggccggacaagcccaagctcgctgggtatgcactcgagagcttcccgagccagaccgccgaggtgaatgcgctgcgctccggtcagctcacctacggctacttgccgatctccgactacaagctggagtcgagcctgtcgaagagcgggtacaccatcgcaccgtgggtcaccgactacgtccagtgggccgaactcggctacaccagcccgaagtacgggccactcgtcaagcagctctacatccgccaggcgctccagcacctggtcgacgagccgctgtacatgagtcaggccctgcacggctacgggcagttcacctatggaccggtcccgaacatccccggctcaccgtacgtgacggcgacggagcagaccgaccccgacccctacagcaccgcagccgcgaagagcctcctcctcgcccacggctggacgctcgggtcccaaggggtgatggtgtgttcgaaccccgggaccgcggcgaaccaatgcggtgcggggatctcgaagggcgaggccctcaacctcctcttcatgtaccagagcggcaccccgacgctcgcggcccaggtggaggcgttcgcgaccgctgcgaagcaggcgggcgtcggcatctccctcgatccccagacccagagcaccatgttctcgatcggcggcgtgtgcccctcggccggcccgtgcaactggggcatcatcttgtaccggaccttcctgtggaactacggccaaggcgatgtgctcccgacggggggtcagatgttcggcaagggcaactactggggaggcggctacagcgatccgacggcccagtccctgatcgacgagacccacacccaaccagggctgagcgccttgttcgcctacgagaactacatctcgcgccaggtcgcagccctgtggttcccgacgtgggactggcagatctcggtggtctcgaacaagctgcacggctggaacccacagcagatcttcgggaatccgacgccgtcgaggtggtacttctaggcgatgcttgggttcgttgcccgacggcttggccaggcgatcgtcaccatggtggcggtgtcgatcgtcgtgttcgggctgctccatgccttgccaggggggctcgtgcgcgcccagttgggcgcgcacgtctcccaagtcgcgatccgtgcgctcaccgtgcaagaaggcctgaccaagccgctgccggtccagtacctcttgtggctgaagggtgtcctcgaagggcagttgggccagtcgttcaaactgggtgaaccggtgtcgacgttgatcgcgctctatgtcccgaggacgatcctgctcgtcggggtgtcgttgttgctcgcggtcgcgatcgcgatcccgctcggtctgtggcagggctaccgccgtaatcacccggacgaccacgccctcagcgccatcatgctcacgctctactccatgccgacgttcctgctcggggtcgtgctcatcatcgtgctcaactcctggctcggcctgttgccgtcgctggcatcgaacttcggcgcgagcatcggcaccgatgtgcgcgacctgggactgccggtgctgacgctcacgctggcgaacgtgagctacttctcccgctacatgcgctcgtcggtgatcgacaacctgctcgaagattacgtgcggacggcacgctcgaagggtgcctcggagcgtcgagtcctcctgcgccacgtcctgcgtaactcgctgacggcgaccgtgaccatgatcgggctcacgctgccctatacggtgtcgggatcgctcatcgtggaagcgctcttcaacttccccggggctggactcttgttctggaacgcggcccagacgcgcgacttcatggtgctgctcggcatcgtgctcgtgatctcgatcgcgaccatccttggcaatctcctcgctgacctcgcctatggcctgctcgatccgagagtgcgctaccgatgaccaccctgacccgtcgccccgaggcccaggtcggcccgcgagccgttcgccgagacggtgcgctggcgcggttcctcgccaatcgactcgccgtcggtgcactggtggtgctggtggcgatcgtcgcgttctgcttcgtcggtccgatcgtgcacccggtgtcggacgcggccaacctgctgcacgccaaccaggcaccctccggccagtatctgctcggcacgacaccgaacggccgtgacgtcctcggacgtctcatggtgggaggccagtcgacgctcgagctcggggtggccgttggcgtgctcgcgacaggcttcggcctgctctatggcaccgtcgccggtctggtgggtggtgtcacggacgcgatcttgatgcgcatcgtcgatgcgctgctctcgatcccgttcctcttcttcgtcatcttgctcgcctcgatcgtgcgcccgacgctcggactcatcatcctcgtgatcgccggcgtgagctggctctcgacggcgaggctcgtccgagccgagaccctcaggctccgaaccctcgactacgtcgacgctgcccgtggtttcggagctcccccctggtggatcctcgtgcgccacctcgtgcccaacgtgctcggtgtgctcgtcgtgaacgggaccttgaaggtcgccgatgcgatcctcacctttgcggcgctcggctacctcggcctcggcgtgcccccgcccgcgacgaactggggcgcgttgctctcggcgggcgtgaacaacttcttcgacggctactggtggcagctgtggccagcggccgtgctcatcgtcgtcaccgtgctcgcggtgaacgtgctcggcgacgccctgcgcgacgtcgtggagcggaggctctcgtgaccgttcgatcgagcggtggggggacctcggtgcgcaggacgtgggagcgccccgagctcctgcgcgttgccgaaggcgcactcgcgcacgcatcgacgatgccgctctggctcgacgatccggctcgaccggcggcgaccccaccactcgaagggcaggtcacggccgatctcgtgatcgtcggtggtgggctgctcggtctgtggagcgcgctcctggcggccgagcggcgaccagagtgggagatcgtcctcgtcgagggcggtcgcatcgccgctgcggcgtcggggcgcaacgggggcttctgcgaagcgagcctgacccatggactcgccaacggacttgccaggtggcccgatgaactctccgagctcgagcgcctcggcgaggagaaccttgcggccattcgggcggccgccgagcggtatgccgcgaactgcgacctcgtcgattcggggacgatcgacgtcgcgctcgaggactggcagctcgacgagctcgccgagctcgccgaggtggcgccacgctacggccacgacgtcgtcctcctcgagcgcgaggcgctctcggccgaggtacgctcgccgagctatcgcggaggcctgtggacgcgcaaccgcgcactcatgctcaatcctgcacgtcttgcgtggggtctcgaggcggcagtggcggggatgggcgtgcgcatctgcgaggggacgcgcgtcgttgggctgagttccgagggcccgttcgtcgtggtcgagaccggttcgggtgcgagcgtgcgcgcgagtcgggtgatcctcgcgaccaacgcggcggctcccctcgtggcgtcggcgaggtggcggttcgtcccggtgtacgactacgtcgtggcgacgcgaccgctcgcggcgagcgagcgtgccgagatcggttgggagcgacgtcaagggatctcggatgcgggcaatcagttccactactaccacctgagcgaggacggtcggatcgtcttcggaggctacgacgcggtctaccactacggttcggtggcccgccctcgctacgagggacgctcaccgacccacgtacgcctcgtcgcgcacctgtacgcgacgtttccggggctcgagggtgtcgagatcagccacgcctggggtggggcgatcgacacgtcgactcggttcgtcgcgtccgtgcatcgggcctttggcgggcgcgtgcactatgcggtggggttcacgggtcttggtgtcggggcgacgcggctgtacgcatcggtactcgtgggtcgtgcgatcggggagccccacccagcggagcggctccgactcttccgtgagggccccgtaccgtttccgccggagccgctccgctggatcgggatcgagttgacacggcgctcgctcgcctgggcggacgaccacggcggtcggcgcaacgtctggctccgtgcgttggaccgcttcggcgtcgggttcgattcctaggaaggggacctcgtgcaagagctcgtgcaagaggatgtgatcgtgcgggtcgaggggctcacgaccgatctcgtgcgtcacggtggctcggttcgggtgatcgatggcgtgagctatgaggtcgccaggggtgagacgctcgggatcgtgggggagtcgggttcgggcaagaccatctcggcactcagcctgctcggactcttgcctccccagatgcgcgtcgtcgctggctcggcacggctcgagggcgaggaactcatcggtgcgagcccgcggcgcctgcgcgagctccgcggtgcggccatcggcatgatcttccaggacccgctgagctcgctgaacccgtcgaagaccatcgggtggcaggtggccgaaccgttgcgcatccaccagcgtctcggagccgccgcagcgcgccagcgcgcgctcgagctgctcgagctcgtgggcatcccgagcccgaaggagcgcttgaacgactacccgcaccaactctccggcgggatgcgccagcggatcatgatcgccatcgcgctcgcgtgtggaccgaagctcatcgtcgccgacgagcccacgaccgccttggacgtgaccattcaggcccagatcctcggcctcctcggcgaactgcaggaccggctgggtacagccatgttgctcgtcacccacgatctcggggtcatcgcgggtcgtaccgaccgggtgctcgtgatgtacgccggtcgggtcgtcgaggctgcgccgacgcgcaccctgttctcggccatgcgccatccctacacccaggccctcctcgcgtcgatccccgtgatcgggatcgatcggagcgtcccgctgccggcgatcccgggcacaccgccgccgctcggcggagcgggggtgggctgtgcgttcgcgcccaggtgtccgcgtgccgacgagcgctgccgccaagagatgccaccactcgcggtgagcgctggccacgcagtggcctgctggcaccccgtcgacggacccgttcgacggaccaggctcgaggtcgctacctcgcttgcggcggtgccacgtgctatggagccgttggtcgagctggtcgggcttcgcaaggagttcgagatccactccaacgtgacgcggcgccatctggggacggtgcacgcggtggcgggggtcgatctcgtcatcggacgtggtgaaaccgttggcctcgtcggtgaatcgggctgcggcaagacgaccctcggacgtatggtcgtcgggctcgagcgcccgacgggtggtgagctgcgcatcggtggcgtcgacgtggttcgcctccgcggcagcgagcggcgatcgtttcatcggcggatccagctgatgttccaagatccgttcgcatcgctcgatccgcggatgcgcatcgcgagcgcgctcgccgaacctttgcgcgttcaggggctcgatcgtggcgaggagcggctggcgggactgctcgagcgcgtcggcttggcgcgcgaggcgctgtggcgctacccccatgagttctccggcggccagcgccagcgcatcggtctcgcgcgggcgctgacgctcgaccccgagctgatcgtggccgatgagccggtgtcggcgctcgacgtctccattcgctcccagatcctcaatctcatgcgcgagacccagcgcgagcgcggtctcagctatctcgtgatcagccatgatctgtcggtggtgagctacctcgccgatcgcatcggcgtgatgtacctgggccgtctcgtcgaggtcgggccgacggccgcggtgatcgcctcgccagcgcatccctacacgcgcggactgctccgttcggtgccgcttccggatccagaacgtgagtcggcaaagcgtcgtctcggagcggtgatcgaaggcgagctcccgtcggcgttgcgcccaccgacgggctgtgcgtttcaccagcgctgcccatttcgggtggcccgttgcgaggtcgaggcgcccgaggctcgcacgctcgacgatggcagggtggtcgcctgtcatcgcgtcgacgacgtcctcgccgagccgtggtcgctcgaggacgtcggacagatggcgagcgcgctgcgagcgtaggcgtttcgacgtgcgccgcggccaacgagggccacaagagtacgccgacgccggccaggcggtctcgtggctgtgcggaggcggcgtcggagcggttcctcgtagcggcgccagacgatgagcgcgatcgcgagtgccgcggtgaggacgaggaggtcttgccaccacggtccgccgtagtgatacagcgacacggtggcgaggctgcgcatgaccagtcgatggaccatgtagaaggcgaagctcgccgagccgagcgcgaccgctgccgaatgggcgatgaggcgtgagatgcaacctgcctggtgtgcaaagacccacacgacggctccccagacgggaagatagagcgcgctgaagcggagcgactgcggagcgaagggtcccgcgacgacgacgcccacggcccctgcgagggcagcgccctcgaggagtgaccatcgccagcgcgacccgccgctctcggggtgttcggcgaaggcaatggccgcaacaacgccggccagaaagtccgagagtcgggtgatcggaaacacgtagatgacccagctctgccaaccggtgtgaagcggaaccagcacgccgacgagggcgagccaggccgtcgccgcgccgaagaggagccagcttgtcgtgagtcgtggccgagcccactcgacgaggcgggcgacgacggggaagatgaggtagaaggttgcttcgtcgctcaagctccatgcgacgccgtcgaacgagaacgccgcggcgagcgatgggatgaagctctggacgaggaggaggttggcgagtgcgagcccgagccaggagccgatgccaccgtacatcgagggtggcgtcaagaacagcgaccaagcgaaggcgaggacgtagaccggatagatgcgtgcgagccgagagcggtagaagccaagcaccgggtttcgccgaagacgcgtgaagcggccctggtacgcgtaggtcaggatgaagcccgagagcacgaagaagaacgagacaccgacgtagccggtctggtaggtgcgcagccaacctacgtgccaacagaagacggcgagtgctgcgacgaaccggagactggtgagtgggcgtagctgtaccaacagacctcctttggccctcgtgcgccacgtagtggctcaagaccgcgagtggtcgcgtgtcatgacgttcgatgacgtgggtcgggcggttccgaacagcgtagagggctcggtcgttcaggtctgggttgggtcgtagtagctactcggagacgtctgagcgctgacgtacgacggttccggaactactgctcgcctcccgcgtgggcgtcgcgcgaggcaatcgagtcagcgaccgagggcgagatggtggagcgcgatggctgcggcggtcgcgaggttcacggagtcgaccccgttcgcgatcggaatggtgacgagtacgtcggcgtaggcgagagcgctcggtgagagcccgtgtccttcggatccgacgaggagcgcaacgcgcggtcgcggcaggtcgtgctcgccgggcgcgcgtgcgtggcgtggttcgccgatcgcttcggcgagctcgtcgaccgtgacgacaggagtgaggtcgcaggttcgctcggtacgcaggcgttgtgtcgacgccggtggcaccaaggcggcgatgcgaacctgcgaccgtgcaaggagtgccagtgcgctcggccatggtgtcgcgcgcacgagggggagcgtcaagaggtggcccgctgacacccgcaccgatcggcggttgcgtgggtcggccgaggtgggatcgagcaccagggcgcacgctccgaacgcggcggcgttgcgcccgagcgccccgaggttctcctggtcgaccacaccctctgcgacgagcgccgtctcacccggtgcccacagatcgaggaagtcctcgagtgcctgcacgggcgggcgctcggcgtgggcgacgacgccgcggtggagtgcgaagcccaccgtctcggcgatcacccttcgggatgcgacgaggatcgggacccgtcgggcgacggcacgatcgaccacctcggtggcgagtgcaacctggtggtcatcgaggaggacggagtggacggtgagcccggtcccgagcagcgtggtgacggccacgcgaccctcgacgatcacgtcgcgagctcctcggcgttggcgaagcccgttgccgcccttgaggtcgcgatacggctcgagccggtcgtcgtcggggtcgtcgatgcgtacggcgccgatcggcagaggagcagaggcggcgtcgtcgtggttggcgatcatggctcgacgtcgaggagggtgtcgtcggcaccaccggagacgagggtcgaggcgaggatcgtcggagccgagttcctcgagctgagcgcacagagccacccgtcgagttcggtggaggtgcgcaccgcgagcggttgccaacctcgtgcgagcttcgtggcgcgcctcgcgagcaggcgtgcggtcgatcgtgtcgagcgctcgaggaggagggcagcgatctggaggtcgtgggcgcggccgaggtgggtggtgagtgcgagtgctcgccgacggagcctcacgctcgtggcgggggcgatgggtgcaaggagttcggatgcgaggcggaggcggcgtgcgcttcgacgtagcgcatggagctcgtccatcccaggccgttgggcagcacgacgcgctcggcgctgccaggaacgcacgagggcttcgagatcgaccacgcgccgagtgtcgggtgtcgatgtcgggcccgggaggcagacacgggcggcgcgtgcgagttcggggaggcgctcggcgcgcttggtgcgctcggcggcgaggtcgggacgagctggcaggatcgtcgcggcgacgtcgagatcgcgcacgctcgcgagctggttcgcgaggcgagtgagtggagaggcgccgtggcgccccacgctgggggcgggcgcggtgccgatgagcgcttcggcgaccgccgcgcgtcggagtgcggctcgcgcatcgtggacgaggtcgggggtggtgcgccgctccagcgcgatgagcagctcttcgagcgccgcgcgtgtctcggcaagatgcgccgccaccgacggccagacctcgggatcgatgacgacacgggtgcgcatggtcgggcgtcgtcgaacgagtcgtgcgttggtcacgtcgggtcagtgggcgtgcaggatcgttgggtcggcgtcgatcgcggtgacgacgccgagcagatcggcggcgcggaccgccacgggtgtggtgccgtcgtcgtgctccgcgatgccggaggcggcgagggcaaagggaatctcgagtgccctggcgaaggctccgtccgtggtgaggcggtcacccaccatgatcgtcgatgtggcaccgaggtggggtcgcacaagctcgaccatgggccagtcgggcttgccgcagtaggtcggttccaccgaggtcgaagcgacgaggctcgcgacgagcgcgccggttcccgggacgacgagtcgttcgagcgggtaggtcgggtctcggttggtcgcgaggaatcgggcccccgcgcggatcgcgacacaggcctgcgcgagaagatcccatgtgaagcctcggtgccagcccatgacgaccgcgtcgaccttctcggcgtcctcgagggacgtgggcctcacgagcgtgttgccctcggcgacgacgctcgtcagtccttcctcgccgatcgccagcacgcgctggtcactgccgagcgcgagacgtgcggcaagggcggaggtgaggatctcgttggcgtcggcgtcgatcccgagtgagcggagcttcgcgacgtaagcttcgacggtgagagtggagttgttggtgacgaagcgcagatcgtcgccacgatcacgaatgcgcctgatcgctcggtcggagccttcgatgagggtgctcgagcgccacacgacgccgtccaggtcgatgagccagcgcatggtcctccagtcgccaatcgactgccgaagcgtcgcgggtcgctcggcgttggttgggacttggaggctagcatgacctcgtcgacacgagggaggtgctgagcgtggactacgagtcactgctgggcgaggaggcgaagcagctcctcacctacgtcgcgacggggatacccgcatcgagcctgatccaccccggccctcgcgtggtcgacgaggtgttcgcttccagcgaccgtaccaatcgcgtgttggtcgagctcgccaggctctatgggactgggcgccttgcggggactggctacgtctcgatcctccctgtcgaccagggggtcgagcactcggcggcggcgtcgtttgcgccgaatcccacctacttcgatccgcagcgtatcgtcgagctcgcgatcgagggggggtgctctgccgttacgacgacgctgggtgcgctcgggatcgtgtcgcggcgctacgcccaccgcattccgttcatcctcaagctgaaccacaacgagttgctcacctatccgagccgttacgaccaggtcatgttcgccaacgtgcgccaggcctgggacatgggtgcggctggggtcggcgccacggtctacttcggctcacccgagtcgacgcgtcagatccaggaggtatcggcggcgttccacgaggcacacgagctcgggatgttcacggtcttgtggtgctacctgcgcaaccccgcgttctcgaccccagacggagacctgcatacggcggccgatctcaccgcgcaggccaatcacctcggcgtgaccatcgaggccgacctcgtcaagcagaagcttccgacgaccaatggcggcttcgtgaagctcggctttgggcgcaccgatcctcgtgtctacgagcgctacgcgaccgatcatcccatcgaactcactcgttggcaggtcgtgaactcgtatgcaggcaggatcggcctgatcaactctggcggcgagtcgcacggcgcgagcgatcttgctgaggccgtccggaccgcgatcatcaacaagcgtgctggaggtgtcggcctcatctcggggcgcaaggcgttccaacggccgttcgaggaaggcgtggcgttgctgcacgcgatccaggacgtctacctcgatcctgcggtcgaactcgcgtgagcgtgtcgcggcgcgcgcctcaggccagcgccgcgagccgttctgcgacgtcgtagagcgacggatcgacctgggcgatcgcgcgaaaggcatctcgtgcctctgcgtagcgtccttgtcgctcgagcagggtcgcgagctggtagcgcagtcggagggcccggagcgacgtggtctgtcgctcgcgttcgagtgcccgacggatgacgtccaccgccgtgctgaggcggtcggtgtccgcgaggtggcttgcccacacgatacgcccctcgaccatggcgtccttcgacgggctcgcttcgcggagcgcgcgccaccaatgctcgacggcctcagcgtcgccttcggctcgagcacagtccatgaggatcgctccgtgcgtcagatcgccggtgaggtcaacgaaggtggcgagatggcgtgcagctcgagcgaaatctcccaagcggtagcgcacgagaccgagcagttcttcgatggggggcgacgcaggcgcgaggcgctcgatgcgtgtgaggatgcgaagcgcctcggcgtagcgatcctcggcatagtgctgtgctgcctcggcgagctgacgctcgacgactggccggagccgaggcggcgccgtcagctcgctgggctcgatcgcgacgggctctcctggcttcgcgcgtcgccggttcggcctcgtcggggcgaggtagcgctgtcggcgcgggctcgtggtgtcgaagcgcacctcgggcaggcgcccgctggtgcgcgagggctgcggctgcttggaggactgccctgccgtgcgagcaggacggtgggcgccatcagagcgacgctcacgcgcctcgccctcggggcgacgtcccccgccaccacgacgcgggccctcccaggaaccctctcgacgggacggccgacggtcgtcgtcgaagcgacgctcacgcgcctcgccctcggggcgacgtcccccgccaccacgacgcgggccctcccaggaaccctctcgacgggacggccgacggtcgtcgtcgaagcgacgctcacgcgcctcgccctcggggcgacgtcccccgccaccacgacgcgggccctcccaggacccctcgcgacgggacggccgacggtcgtcgtcgaagcgacgctcacgcgcctcgccctcggggcgacgtcccccgccaccacgacgcgggccctcccaggaaccctctcgacgggacggccgacggtcgtcgtcgaagcgacgctcacgcgcctcgccctcggggcgacgttgcccgccaccacgacgcgggccctcccagcggttggcagaggtgccgtttccggagcgatccgagctgcgttgccccgcggctcgggcccgagactgagggttgcgctgcccgtcgcgttcgcgtgctcgagtgtcgggacgggggcgctgtgtcggggtttgtcgatcagactgggaaggatcgtggcgttgaggtcgtgcgggcatgcgtaagggcttcttcctggcgatggagtgtgacgggtgcttcagtctacgtgccgattgcggcggcgttcgcggagagacgggagtccgctgccgacagcggccctcggcgacacgagagtagcggtcgctctgcgctcaccggtggcggtcgagggtggtcacggtgctgtgcgaaggcgcggtcacctcggcgaccctggcgcccatgttgagcatctcatccccggccagcctttggagaatctgccgcgtgtggtgcttcgagcgtcgtgggtgctcgctcccgcgtgtgcatcgtcctcgagatcctcgccgagcgagtggtcgcgtcttggaggtcggccgcaggcgagcgtcgcctccggtcggtcggtccgatcagcacctcggggcaggagaggaccggtctcgcagccctcgggatgggttgggtgtccgtcggcatgcggtcgtccctcgtgccggcgaccagggtcaccctcgctagggtcgtctgtcgagggtgcggtcggtgacgggcagtgccatggtggctcgcgagcaggatggtccgtgagcgggagcatccgcggctgcgtgcacgtgcttggcgcgctcgattgcgaggcgtgctttggcaaccccgacacgcacacgatctcgtgcgaacgcgctgcgtgccagcgcgggcgatggctggaacagagtcagttgccctgggtgctgtcgtgccatgaccctctgcttagaccgagggtcggacggcctccatctcgctggcgttgacggcatcgatgagttggcgcaggcgtccgaacgagcgccggtcgaagcggagggcgaggcgcgggagatccggatggtcgtgctctcgcacctcccacggcgtcgcgcggacgcttcggatgcgaccgtcggtggtgatgtcgccgaaggcgacctcgaggtcggcgacgcgcgcgggggagagtctcccgttcagtctgaggatgaggtctcggccgacgacgcggagcgagtggaagactcgatagaagccgaacacctcggccagggcgtcgtcgatgtcgtccgagcggtgaagcagcgtgagatcgtcgcggtcggcaagcccccggtcgacgatgcgatcgttgagcagctgccacacgccgtcccagtagtgggatccagcgggctcgagcaggatcagaggggcgatctgcgtcttgcctgtctgcatgagcgtgaggagctcgaacgtctcgtccaaggtgccgagcccgccggggagggagatgaaggcatcggactcgcgcaccatgagtaccttgcgagtgaagaagtacttcatctccaacagtcggccgtgttcggcgagttcgtgatcgcctggttgttcgaggggaaggcggatgttgatcccgaaggcgtgatgaggtcctgcgccgcgcgccgccgcctccatgatgcctgggccgcccccggtgatgaccatccagccagcctgagcaaggcgggcgccgagcgtctcggcgagctggtagctcggctcgtcagggtgggtgcgagccgagccgaagaccgtcaccttgcgctgggttcgaaacgggccgaacgtctcgaatgcgctccggagttcgcggagcgctgaggtcagcatcttgaggtcgagtcggtcgaggggcgcttcggtggccgcgagcgcctcatcgaggaggagctgcttgaggtcactgtcacgtcccgcgaccgccggtacctggttgcggtggtggtcggatgtcatgagtgcgtgctcgcgatcgtgacgtccatcaggtgctcgtagaacgtcgttcgttggacgaggtggcggcctcgctgcgctgcgatcgcaccaagctcggcgacggtgagctcgctcgcgtgtgccgccccggctgcgtgcgaaatcgactcctccatgagcgtcccgccgaggtcgttcgcgccggcgtcgaggaggagcacggctccggcaggccccatcttcacccagctggcctggacgttgtcgataacaccgtggtaggcgatgcgccccaccgcgtggaggaggacggcctctcggagcgtcggaccccggcgggcacggccagcgaggaagatcggtgcgcccatgtggacgaaggggagaggcacgaactcggtaaaccctcgtgtgcgcgtaccgagcgcccgggtgcgcatgaggtgccgtgcggtgtgcgtggtcgtctcgaccgtcccgaacatgatcgtcacgttcgatcgcaagccgaccgcgtgtgcggtctcgtggacctcgagccactggtcggtggtcagcttctcggggcagatcaccgcacgtacctcgtcatcgaggatctcggcggccgttccgggcaggcttcgcacaccgcgggcggcgagctcgctgaggtaacggtcgaggggccagccgagtcgtcggctcccctcgaagacctcgagtgccgagaacgcgtggatgtgcatggccgggaagcgttcgtggatggcttcggcgatgtcgaggtacgtgccgccgtcgaagcgaggatggataccgccctggaggcagacctcggtcgcaccacgggcggctgcctcggcaaccttggcgaggatctgctccatcgacaggagatagggtgcgccacggagcgccaaggagcgcgggccgcgcgagaaggcgcagaacccgcagccgaaggtgcactggttggtgtagttgatgttccggttctgaacgaaggtgacgacgtcgccgttcgtctcgcgccgcagcgcatcggcgaggtcgatgaccgcctgtgcgtcggttccgcgcgcactgagggcgtgctcgagcagctcgagcgagggaccctctcccgatcgtgacgccgcttcgagctcgtcgaaccaaccggccggagctcgtcggctgacggtcaccacgcgcggggggaggggacctggtcgaccggagaaccactggtgctcgcgtgcgaagccatcgcgatccatggacgcgcgcactgcgggtcggagcgcgtcgtcgacggcgtcgtcacgtcgcgcgtactcggggtagagcgcgaggcgcggcacgaggtcgcggcctgcctcggcgaggcgacgctcgaggagctcgatctcgggccacgggcgttcggggttgacgtgatcgggggtgacccgcgagatgccgccgagatcgtcgatgcccgccgagaggagcccctcgatgtcgtccgagaggttcgggggtgcctgaacatggacggtcggtgggagcacgagacgcgcgagtgcgatggtacgcagatgggcctcgtgatcggcgggcggggcgtgccgcagtcgagtaccaggttttgggaggaagttctggacgatcacctcttggaggaagccggtctcctcggcgatggcggcgagggcttcgagtgcacggaggcgatcggcttcgctgtcaccgatgcccacgaggatgccgctggtcgtcggcacgtgctggagtgccatcgcacgtaccgttgcgaggcgcagatccggatccttgtcgggtgcgttgcggtggaccgggaggtccggtcggatggactcgagcatcgtgcccatcgagacggcgtgcggtcgtagcgacgcgacctcttcgggcgtgagcgtcccgggattgaggtgagggaggagtccctcggcgatcgcgacgtcagccgcggtgcggaggtagtccagggtggttgcagcgcccagcgaacgcagtgcatcgcgtgcgctggaccatcggagctcagggcgctcgccaagggtgaagagcgcctccgcagcgcccaccgccgcccccttgcgagccaacgcgcggacctcgtcgaggctcaggaaggcagatccgagtcgggcgggcacggtggcgaaggtgcagtagtcgcagcgatcgcggcacagacgcgtcaacgggatgaacaccttcggggagtaggtgatcctcggcccgaaggttcgatcgcgccgacgagcagcttcggcgagcagtcggttggtggaccactcgagcagcgccttggtcatggggtcaccctagccatcatggctgacgatcgagggatcgagcgcgctcgccgcggcagagtcgaggagccagatcgtgtcgtcgcgggtgacgtgcacgacggggaggtcggcaccgccgagcgccgctgcgacgatggttgccttggaggctccgagcgccacgatcacctgagtctcgaagcgcgcgagagcatcgcgtgtcagcgagaggcgccagtggcggttgtgtccgctcggatcgtgattgggtgtgacgaggcctgaggcatcgagacctggggagcccgggaacaggctggcggtgtggccgtcggccccgatccccagatggacgagcccccaggtgggacgcgactcgagctgcgcgccgtagcgggcagcgagcctgtcggcgagcttcggcactgtggccgggtcctccgtggcgagggttgcgaggtccgcgggcgtcagtgcatcggcatccaccatcggcaagagggccggaccgcgtccggtcaggaccgggccgaggtgtgtccagttcgcttcgggcgagccgggctcgacgagcctctcgtcgacctgcgcgatcgtgccggtgcgtgggaggctcggcccgagtgcgtccaagagggcgaggatcgtcgatccgccggagagcgcgaccaaggtgtcgcgttcgagcgcgtcgtggatgagtgccgcaaagcgcgttggcacgtcgttgctgacgatgacgcgagccatcgaacctcctcgtccggtcgccttccctgctagggtaggcgacgcggtggctgcggtcgcaggcagcacaaggacatcgaccgcgcgagcagctaggggagcagggtggatgcgcgaggcagatgaggttcgagacgtcctccgggtcgtcgggcgttacctcaagcaagagaccgtcgatccgttccgcgcgatcggtgccatggtcgtgtggggcctcgttgggtctgtgctcgctgccggcggcttcgtgctggcggggatcggactgttgcggctgctccagaccgagacgggaacgaccttcgccggccatctggactggctcccgtacgtgatcgtggtcgtggtgctcgcagttgtggtggcgatcgcggcagcgcgcattgggcgccgggcgaaggcgtaaggcgggaggacacatggcaaccgaaggccgggtaacgctcagcgacgtcgaggagcgcattcgctcgctgactgagcaggcgtctcgctccgccagtgcggtgcggcctgcggtccctggcgtcgccgggatcgcggtcgccgcggtcgtggtcgtcgcgttcgtgctcggttaccggcggggtcgtcgttcgagcgtcctcgagatcactcgcctgtgatggctgcatcccggcgcgtgctgcggtcgcttcgacgacagcgttcccgcctcgtcggtaccgtgctggggctcggcgggccagtggcgggcgtggtgtggggcatcgtcgcgctgcgttggatcgatcgacgcctgggtcggcgtacgagaacggcgcgcatcgatctctcccgtggcccggtgaccttgcgactgcgcgagcgtcggtgagcggggcattccaggtcggcgattcggtcttgctggtcgaccatcgcggtcgcgagaccgtggccgaactcaccgaggccggcgtcgtgcgcacggccgtgggtgaggtcgcgatgggtgatctcgtcggtcacgagccgggtgaggcggtcgtgacctcgaagggcaagcggatcctcgccgtacgtccgacgctcgccgagacggtggtccacatgccccggggcgcacagatcatctacccaaaggacgcgctggccatcctcggcgcgctcgatgtcgcccctggtcagcgggtcctcgagtgcggtgtcgggtctgggggcctgacggtctggctcgctcggctcggtgcgtcggtcgtggcggtggagcgcaggcccgattttgctcgacgtgctgagaagaacgtggcgcatctcggaggctcggagcgggtctcgatcatcgttggcgaactcgccgacgtggctccgccggggccctacgaccgggttgtgttggacatggtccatccgtgggaggtcatcccctggatcggggcagaactcgcccctgggggtcgcatcgtcgcctacgtgaccaacgcgctccagattcacgagacggtggaggcgctcgaggcgagcggctacgtccgcatcgaggtccgggagctcctcgagcgtcgttgggtggcacggggcgagatcgttcggccggagctgcggatggtggcacacaccggcttcatcgtgtcggctcacatcacgcctcgagcgcgtcggttggccgctgaacggccgcgcgagatcagcgtgtcgggtgtcgtcgatgacggctcgctcgacgagagcgcggacggcgacgtcgacgacgagctcatccaaacggaggaccgaccctaggactcacatcctcgtcggcgcgttctctgcgcagtctcaggcatgtcgtgaggggccggcgagtcgtgccgacgcgagcggccagacgggtcgtacgctgggtcgaccctgacggtgggtggagcaacccttggcccgaacgtcgacctcgacgagttcgttcgtctctcggcccgtatccgtcccgtatccgcgctgccggggaccgcgttcgccgcggggggcgaaggttgcgagttgtcggggttcagtccgcctcgatgaagatgcactcgccggggcactcttcgctggcctcggtcacggcgtcttcgagctcgaccggaaccgaggccatctgggcagagcccccagggttgttcaggacctcgccgttgtccttgacgtaggcgaggccgtcgtcgaggagcgtgaagacgggagggcagatctcctcgcagaggccatcgcccgtgcagagatcctggtcgatccacaccttcatcgaaaccctccatcgattgacgtcgcccacttgagactagtgggtactcacccagggaatcacgggagcgcgggaccgttgacggtgtcatggtgtcgtgcccatgcggtagtgtcgcggtggagggaggttagccatgccacgcgatgagaccccggaacgtgagcacgctgagcagcagtcccgccaagcgctcgaggaggaggtgcgcgaactccgccgacgtgtcgaggaggcaccgagtcgagttcgtgccctggaggagaagctcctcgaggtgtcgggagcgttggctcagacccaggcgaagaacgagaagctgaccttcacgctgcagcaggcacgagagcacatccagaacctgagggaagaggtcgagaagctgacgcagcccccgtctgcgtacggcgtctacctggcggccaaccaggatggtacggcggatgtcttcaccacgggccgcaagatgcgcgtggccgtgcaccccgagatcgacctggcagcggttcgcgtcggtcaggaagtcgtcctcaacgagtcgttcgccatcgtgtcggtgcgggggagcgacgtgatcggagaggtggcgacggtcaaggatgtgctcgacgacgggagtcgtgtgatcctgctcggacgggcggacgaggagcgggtggcgcaggtcgctggtcatctgcagcacccgccgctgcgcgtcggtgattcggtcatggtggatccgcgttcggcgatggtgctcgagcgactgccacggcccgaggtcagcgaactcgcgctcgaagaggtccctgacatcacctatcacgacatcggtgggctcgatcggcagatcgaggagatccaggacgccgtcgagttgccgttcctctaccgcgagctgttcggcgactatcggctccccgcccccaagggcatcctcctctatggccccccagggtgcggcaagacgctgatcgccaaggcggtcgccaactcgctcgccaagaaggtcgagcaggtctcgggccggagcgtgcgaagctacttcttgaacgtgaagggtcccgagctcctcaacaagtacgtcggtgagaccgagcgccagatccggttgatcttccaacgcgcacgcgagaaggccgaggaaggcgttccggtcatcgtgttcttcgacgagatggactcgctgtttcgcacacgaggctccggcatcagctccgacatggagtcgacggtggttccccagctgctcgcggagatcgacggcgtcgaagccttgcgcaacgtgatcgtgatcggcgcgtccaaccgagaggatctcatcgatccggcgatcttgcgcccgggtcgtctcgacgtgaagatcaagatcgagcggcccgacgagcaggccgcacgcgagatcttcgcgcgctatctcacgccggaggtcccgatcgatgcgggcgaggtcacgaccctcggcggtggcgatgcggagaaggccatcgcggtgatgatcgagcggaccgtcgagcgcatgtacgccacatcggacgagaaccgcttcctcgaggtcacctaccagaacggcgagaaggagatcctctacttcaaggacttctcgtcgggtgcgatgatcgagaacatcgtgcgacgggcgaagaagctcgccatcaagcgcgagatcgcgggcgggtcgcggggcatctgcctcgatgacctcctcgcctccatcgcgaaggagttcaaggagcacgaggatctccccaacacgaccaatcccgatgactgggcgaagatctccgggcgcaagggcgagcggatcgtgttcatgcggatcctcctccacgaggaggagggacagacgggtgggcgcgccatcgagcgcgtcgcgaccggtcagtacctgtaggtaccgagtagggaggtgcgatggcggtcgcaaaggttctcggcatcgaaaccgagtacggcatcaccgtgccgggggtgccggaggcgaaccccatcaccgcctcctcgagtctgatcaacggctaccttgcccagctcgccgggaggacgagctgggacttcgttgacgagtcgcctggccaagacgcgaggggcttcagcgtggataccggcggcaacatcgagctcgagacgcacctcgtcaacgcggtcctcacgaacggggctcgcctctacgtcgatcatgcgcacccggagtattcctcgccggagtgtcgcacaccgcgggaggcgaccctctacgacaaggctggcgaggaggtgatgcggcgagcaatggctggtgtcgccgcactgaaccctcatggaccagcgatcgtggtctacaagaacaactccgatcgcaagggcaactcctacggttgccacgagaactacctgatggatcgtcaggttccgttcggtcggatcgtcacggagctggtcccgttcttcgtgacgcgccagatcgtggtcggggccggcaaggtcgggtccgaagccccgggggtgtcgatccgcgaggttcccttccagctctcccagcgggccgacttcttcgaggaagaggtcgggctcgagaccacgctgaagcgtccgatcatcaacacgcgcgacgagccacactcggactcgcagcgcttccgacgtttgcacgtgatcctcggggacgcgaacctcagcgaggtggccacgtggctcaagctcgggaccacggccatggtgctcgccatgatcgaggacggtgagctcgaggacctcgggatctccatcgtcgacccggttggctccctacggcgcctgtcgtgggaccccacgctcaaggccaccgtgacgttggccgatgggcgcaccatgcgtggtctcgacgtgcagtgggcctatcgagagcgcgcagagcgctggctcgatcgcttcggcggcgaggccctcggtggcgatgacgaggcccacgcgatcctcgaggagtggacggatgtcctcggcacactcgagcgcgaccccatgagtcttgccgatcgtctcgattgggtcgcgaagtggtccctcgtgcagggctacatggagcgacaccacctcgatatcactgatgccaggatcgccgcgctggatctgcagtaccacgatgtccgcccggagcgatcgctgcagcgccgtcttcgcatgcgaagactgacgaccgacgaggaggtcgcgcgcgcgacgacggagccgccgccgagcactcgggcctactttcgcggtcggtgcctcgcgcggtttccgtcccaggtcgcagccgcgaactgggactcgatgatcttcgacgtcggcagcgatccgcttcgacgcgtgccgatgatggatccactgcgagggacgaaggaactcgtcggaacgctcctcgagtcggtgggctcggtggacgagctactcgaggcgcttggggcctaacatacctagtgaggtgatcatcgtggctgagcgcgaacaggtcagacggagtgggacggagcgcgaggaggaggccgaagaggtctcgacgcagagcgcggcgagctctgacaagctcaaggccgagatcgacgacatcctcgacgagatcgatgaggtgctcgaggacaacgccgaggagttcgtccgcaactacgtccaaaagggtggcgagtagcggtcgggtgaactgacgggctcgagggccgacgacggtcggcctgagcacggggccgacgacggtcggcctgagcatgaggaaggatggagcaaggttggcgttaccgctctttgaccctcggcacgacccggggccggattttgccgcactcgtctcgcgggacgcggctcgcaccgtgccgacgtcgggcgatggttcgctcggcgctcaggtgccgcacgggaccaccatcgcggcactgcgctttgccggcggcgtcgtgatcgctggcgaccgtcgcgcgaccgaggggaacttcatcgccaatcgtaccatcgagaaggtcttcccggccgatcgcttctcgggcgtcgggatcgccggtgccgcgggtccggccgtcgagatggtgcggatcttccaagtgcaactcgagcactacgagaaggtcgagggcaaggcgctctcgctcgagggcaaggccaatcagctcgcccagatgatccgccagaacctcccgctcgcgatgcagggcctcgtggtgatgccgttgttcgcgggctgggacgcagagcgcagcgagggtcggatcttcaccttcgacgtcgcggggggccgctacgaggaggtcgcctactacgcgatcgggtcggggggtcgtgatgctcgcgcgaccttgaagctcggatggcggcccggcctcgacgaggcaggggctgtccaccttgcggtccaggcgctgtacgaagcagcccaggaggacgccgcgaccggtggacccgatgcgctgcggggcatcttcccggtggtcgcggtgatcgaccgcgagggttaccggcgcatcgacgacgctcgcctcgaggagatcgcggtcgaactcgaccaggccgtgagggagcgaggtgcgcggcgatgagcatgccgttctacgtcgcgcccgaacagctcatgaaggatcgggcggactatgcccgcaagggcatcgctcggggacgagcgctgatcggcgccgtctgggaaggtggcatcattatcgtcgccgagaacccgtccagatcgctgcacaagctgtcggagatctacgatcgcatcgccttcggcggcgtcggcaagtacaacgagttcgaccagctccgcgtcgctgggattcgtcacgccgacctcaagggctacgcctatgcacgagaggacgtcgacgctcgcagtctcgccaatctctacgcgcagtaccttggcacggtgttcacgcacgagatgaagccgctcgaggtcgagatcctcgtggcggagctcggcaacggacatcgggagtcgcagctgttccagatcctctacgacggcaccgtgatggacgagcgcgagttcgctgtgctcgggggcgatgccgacgcgatcgcggagcgcttccgtgcgctctacgacgcgagtggtccgagggagcggctgctccagagcgcgcgagacgcgctcagtgggcaacgtcctccgatcggggccgacgatctcgaggtcgtggtgctcgaggatcgaggcgagcgtcgctgcttccgacgcctcgaggtcgacgaggtgcgcgaggcgctgggcgatcagccggaggggagtgcctgagtgccccgcttggcacggcggatctacggcatcgagaacgagtacggcatcacctgcacccagcgtggccagcgtcgcctgagtcccgacgaggttgctcgctacctgttccggcgcgtcgtgagctggggccgctcctcgaacgtgttcctcgagaacggcgcgcggttgtacctggacgtcggcagccacccggagtacgcgaccccagagtgcgactccctgagcgatctcgtcgcccatgacaaggcgggggagcggatcctcgagtccttggcccattctgccgaggccaagatgcgcgaagagggcatccgcggtgacgtcttcttgttgaagaacaacaccgattcggccggcaactcctacggctgtcacgagaactacctcacggtccgcgtcgacgacctgacccggctcgtcgaggtcctgatcccgttcctcgtgtcgcgtcagatcatcgccggcgcgggcaaggtgctgctcacctcgcgcggtccgctctatgcggtctcgcagcgagccgagcacatctgggagggcgtgtcctcggcgacgacgcggtcacgtccgatcatcaacacgcgcgacgagccgcacgcagatgccgagcgctatcgacggctgcacgtgatcgtcggggactcgaacatgtcgcagtgggcgacctacctcaaggtcggagccatggcgatcgtgctgcgtcttctcgaagaggaggtcgtcctccgcgatctcacgctcgagaatcccattcgggccatccgagagatcgcccacgacaccgaactcgagcgcacggttcggctcgtcaacggtcgcgaactcacagggctcgagatccaagaggcctacttcgagcgggcggagcgctaccacgagcggatcggtctgcctgcggacgaggcgcgcgcactcgacatgtggcgcgaggcgctgaaggcgctgcgcgcgaacgatcacgaggcgctctttggcaaggtggactgggtcaccaagctcaccttgatcgaggcctttcgggcgcgtcatcagctcccgctgtcgcatccgcaggtgtcgctgctggacctgcagtatcacgacatcagccgcgagcgaggcctctttgctcggctcgaggccaagggtcgggttccgcggatcgtcgacgacgagaccatcgagcgtgccgtcgacgaacctccggcgacgacgcgggcggcgctgcgggggcgcttcattcgtgcagcgaaggaggcgcaccgcgactacacggtcgactgggtgcacctcaagctgaacgaccaggcgcagcgaacggtgatgctgaaggatccgttcgcgtccgaggacgagcgcgtggatcggttgctgacctcgatctgatggctcgccgtcgccgagcgggctggctcgcactggcgctcctcgtcgtggcggccgtgctggcggtgcgcgcatgggtgctcacgccgttcgtcgtccccaccggttcgatgcgaccgaccatccgtcccgggtcgtggatcctcgtcgatcgactcgccttcgacacacaccccatcgaggtcggtgacgtcgtggtgcttcggcgaccggccgacgatccgggggaggcgaactcggactacctcgtcaagcgggtgatcggcctgcccggtcagacgatcgccagccgcggggggcacgtcgtggtcgacggacgggtcctcgcggagccctatctgcctcgcggcgatcggacggagggcatcgtgccccagacgatcccgcggggcgaatacttcgtgctcggtgacgatcgcggcgattcggtggattcgcgcatctttggacccgtgccagcctccagcatcgtgggcgaggtcgtcgcggtggtatggccgccgagccaagcacacgtcgttcggtcgtagctgtgcccgggcgtcaggcgttcccgcgttcgccggcgatgcccttgcgaaggaagtccacccaaccgggcgtctcgagggcgtcgcgcagcgatgccgcatcgtgttcgtcgagtggggggccgtcgtggtgttcggagagctcctcgggcagccgccagaactgcagccgtacgccggctgcgaccagcacctcgacgatgcgccgttcgaccggtttggcgacgatgaacccgcagctcggacagcggaacgtgtacgaggcttcgccgttcgaggagcagagcatgatcttgacacgcccgggcgcgacctcgacgtccccgcactctgggcacgaggccttgatgatcggcatgggcgactcccttcgcaaccgcgcgtccgtgacagagggtctatcggcacgcgcggcgccggtgttgagtgctgcggccgtcgacctcgacgcgactccaagagaatgtgccgtgtgcaggtagactcacgccggtgacgcagtctctgcgagcgaaccgtgtgctctcgggcgtgcagcccaccggcgtgggtcatctcggcacgctgctgggtgcgttcatgaactttctcgccgaccaggagcgggcggagtgcatcttcctcgtcgcggatctgcacagcctcaccgtcgaccaggaccctgcggcgcttcggcgccagcgttacgagctggtggcgaccttccttgcggtgggcatcgaccctttgaagtcgaccatcgtgatgcagagtgaggtgcccgagcatgccgaactcgcctgggtgatggagtcgaccgcgacctatggcgagctcgcacggatgacgcagttcaaggacaagtccgctcgccagacgaaggtgcgcgcgtcgctgttcacctaccccgcgctgatggcggcggacatcttgctctatcaggccgatgtcgtgccggtgggcgaggaccagctccagcatctcgagctgacgcggaccctcgccgagcgcttcaacggcgcctatggcccgaccttcacggttccgaagggtcagcttccgacccatgccgcacgcgtgatggacctcgccgagccgacgtcgaagatgagcaagtcctcctcctcgcaagcgggcatcgtgttcctgaccgacgacgacgcgacgattcggcgcaagttcctccgcgctcgtacggattcgttcgccgaggtcgtctggaagccagacgacccgtcccgtgccggtgtgaccaacctcgtcgagatcctcgccgcgctcgagggcaccgacgcatccagcgtcgctgctcgcttcgatcgctacggaccgttgaaggaagcggtcgcggaggcggcggtggccgccatcgccccggtgagagagcgcttcatggccctgcgcgacgacgaggcgaccctgcggggcgtgctcgaccaggggcgtgagcgcgcccgggacatcgcccgcacgacgatggccgtggtgcgcgatcgcctgggcctgacctgacgaggcgtggagggaccagcgtggatccggccaaggtgctgttcatcgccgtcgcggcgctcatcgtgctcgggcccgagcgcctaccggcggtcgcgcggcgtgcgggcgagctgtggtcgctcgcacggtcgccgacggagtgggtcgcgaagcatctcggcgaggtcgcgcacgcagccgggatccccgaggacgtgctgcgcatcggtttgccaggaggcctggatcgctggctgatggcttcgggccccgccacgagtgcgtcggcccaaggccccgcggctccggcgtcgccccctcctggccaggcctcctcggcgacgccgacgggcgccgcatcgatcgtggcgggaccctgggagctgaactagtggcgctgcggcggccacgacggcgccgtctcgaccccaacgcgatgaccaccgtggagcacctgcgggagctgcgacgtcgcctgattcgcgccatcgtcgcggtcaccatcggcgccatcgcggcctatgcggtctacccgcacctgttgtcggtcctgaccgaaccgttgtgtacggtcgagcacgaaccgcactgcgtgctgtacgtgaccggaccgatcgatgggttcgcgatccgtctcaaggtggccgcggtggcggggctgttcctcgcctccccgatcgtgctctgggagctgtggcgcttcgtcgctcccggcctcaagcggggcgagcgacgcctgacgctggggtttctcgtgtcgtcggtcgcgctgttcgtggcgggcggcgtggtggcgtggttggtctatccacgcgccctcgggttcttccagtcggccgcgggcgcccaggtgcacgcgatctacacgccgcagagctacctgtcgctgttgctgatcctcatgatcgccttcggcgtcgccttcttgttcccggtcgtgctggtcggcctcgaactcgctggcgtggtgagtccggccgcgttgcggcggcaccggcgtcccgcgtggctcgggatcatcgtggtggtggcgatcctcatccccagtaacgatccctactccttgaccgcgatgacggtgccgctcctcgtgttctacgagctgtcgatcgtggtcggttcggcgctcaccaagcggcgggcacgcgtcgccgacgccggaggctaagctcgtcctcgacggggaggctccgctggtatctaccttccgcagccgattcgccgaaacgctcggcttggtcatggatcggttccaggacgaggccctcgaggcgctcgacgaagggtcttccgtcctcgtcagcgctcccaccggttccggcaagaccatcgtcgcgctctatggcatggcccaggcccttcgacagggacggcgagccttctacacgtccccgctcaaggcgctgtccaaccagaagtaccacgagctcgcccgtttcttcggtcctcagcacgtcgggttgctcactggggacaccacgctgaacccggacgcgcctgccgtcgtgatgacgaccgaggtgctgcggaacatgatctacgcctcgccagccgcgatcgacgacgtcgacgtcgtggtgctcgacgaggtccactacctccagaacccgtaccggggatcggtgtgggaggaggtcatcatccacttgccgcgccgcgtccgcctcgtctcgttgtcggcgacggtgtcgaacgtggcggagttcgctggctggttggccgccgttcgaggtacgacgcgcgtcgtggaggcgacccaccgccccgtcccgctcgagcatcgctacctctacacgccgcggcgttcggagacgccggtcgcgataccggtcctcgtcggtgggagggagaacccccagggggcacagctcgatccaccctggctcgcgcgcagtcgttaccgagacgggcttcgggctcggacggtccatcggatcgagctcgtcgagttcctcgctcacgagggcgatctgcctgccatcgtgttcatcttctcccgtgctgggtgcgagcgcgcccgcgatgaggtggtcgcctccggcattcgactcaccaccgcggccgagcgggtcgcgatcaggcgcatcgtcgacgagcgtctcgacgggttggccgagcgcgacctcgcggccgtcgggttcgcgccgttcctcgcgggactcgaggcgggcatcgcgccccaccacgcgggcatgatcccgccgtttcgcgaggtcgtcgaggcgtgcttcgagcgcgcgctcgtcaaggtggtgttcgcgaccgagacgctctcgctggggatcaacatgccggcccgatcggtcgtcatcgagcgcctggtcaagttcgacggggagtcccaccagctgctcaagcccggcgaatacacgcagttcgctggacgggcagggcgtcgggggatcgacgagcgcggcaccagctacgtcgtgtggggtccgcaggtcgccttcagcgacgtcgcgcacgtcgtccgggcggacttctacccgatcacgagttcgttccgtcccacctacaacatggcggcgaacctcgtgaagcgctacacgcccgagcgcgcagctgagctgctcgatctctcattcgcgcagtaccagcgagacgccgaggtcgtccggcgccaggcgcggttgcgagcaggcaacgaggatgtcgtcgcggcgacgacgcagccggagcgcgctgagtggatcgagccgggtcgggtggtgagcgtcccgagcgagcgcggcggtgccgagcgagcgctgctgctcatcacgcgggtgtcccagcggcgcggtggcgggcttcggatcagtgcgtcctcggagtcgggcagggtgtatcgcctcgacgaggggcacgtcgcctcgatgcgacccaagggcaaggtgcgcctccgtgcggtgcacggctcccgggaccaggggatcgccatggcctgggcacggatccgggcgcggcgtcagcaggcgcgggagctcggcgaaccgtcgaaggcattcctcgacgagcgtgcgcgtggtcgtcgcaccgacgcgccagcgccgtcgccccgttcgcgtgagttgctctcggaacagctcgagcgtgtgcgcacggtgctcgagcgcttcggcttcgccgaggggtggagcctgacgcagcgaggcgagcgactgacgaaggtctacgtcgagacggacctcgcggtcgtcaggttcctccacgacgccgagatcgacggcgtcggcccggcggagttcgccgcgatcgcctcgtggttcgtgttcgaaccacgacctcattcgccccgatccggtccgtggccagcgagcgcggccatggcgcggctctacgagcgggccgaggcgctcatgcaggagcagtgggcggcggagtcgtcgctcagactgcctcgatcgcgcggtccagagcccgggatctctcgcgccctctggcggtgggcgcggggagagccgctgggggcagtgctcgcgaccgacgagatggcaccaggggactttgttcgcgtggtcaaacaggtcgcggacttgcttcgccagatcgcggtcgcctgggacgacgatgtggtctcgtcgctcgctcggcgagccgaggcggcggtcgttcgcggcgtggtggcgctgtcgtcggaggtcgtcgccgaggatcccgagcgcatgccccacggagtgctcgagctcgacgagcggccggcgtaggctggcccgctgtggcgagctaccttcctgagcagttcgacgaggcggagcgggcgcggctcgctcctttcgtcaccgacgtcgacggtcgtgtgttcggtctggtgggcctcgacgaggaggtcgtcgcagccctgttcgcacgctactcgcgcacgtccaggtcgcttcggcggacgctgctggaggagttcgcgccgagggtcgaggacgcggtgcgagcgggcgtcggtcgtgagcgcaccgaggctctccttgcccgcgtgatcggcgagtacggcgacgactcggtcgcccaactcgcggtcgtgcacttcgcgatcgagcagatcccggccttgctcgcgcgccgcatcgagcgcggccgtcttgcggcctatctcgagcaatccactcgctacgtgccgctcgcgactcgccgttcggatgggagttggccagcttacgtccccgacggcctcgcgccgcgggcggcgcgtgcctacgacgaggccatcgaggcgagctttcgtgcctatgcggcggtcctcgaggcggtcgaagaccatctcgcgaagctcgatccaccggccgatgcgccggctcgtcgtgcgcagcgggccgccgcactggatgcagcgcgcgggttgctgccgctcgccgtcttgaccaacgtcggtgtcgtcgccagcgcgcaggcggccgagcgcttggtgtggcggctccgggccgacgccacgcctggggcgagcgaggttgccgacgagatcgcccgggtcctcggagtgctcgtaccgggcctcacccagcgcatggaccgccccgaccgcggtgggcggatggtcgagtatctgcgcgagacgcggggcggcgtcgaggttccgtggcactggaacacggcgatcgtcgaaccctccgttcggatcgtccgagccgacgaggatgcggagcgccgcgtcgctgcatggatgctgttcgagcgtggcgaggtggactcggtcgaccagggccttgccgcggtggaggcgcggggcgaggagggcctcgatgcgctgttcgtggccggcgtcggccatcgggccaatcgccgccacctgcccgggcgccccttcgaggctgcggtgtacgagctcgagatcacctgcgacatcggagcctttcgcgacctcgcccgccatcgcatcttgaccctgctcgagccaccgctcgtgccgggtcgtgggttcgcgctctccgatctcgtcgtcgacgcaggcgtcgcaccgctcgtgctcgagcattgggagcgactcggcccgctggtcgcgagcgtggtcgccgaggccggaccgtcggtgggtcggttgctcttgccgttcgcgacgcagatccgcttcgcggtcgtggtgaacgcgcgggagctgatgcacctcgtcgagctgcgatcgcagccgcagggtcacccggtctatcgccgcatcgcgatcgaggcctggcgcgcgctcgaggcggtcgggcatcgccggatcgcaggggccatggagttcgtggacacagagggctacactgtgggccgcctcgccgccgagcgacggagcgaggtgcgatcgatgcagtcgggaaggatcagcggggctgatccgttgagctagccgagctggtgcgcgaccggctccgtgcgaggaggacgaggacgagtatgccgagacgcaagggcgacgagtcggcatcggaaccggaggttccacacgacgacgagctcgacgaggagctggtgggcttcgacgacgatctcgatggtgacctcgacgacgacgtcgacgaggaactcgaagatctcgacgaagagatcgaggaagagggcctcgaggttggcgatctcgaggatctcgaggccgatgatctcggcgaggccgacgacatcgtcgacgatggtgtcgacgacaccgaggacggcgaggtcgccgttgtcgacgaggaggacgacgatctcgagggcgacgaggacgtcgagtcggccctcgacgagattctgagggagcgcttcgtcggcggtgacgtcgaagaagatgtcgaggccgagtcggacgaagacacgcccgatggtctcgccccggtacggcctcgccaacccggcgagttcgtgtgccagtcgtgcttccttgtcaagagcatgtcgcagctggcagactccgagaagatgctgtgccgcgattgcgtctagacggatcggtggcaccgtaagcttgaggttggccccaaaggaggcgctatggcagagcagcaacgtcgacagctgttcgatgatgtcctcgatcgcttcgtgttcggcccggtcggtgtcgccgctgcggtggcacgggtgctaccgagcgcggcggaggagggtcgcaaggtcctgcagggaccgatccagactgcgcagttcgtctcccagatggccgctggggtcgtacgggcacgctacggcgagcagttgcggggagtcgaggagcgtctcggcgacgtgagcgagcgcgtctcggcactgcgttcgatggtcgagcaggttggcggcgggatcgtgcgcaccgtccagcagaccgtgccccggccgggtgcgggcccacgcgatgcggctcccgatgccgaagccgcatcggccgccacgcgcgaggcgaggccgtcggatgcgcacgcaactggggaggaccacgccggcagtgtcggtgggatcgatgcctacgcgaccctgtcggccgccgaggtgatcgagcggctcggatccttgagcgcggagcagctcgccgaggtcgagctgttcgagctcgatcaccggcgccgccgcacggtgctcgcgcgcatcgcgaagctccgtgaggagcgtggctaggccgcctcaggcattgagaggtgcctcaggcgatgaggccgaggcgctcgaggagcgagcgcacgcccggagccagggggcgaaggtgacgaaggtcgtctggcccgaaccagccgagagcatcggcgtctgaacgcgcattcccacgcgctcgcccccgcggtgtcgcgagcacggtccagagcacgtacgcgccgcgatcggcgagcacctcggcaacctggaggacgcgcactggcgcggcgtggacgccggtctcctccgccagttcgcggatcgccgcggcgaccgggtcctcccccgggtcgacgtgcccaccgggtggggcccaggtcccgttcgcgtccggagagccgcgccgcacgagcagcacgcgcccatcgaggacgaggagcgtcgaggcaccgcgctggacggggagggcgaggcgcgccacgacagcgggcctaggcgaggcttcgagcgagccggagctccaccgttcgaagtccagcctcctcgaagagggccttcgttgcccggtcgccgggtgcgcaacttgcgctgaggacggtggcgccgtgccggcgagcgagttccgcgcaggcttcgaggagctcgccggccaagcccaacctctcgaagccgggcatcgtgacgatcgcgcgcacgatggcctcggggccgttgcgctccacgatggcgatcgctccgactactccgtcgacctcggcatcgacgcgccaggcgtggtcgggccgaagttcctcggcgacgagcacactggccatgggagcctcagtcgtgggtcggcgtcgcctcggcggcggagacgtcggaagggtcatcgccgggcaccgcctcgtcgatgtgcgacggtgctgccgcttcgggttcgccgatggtgtggtcctcgacgtctcgaacggcgtcggctgccgcgagctcgtcgtgtggtcctgcggggtgaggggatggagcagagacggtctcgtcgacggcgacggtcgtcgcagggtcgatgtcgcgggtcgatgtgtccggctccgcgtcagccggctcgggctgggcgccgacgagggtgtcgtcgggagtcgccaacgattggggctcggcctgacgagcgcccgttgcagcgccggcgtccgtggactcggcgtggccccgcccggcatcgtcacgttgcgtggagccctggcggggtttgcgcgaagtcttgggaacccgagcgaggatctctggcttcgggggcgccggcatcgtgaccccgagcaggcgtccgagcgacgggatgcggccggcctgttccttggcgagttcgacgagttcggcaggcgcggcctccggcagaccggtcgcggtgacggctcggcggatcggcgagttcgcgatcgcatcgatcaggaccatccagcgctctggcggggtgtcggggatcagttcgcgatcgacggcctcgacgagggcgcgctcgacgtcgtcggggatgcgtgcactcggatcaggcaggcgactcgccagccgcagcgctcgcacggtacggccggactcgacggcctcgcggagttcggcatgccagcgctcgatgctctcggcgatgcggcggttcagcacctcgcggagcgtggtggccttgtcgaggacgctcgggtccttcgacgacggatcgacggaggccaccacgctgcgcagatcgcgaagggcgacggtgttggcgatggcgagtgcggcgtcggcccgatcgagccaggtcgccgtgcgcacccgaggcaggagatcctcggcgatcttgagcgtggcctcctcaggcgctggcgcgcggccctcatgagcggcggcctcgcgatcgcgcgcgatggctgcgcgaacctcgggcatgccgccgcgcaccagtgcctctgcgatcggccggtgctcggggatgacgctctcgaggaatgcgcgtcggtgggtgtcgcgtggccgaaggcgtggtgccgctggtgcttcgggctgagcgggccgtgcgtcgcggcggcgagaacgctgaggggtcgctccctccgcgcgcgcgctttggtcgtgctggtcgtgctggtcgcgattgctgcctggacgtccacggcgctcggcgcgacggtcctgacgcggccgaccgtcgcggtcgtgggtgcctcgagcacccggccgtcgctctcggcggacggtctggatggtgacgggaggttccgcgcgtcccgaccccacgatgtcgatgcggtcggtgcgaggcggcgcgacgtcgggccgagccaggctgaggatctcgatgccgtcgaggcggcgcgcgatctcggcccgcgcgacatcgccgacgctcgcaccctcccacacgagcgaagccggtaccgtgccgcgcggatgtcgtgcgccgacggcgcgccaggtccactcgccacgcgctgcgtcgtggctcgtgagctcgacctcgatcctcgatgccatgtcccaagaacccttcttgctcacccgatgctcggcatgtcgccggtgcctgcgccatcctagtgtgcgcgctcgtgggcgtcggagggtcactgggggcgctcgggtgccctcggaaggggccccacggcgcccgtggattcgccgccccgaggggccggtcgtgggcgccggctcctcggatcggagcctgtcaatctctagtcaatctctaagaggcaccccgggctcgatgttcactgtgtcgtcgctgcctcctccggcgggttgatccggaccgctgcacggagccggggtggctcgggccgcctctgcacgaggcgttcggggtgggcacgcaaggcagccgcgagcacctcggcccggtgtgctcggagctcctcggcacggccgtcgacgtctgccggggtgtggagtccgattccagaatgacggtgctcgtggttgtaccagcggaagaagcgctcgcaccaggctctcgcgtcctcgtagcagccgaagcgccgggggtcgtcaggtcggtacttcatggtcttgaactgagactcgctcctacgggttgtcgttggaggtgtggggcggctatggctccgcgtcaccccgaggtgcgagagcaggtgtgcgacgggccccgcgatcatgggacctcctctgtctgcgtggatggtgagctgccctggtcggatgccctggctggccacggtctctcccaagagagcgaccgccaggctggcgtgctccgcgcgggcgagcatccagcccacgacgcaagcggctgtcgatgtcgatcacggtggagaggtagtagtggatccacgtggcagggccgtgcagcttcgtaatgtcccacgagtagacctggttccttctcgtggccacgagctcgggcttgaggctcgggggatgggtcgcatggcgtcgccggtctccgagcgcccgtgggcgcgcagtatgcgatccatcgaggacacggaggcgaggtagatcccctcgtcgaggagcttcgcgtacaccgtggccggggcctcatccacgtactccgggctgttcaggacgcggcgcacctcctcgcgctcgcgcggtgagagtgcccgtgggtgagggacacgtgcacgcttcggccggggtggccgggggctcgcagggtgccgtcggtcgtagcgggcacggggctcgccgagggccgagcaggctgcgcgtaccccgaccgttggcgccagttcgctgatggcctcgtcgatcacgtggtctcgccgtgggtcgcgggcgcgccgtcggtggcgagctgctgcaggcgcgcggagagttttccctgcacctcgatcaccttgtgggccttggcgaggtcggcctcgaggcgctcggcgcggcgcctgaggcgtgcgatctcctggtcgcggggatcagcgggttggcgtcctggtggacgtgcgagtgcctcctcggtggcaaggtcgcgttggcgtcgccactcggtgatgagtgaggagtgcaagccctctctccggagcagggctcccttctcggcctttgcaaagggagtcgtagtcggcgaagatccgtgccttgtaggccgcggagaagcgtctcggccctcgggcccgctcggggacctgcggatcggagttgctgggcatgcccccagtctggtagggactcgtcgtggcgtcggtcgtcatggtggtggcaagctccttcctcggccgccctctcgatccaacgatggggtcaggaggagtggtctcacccaagattgacacggagggtaaccccgaaccgctggcggtgccgaggtcagcggattcccccggccagctcctcagcgcacgtcgctgtcgagggggcgctctgccaccagctgcttggcgcgctggggctggcctcgagcgccttcagcctctttacctcgggccccgtgcctgccgccgtcggtctgcttccagccgctgtcaggtcgtctcggtgacgtgcgaaggctcgggcgacctcggcgaccgtggcgcctgtggtgcgcagccgtccccctcggccagcctccggaggaggctgctggtggggtgtggcgctgcctgcccttcatgtggtctcttcctcccactcgtccatgctggtcggggtgctcatggaacgggtggtctcgttgcaggagggccggccagggtactcgatgatcgcgaggtggtcgacgcggtctgtggaggtgcaggcttgccgacgacgctgggtgcaccagccgcaccagcgctcggcggcgtggcgctgtggcttggtggccacgagatcgtcgtggagggggtacggaggcccagctacggcgtggacgacgcagctggtagtgccgtcgtgacggcgtcggctccgcccaggcgctcctggacgcctgttgaaggctacttcacggtcacgttgcagccaacccaagggcaccaccgccgtccggctcagctccctcccctgccagatgacaaccgccgggacaacaacttgtcatcttttcgtccgggtcgtgaggctgaggctatactccgctcaggcgcctccgcaaaggtcgtacggctcgagggctctcggggctcatcgctgcgcgtctcctccgaagggagccgagatatgcacccgtctaagcagatgaccttcttgcgcaaggaactcgcccttggcacgatcctgacgtctgcgctggccttcttacttttctcacccttgggtacaaccagcgtggctgcgtcgaaaacggcagtcgccccgatgcccgcaccatcaggcgacccttctcagcctgccggtatttgttgcagtacccagaacttgggatccaccatcggtgaaggcactgttctcaatcccggcgactatctactctcaagttctggacaataccagctcatcatgcaaggcgacggcaactttgtcctctacaacttgtacaacggtcaagcattgtgggcgactggtactgaagagcactctggcgcctacgcagtgtttcagaacgacggcaaccttgttgtttacttcaatgggactgcgctgtgggatagccatacgtatacctactctggtctgacactgacaatgcagaacgatggcaacgcagtcatctatcaaggtacccagccgctatgggcaacggatacagctgcgaacgagttggactgttggccttccaacaactgcacacccggcttgttcatctatgcctatcttcaattcccgccaacagcgccgttgcagggagtgaacgcaccgacaacgggtgccaacacgtttgcgatgtccaagtgggaacaacaagaagacagcgtcattcagtcaaaccctctcgacacgacgcaaaaggagcctggctcctacaccctgaagggcaactctgccaacgttcaagtgtatacgaattctgatggtgagtccgctgattactggggcattgacgcatttgatcagactatttcttaccttccatattatgggccgattatctcggttcttagaaatccagtgaacagtccctaccagcaatgcgtcaatctcgcgaatgctgtaagcagcaccctttgggggacgattaatttctcagatctgtgttagcttcctactgcaaagatgaggaggtgtgatgtccactgcatggaaccgcacggtgaagattggcggggttgtcagttcgtgtcttgccttagtggctcttgctgctgttgctggccgagtcgaggatggccacgccgctcaacaccgcggacatcagcagtcacccgttgcgagaacagctacggcgccctcagtacaggtggctactgggcaaagagcagggcagtcaaaggatgctgctgccgcaggtgatccaagctactttacccccacgctatcaggtgttgaaacgggtgatcctgccttgccagttggccactactgggaatacgtgccagcggtagtgcccggcgttccggagagaccatcgtacatgttgacgatcacacaaagtgggagtgatggacagatcgcgggcatggtctatatcttctacgaggatgggaagcttgataccgtgtttccgttctctggcctcgtggatgcgacgactggcaagggtagtatcacagtgagtggcgctccaactgtggtgtcatacaacggcgtgatcttctacgatcaatctacggtgcaatctggtcagcagctgccagtggtcgtcagccatggcgacatcacgttccctgggtgttcgaactatctgcactggctgatggccgggagttcagcatcacctgctctgctcgcggcaatagcaagtgatccgaatgtgtgcacgttctacccgactggtggcgaggcctacccaagcgagtcgcagatacccgttaccccttaggggatcggtgcgtgggaagcggagggcggagagcatcttggcgcctcgtgttagttggtgtctcagtaccctcggccggctctcctgaccggccccccgcaccgagtccaccttcaccgtgagacccagcgtcgtcatgccagcgctcgttgattccactgagcgccgatgacgccgagcgggcagcacctctgacccctcgcggaggcctcgaggatccgtcgctgggtggcgacgtcgaggcgggcgaaccgggcggggctgcggtcccccggcgatctgggcgtccgcgtcgtgctggggggtgccggtcgtgctcgaggagctgcctggcctcgcgaacgccaggcgacgcgctccccatcgagcacctcctcgcggacctgggcacccagcgatgcgcacaccccgttctgccacggcgagcccgggtcctggacacctgggcagccgagctcggctgcccaggtggtcatgcacgcggccacgcacgccgggccgtcctcgacccggaggacgcctagggttcctcgctcggcgaggaggccatcgagggtggcgacacgtcgtgcgcgtcaatcgagcgcttcaccacgcacagccagctcctccgtcgtgggggcgtccaccacggcgagcacccagggcgccctcccgtcgtcggtcgcgtcgaaccggctccagtgcccaggtcgcgttcgtctggatgggcaggtgagcgcccatgggcaccccaggtcgtggttggcgccgtctcgtgcgtgactggggacccggagccctgccgtgcgccagagccggtgcacccatttgaggttcacctggtagccagcctccctcaccgctcggtaggccttgcgatagccctggcgggagttggctagggcgaaggtgcgcaggacctcatgctggccgcatccaagctggactcgggcttcgtcggcacccgacgctgggtggagcgaggctgggccgtcagccggcacgctcgtcgctcgtgcaccccgaaccgccggcggtgccggggtcagcaggttccctcggccagcctccggaggaggctgctacctgggtggcacgctgcctgcccttcatgcgctctccctcccgctcgtccatgctggtcggggtgctcacggagggggtggtctcgttgcaggggggccggccaagatcacctcgtatcggtgccggtgccaccaggcgtatggcaccagcgagcggtgatcctcgtaaggcggtcaggtaagtccaggtcagagctgctatggttgagggtcggtagcaacgacccctcggggtcgtcctcgttggagcagggcgtcccagaagaccggatcgtcggcattcaccacgtggcaacgaccccgagcggtcgtcctcgttggagcttcgatgacaccccgctcaccatgtagcggcggctcaagtagcaacgagcccgcggggtcgtcctcgttggagctcggcgacgcagggcccagcccccgacccgtgaccgcggctacgccgtgtgctggaacacggcctgctcgagccgacggaggcgctcggcaacgctcagctcgccccctcctcctcggcgcggagccgatcgagtgcccagattcggatcaacgtggagactggcaggtgctccttggcggcagcgcgttgcagccgggcgtgctcgtcagcggacaaccgcaccgacaccacggtcgggcgagtgaggttgggtcgtgcgaccgtgacgcctgcgggcacggtgtcggcgaggtcgtgctgctccgccgccgctccctcctcggccacgtggagcatgacgcttgccgcccttcaggtcggcgccctcctacgagtccctgctcgtcgggaccgccgcaggccgagtgcaaggatgtagcgtgaacagcgagaggaaggaccccatgccccgccgtaccaccaaggactgcatcctcgcctacctcgccgcccgcccgaacgaggtggccttcgtgcgctccgagttcgctcagtgcgcgaagagtcgctcggccgtggaccgagcgctgcgcgccctcatcgacgaggaggtgctcgtgcgcggcggctggggcatctacgtgcgggccaagcgtgtcgagttccttggtcgtgagtacgtcggcactgtcactggcttcgactattggtaccccgaggtgctcgccaagctcggcgtcacctgggaggccgacagcgcgcgcaaggcgtacaacgagggccacaccacccaggtccccgcctggaccgcagtcaacgtcggccgccagcgcatcaccaggcggatcgcgttcggaaagcgagtgttgcagtatgagcgaaccacgggggctcgacgacgcaaggttcggcctacttcagcgagccgacgacagcgggcaacttccactccctcctgagttcttcgaaaaggacctgctcgtcgccgaggcggtgcgcgtcatcgcccaggtaggtcgtgagcgaggtgtctcgctcatcttctgcggtggcaccgcgctcgcgcaggcccaccaggtgatcgagcgcatgagcgaggacgtcgacttccgggtggtgctgccggacctgcccagcaccaaccagcgccgcaagttcctctcggcgctcaaggccgacctcgtcgcggcggagcctgtcaatctttgagagacaccccgggctcgatgttcactgtgtcgtcgctgcctcctctggcgggttgatccggaccgctgcagggagccggggcggctcgggccgcttgcgcacgaagcgttcggggtgggcacgccaggcagccgcgagcacctcggcccggtgagctcggagcgcttcggcacgtccgtggtgcacatcggccggggtgtggagtccgatgccgcacgtggcggcgctcgtggttaaaccagcggaagaagcgctcgcaccaggctcgggcgtcctcgtagcagccgaagcgccggaggtcgtcaggtcggtacttcatggtcgtgaactgggcctcgctccgacgggttgtcgttggaggtgtgggggcggctgtggctctgcttcaccccgcggtcggcgagcaggtgggcgacggacttcgcgatcatcggacctccccggtccgagtggacggtgagctcccccggtcggacgccctgactggccatagtctcctccagcagggcgacggggtggctggcgtgctcggtgcgggcgagcatccagcccacgacgcaagcggctgtcgatgtcgatgacggtggagaggtagtagtgggtccacctggcagggccgaggagcttggtgatgtccgagctcgtgacttcgttcggtctcgtggccacgagctcgggtttgaccgtcgggggtgggttgcgtggcgtgccggtccccgagcgcccgtgggcacgcaggatgcggtacatcgtcgacacggaggcagggagatttcctcgtcgaggagcttggtgtacaccaaggccggggcctcgtccatgtgctcggggctgttgtagcacccggcgcactggccctcgttcctcgtccgagagggcccgtggctggggagccttggctagcttggggcttcttcggtgccgtcggtaggagcgagcacggggctcaccgagagccgagcaggcggtgcgtaccccgacggttggcgcgagttcaccgatggcctcgccgatcacgtgatctcgtcatgggcgccgggcggcgtatgcgcgcggctcaagggtccttgcggacgcgaggtcgctgccgcacgcgcgtgcacgggagcggttcgcgtgctccgggccactcgggtcagttcgcagccgagaacggtagccttggccgtggggacgcttgctccgagggaggttacagggggatgacgcgtcggtaccgctgcacgaactgcgggaacgtcacacggtttgacgtcaccatgtcggttcgtgcacgttcctatttccactattccatcgcgggtgagctgtcggtcgaggacaccgaggagctgtcgcgcgtcgtcgaggaggtgtcgtgtcggtggtgcggcacgagccgattcgtggaggtcctcgaggcgaccccagcgacggtggagcggacgtgagcccccgcgctggtgaccgccctcgtcggccggcgccgcagtgggcgctcgctcgtgtcgtggagctcctcgacgagacgccggacacgaagagccttcgtctcgagctcgacgaaccccagcagtacttgccggggcagtactacaacatccgtatcccggtcgagggacgaccacgaccgatccagcgcgcctattccctcgggtcctcaccgatcccggaaggccgcgtgatcgaggtcggcgtcaaggcggtgccgggaggactggtgtcaccgcgactcgtgttcgagacgcacgtgggtgacgaactcgaggttcgtggcccctacgggacgttcacctggaccgaggaggacgggggcccggtcctgctcgttggtgcgggatcgggcatcgtgcccctcatggccatgatccgctaccaggccgctcgtgggacggcgatcccgatgcacctgctctactcgtctcggcgtcgcgacgaggtgatctacctcaccgcgctcgagtccctccggagcgagcacgagtggcttcgcgtcagccacaccttcacccgtgatctcgatgatccgctcgccaggttccatcgtcgtatcgacaaggagatggtgcagctggtggcgcgcgaggccgaagcgcagctcgcctacatctgtggacctccagaactcgtcgacgacgtcgaacggacgctgatcgagtccggtatggatgagcaacgcatcaagaccgagaagtacgactgacgacggtgcgctcgctcgccgcgtcgaggcgtgcctccgagacgccggtgtcgtcgcggcagggtgggtcccgagagagcagcgtgcctggcgcgagagcacctgggcccagctggctgtcgcgcgcggctggatgcgtgagccacggttcacctttcggcgtccgcagcctgcggccgacccttgggccccgctgtcgtgggcccgcggtgcgatcgtggtcgcggtcgcggcagcgccgtccgtgcccgcggcgaaccatctcggtgtcgctggctacgcagcaggcgatgcgtacgcgcaggtgcgcgacgcactcgagcgtgtccggcgcctcctcgtcgacgtcggtggccgtggtgtcgtcgtggccgactccaacctcgctttcgatcgcgccctcgcgcgccgagcgcggctcggatgggtcggacgccacaccctcgtgatggtgcccggctacggcggggccgtcgtcctcgggtccttgatcgtcgatcgggtcgtcgaggtgcgtctcggacggaccccgactggggatccgtgtcgcaactgccgtcgttgcgtggatgcgtgtccgacgggcgcgctcggcgacggggtcctcgagccgctgcggtgtcgctcgtggcgccagcaggagcgacacctcgagccgtcgtggcgcgagacgtggggcccctggctgtatgggtgtgacgagtgcgtgacggcgtgtccgctctcggcacggcagaagaaggtcgggggcgagcgcgtcgcgtccatcttgtcggcgagcgatgcagcgctcgccgagcgcgtccggagttggtacataccggatcgaacgctggcgtgggtgcggcgcaacgcgatcgtcgcggctcggtccctcgcgacgagccccgacgacgagcaggcgatctggcgccagctggtcgccggagcagcgccggtgcgagccgaggcggtacgctgggtgcttcgtcgaggtgggtggggaggtgtcgatgcgtcacgtgctcgtcaccaacgactttcccccgaagatcggcggtattcagcactacctcggggagatctaccgtcggctcgacccgacgagcttcgtcgtcgtcacgcgtgacgaggcgggcgccgaggccttcgatcgcgccttcggggcgcgcgtcgtgcgagtgcgcggaccgcttctgcccactcgggccctggccgcccgagttcgcgggctcgcacgcgagatcgacgcggacctcgtggtgatcgacccgatctggccgctcggtgaggtcgcggcgagcctagggctggggtgggttggtgtcgcacacggtgcggagctcacgttgccgcttcgactgtggccgacggccggtcgaatccgaagtgtgctcgcgggggcgctcggcgtggtggcagcgggaggtttcgtcgcgcgcgcgctcgatggggtggtgccggccgatgcgatcgcgacggtgccgccgggggtggatctcgaacgcttctgcgtcggcgatcgcgagcgtgcgcgcaaggacctcatggtggacccggagcgatcgctcgtgctgttcgtctcccgtctcgtcccgcgtaagggcgcccacatcgtcatcgacgcggttgcccagctgcatcggccggtggagctgcacgtggtcggtgacgggcgaagccgcagtgctctcgagcagcgagcgcgccgtcggggaatcctcgcggtgttcgaggggcgtgtggcgctggatcggctggtggcgagctaccaggccgccgacgtcgtcgcctttcctgcgcacgatcgttggttcggtctcgaggaggagggtttcggcatcgtcgcgctcgaggcgcaggcctgcggcgttcccgtcgtggtcggcgtgagcggcgggaccgcggaggccgtcgatcctgcgagtggacggctcgtcgcgagtcgccgtccgagggcctgggccgaggcgatcgaggagcgtctcgctcacacgagccctccggtcgccgacgcgcgtggcttcgtggagcgtcatcacggctacgaccggttggccgacgagtggcatgcgggactcgagcgcctcgcgagccgtggacgtacggccggaagcggctaacctgcacacatcatggaggccacagctgagtcgcgcgaggttcctgcgccggtcgaggcgctgttcgacgtcgtcgtcgacgtcgaacgctatccagagtgggcctcggacatccgaagcgtgagcgtgctcgagcgcgacgagcatggtcggccgcgtcgcgtccacttccgtgccggcgcgttcggccggagcgcgtcctacacgctggtctacgatgcgtccaaagcgccgaacgagctgtcgtggacgcaggaggaaggcgacgtcaccgcgcggctcgatggccggtatcagttcgagccgttgggggacgacgtcacgcgtgtcacctatgagctggctgccgacctcgtcgttccgctccccgggttcttgaagcgtcgggcagagatgaagatcgtgcacgccgcgctcgaggatctggcgcaacgggttcgccagctcggctccgccgacggatcggcggcgcgcacacccgatcgctcgcattgatcggtcgtgacgcactcgcttcaccactgaatccatcgtccctgaccttcggcgtccctcacgacagggacggccatcggcgcacgtcagatgcactacgctggggttcacagcgacgctgtgcgtcgggtgtgggggagcggagccgtctgggggtgcggaatccatggcgagatgtcgaggatctcgaccgatgagccgatcggggtcgacacacggttcgcagccccgacgtcggcgactcgcgcaggtgtcgagcgcggtgcgcgcatgatcggctgtggggggcccgcgctgggcgagatgatcgatctgggcttcggcaaccccgacctgcctccgcctcaagaggcgctggcggcgatcgcggccgagctcgcgcggtcgcatcctgcacgctacggcgacagcgctgggaccgtcgcgtatcgtgccggcgtcgcagccctctacgagcggcgttggggcgtcagcctcgatcccgacgcggaggtcacccaggtgctcggcgccaaggagggtctgcaccacgtgctggcggtgctccctccgggtcctgtcggggtgccgatgccgagctacccgacgcaccacgaggcagtgctcgtcgcggggaggcccctcgtcggactcgagctcgatcccgacgatcgagacgggcgacacttcatcgagcgggccgcggacttggcccgcgccggccgcgttcgcgcgatcgtgctgtcgttcccgcacaaccccacgggggtcacgacgacgcgcgcgatgctcgaggagttggtggccgccgcggtggaggcaggggtgaccctcgtgcacgacttcgcctactgggccacggtgctggaggagcgcccgagcgtgagcctgctcgagatccccgaggcgcggtcggtcgcggtcgagctggtgagcctgtccaagtcgcactcgatggcgggatttcgtgcgggtgcgctcgctggttctggcgctatcgtgcagcgggtacgcgcgcgcaagcgcgccttcgaccacggtctgtcccaaccggtagaggcaggagccctgtgggcgctgcacgatggcgaccgagcggccgacgagctcgcacgtcggtatcgggtgcggcgcgacgtgctggtggcgggccttcgccggctcgggtgggggcgggtcgcgaatccggccggatcgatgttcgtgtgggcacagcctcggggcggactggacgacgccggcgtgacgcgccacctcgtcgacgagcacggcgtccttctcggtgcgggacgcgacttcggcgccacggaggcggggtggcttcgcttctcgctcatcgccgagcccgaggtgctcgacgaggccgttcgtcgtctcggccagtgcgcgctgctcgggtcggcgtcagcgcccgagggctcgctcgcgtcgtgaggccgtggtatcgaggcgcgctcgctcgaggtaggcgagcacctcgtcgaagtcgtggtggggctcggccagcgtgatgcgcacggcgccggcgaacgacgaggcgagggtgaaggcggcgcctggcacggtgcgcacgccgtgggcggcgagctcgagggcgatgagcgcctcgggatcgggcgggagccatgcgttgacgccgtctcccgtcaggttgcgacccagcgcatcggcgaggcgctcccgtcgggctgcgtaggtggcacgggcgtgctcgaggcgctccgtctcctcgggggcctcgagcatcgcggcgagcagcgcctggaggagtttcggcgaccacgacgggccgaggctgcgcgcgtgctcgagcgcgtcgcgtcggtcggcatcggtgatgatcgcggcgaggcgcaggtcgggcccgtgggacttcgagaagctgagcacgtacgcactcgcgggatggagccctgcgaggctcgccaacagcgtcgaggcgacgagcccggagtgatcgtcctcgatcacgaggacgtcggggcgtggggcgagggctgctgccagcgcatcgcgacgctcgccgctcaccgtcgcgccggtcgggttgtgcgcgcggggctggatgatcaccgcgccaagctcggggcgtgcggcgagtcgcgcaaggtcgctcgggtcggggccctcggcgtcgatcgggaggggccagacgctcaagccgtgggcctcgacgaggtcgaagagcgcgggaaagctcggatcctccacggcgacggcggtcgcgctgggagcgacggtgccgaggagtcggtcgatcgcctcgagggcgccatcgacgatcgtggtgccggtgtccgctcggagctggagggcgggtggcagcaaggggacgaggacgtcgacgaggggtccgaacaccggtgggtccgcgtacgtcgcgggagcgagcggggcgatgcgtgggagataggacacggggtcggggagcaggcgcggatcgggagcgccggtgccgaggtcatagcgtgcgggctggggcggcgtctgctgccatcgccgaggccgacggcgcggtggtgaggcgacgaaggtaccacggcggccctgggccgcgacgagccccaagctggcgagctgtgcccaagcagccgccaccgtcgtcggcgagatcccaaggtccgcggcgagctggcgaacagggggcaagcgcgtgccttcgggaagctcaccggcgcgaatcatggtcgcgaccgtcgaggcaacggtgcgcacgccgatcgtgccgacgctgcgacggcgcagcgctgccaccagggcgtctgccgctgcgtcgtgcccgagatgctccatggccccagcgtagcaaggagcgcgctcgtgattttcgtttgtgtggcacaaccctgtgtcgcgtgccagtacaacgaagtgctaccatgccggaaacggtccggatgctcggaggaagtggaggcggcgatggacctcatcgaacggcatcggcgggtgctcccgtcatggctcagtctgtactacgacgagccgatcgaactcgatcggggcgaaggatgctgggtgtgggacgcgcacggtgagcgctacctcgactgcttcggcggcatcttgacgacgagcgtcggtcacaacgttcccgagatcgtgagcgcgatcagcgaccaggccgctcgggtgatccactcgtcgaccctgtatctgaaccggcccatgatcgagctcgccgagcgtctcgccaaggcgtcgggcattcctgatgccaaggtgttcttcacgacctcgggcaccgaggcgaacgacgcagccctgctcttggcgacggccgccctcgggtcgaaccaggtgttcgcgctgcgcaactcgtaccacggtcgctccttcacggagatcgcggtgaccgggaaccgaacctggtcgccgacgtcgtactcgccgctcagcgtcagctggttgcaggggggttcgaggctgcgcgggccgctcgcgggtctctcggacgccgagtacgtcgcgcgtggggtcgccgacttggaggatgcgctgctgacgacgacggccggacgggtggctgccctcatcgccgagccgatccagggagtcggcgggttctgtctcccgccggatgggtacttcggtgagctgtggagggtgacccagcgcgaggggattctgtggatctccgacgaggtccagaccgggttcgggcgtaccggcgagcatttctggggctacgaggcgcacgggatcacgcctgatctcatcacgttcgccaagggtgtcggcaacggcatgtcgctcgctggcgtgatcgggcgagcggaggtgatggacgcgctcgggaccaactccatctcgacctttggcggttcgccgatcacggcggcggcgggcgtggcgacgttcgactacatcatcgaccacgatctcatggccaacgcgcgtgcgcgcggcgccgagcttcgcgaggggctcgacgcgatcgctcgatcgacgcccgcgatcggagaggtgcgcggcaagggcctcatgcagggggtcgagctcgtctggcccggtacggtcgagccggcgcccgagcttgccacacgcgcgctcgaagcggcacgtcgcgaaggcgtcctgatcggcaagggtggtctgcacggcaacgtcctgcgcatcgcaccgcccatgaccatctcggccgagcagatcgagcacgcactcgaggcgttccggcggtccttcgccgaccaggcattccatgtgaaggagcagtgatggagacgatcgcgcacctgatcgacggcgagcgggtcgaagcggccccgctcggatcccagccggtcctcaacccggcgaccggtgaggccatccggagcgtcggactcggcgatgcgggcctcgtggatcgggccgtcgccagcgcggcggcggcacagcaggactgggccgagcagtcgctcgccgcgcgccagcgcgtcttcttccgctatcgcgagttgctcgtcgctcacaccgacgagctgtgcaccttgatcagtgaggagcacggcaaggtgctcggggatgcccgtggcgagttcgcccgaggggtcgaggtcgtcgagttcgcgaccgcgctcccgcagctgctcaagggtcagttctccgacagcgtctcgcgcagcgtggacgttcgcagtctgcgccaaccgctcggggtcgccgctggcatcacgcccttcaacttcccggccatggtgcccatgtggatgttcccgatcgctctcgccgtaggcaacggattcgtcctcaagccgtcggagcgcgatccctcggcgtcggtgcgactcgccgagctgttcgtcgaggcgggtggtcctccgggcttgctgaacgtggtgcacgggggtccagcgacggtggatgcgatccttgcccaccctggcatccgagcggtgtcgttcgtcggctcgaccccgatcgcacgccacgtctacgagagcgccgctcgttcgggtaagcgggtgcaggcactcggcggcgcgaagaaccacatggtggtcctccccgatgccgatcgcgaacaggtcgtcgacgctgcgatcgcggccgcgttcggcagctcgggtgagcggtgcatggcgatcgcggtgctcgtggtggtgggcgagcagccgggcctcgtcgacgagatcgcggctcggatgggctcggtacgcgtcgggcccgcgacggacccgactgcggagatgggcccgctcatcaccgaagcgcatcgcgaccgcgtggcccgcctcatcgaggaggcggtgtcgaagggggcgaaggcgatcgtcgacggacgagcacacccggctgcggcaggtccgggcttcttcctcggccccacgctgctcgaccaggtggacgtcgcgatggacgcctacaaagaagagatcttcggcccggtgctcctcgtccagcacgcggacgacctcgacgaggccgtggcgctcgtgaaccgcaacccgtacgcgaacggcgcggcgatcttcacgcgcgatggcggcgctgctcggcgcttcgtgcgctccatcgacgccggcatggtcggggtcaacgtgccgatcccggttccggtggcctaccactcgttcggcggcttcaagctgtcgctcttcggcgacacccacgtccatggcgaggagggcgtgcgcttctacacgcgcggcaaggtcgtgacggagcgctggcccgacgaggcgtccgaggcgcgctcgctgcacttcgtgaccaaccggtgaggtcgcgcttcggtgccggctcaccgaagcgctaggctcggcgcctcgtgaagcgggaggagtcatcggcggccgacgctccggcggccagcgagcgcgacatggcacgcggccgaggcgcgcgagaagcgtggcaggtgcccgcgctctcggtcgatgcgttcgactacgacctgccggccgaggccatcgcgcacgatcccatcgagccccgtcgtgctgcgcgtctgctggtggcccgtcgcggggctcccgtggcccatgcgagggttgccgatctcgctcggctcctcgagccgggcgacctcgtcgtcgtcaacgagtctgccgtggtgcccgctcggctgcacctgcagcggagcagcggaggcgccgtcgaagtactcctgctccggcagcttcccgatgggaccgccgaggcgctcgtgcggcccaatcgtagggttcgcgccggtgagcgccttctcgccgacggcgtggaggtcgtcgaggtgggaggcgccctcgaggccgtcgagggcatgacgatccgagcggtgcgcgtgctcgatccggagcgcgtcgcctcgatcggggtggcaccgctcccgccctatctcgggcgccaggacatccccctcgagcgctaccagaccgtgttcgcgcggcgcccagggtcggtcgcggcaccgaccgcgggactgcacctcgacgaggtcgtgctcgccgacctcgcggcgcgcgggatcgacgtcgtgcgcatcgtgctccatgtcgggctcggcacgttctggccggtgacggcggcgacgctcgccggccatccgatgcacgcggagtcctacgaggtcgacccggccacgtgggcgcgcatcgagggcgcgaagcgtgtcgtcgccatcggcacgaccgtggtgcgcacgctcgagaccgtggcgctgacaggtgagttggcgggcgagtctcggctgctcatcgcgccagggtttcgcctgcaggtcgtcgacacggtgctcaccaacttccaccaaccgcgctcgacgctgattgcgctggtcgcggcgatggtgggggatcgctggcgcgagctctactcggtggccctcgccgaggggtaccgcttcctctccttcggtgatgcgatgctcgtcgacgtcgaggggcgtcggtgaggccgtcgttccggatcgacgcgacggacggcacggctcgtgcggggacgctcaccctacgccatggtctggtaccgacgcccgtgttcatgccggtcgcgacgcgtgggatggttcgactcgtccccccggcgaccctgcacgagctcggggtctcgctgctccttgcgaacacctaccatctcgccctccgccccggtgccgatgtggtggcggcgctcgggggtctcagcgctttcaccggcttcggagggcccatgctcaccgactccggcggattccaagtgatgtcgctcggaggcacggtcgatgacgacggagtcacgttccgatccacctatgacgggcgccgggtccgtctgaccccggagggcgtcgtcgagctcgaggagcgcttcggcgtggacatcgcgatggtgctcgatgtgtgcaccatgttgccggcggagcgagcagcgctgcaggtggcgatggttcgcaccaccgagtgggcgcgccgggcagcagcggcgcgtcgagacgaggcccaagcgctcttcggcatcgtccagggtgggtcggaggaggatctgcggcgtgagcacgcgagccagatcgccgagatcggtttcgacggctacggcatcggaggcctcgccgtcggggagtcggcgcccgccacgctcgcggccgtggcagccgccctcgagcggctgccggcggatcggccgcgctatctcatgggcgtgggggatccctacctcatcgcccacgccgtcgagctcggagtcgatgccttcgactgtgtggcacccacgcggcttgctcgccacggcatcgcgctgaccagccagggtcggctcgcgctgcggccgagtcgctggttgggctcggacgagcccgtcgatcctcgttgcgggtgctcgacgtgtcggacggtccctcgagggctcgtcgcgcacctgttgcgtgtcgatgcgcacagcgccggcgcgctcctcagcgtgcacaacctgtcgtttcagctcggactccttcgcgacctgcgtgctgcgatccgtgccggcacgctcgcgggcctggtacgcgccctcgacgaggtctgggcgccgagctggcgaagcgctcggaccgaggccgcgccggatcgctaggctccttgatgagtgcacgtcggaggggtatgagcaagacgcgttggctgtggtcggtggtgctgtcggcgctggtcgcggtggcggcattcatcggtgtcgtcgagctcgctcacgatgggccgatcctcggactcgacctccaaggcggggcgagcgtcgtctaccggcctgctcgaccggtgtcgacggccatcttgaacgagacgatcggcatcttgcgcaaccgggtcgatggactcgggatcgccgatccgtccatcggtcagcagggcaacgacatcgtcgtggagctgccaggagttcgcgatccgcgccaggccttggcgctgatcggacagacggcggtgctgcagttccgaccggtcgagtgtacgtgggctgcgtacgccccgacgaagggacagcacgtctcggccactcggccaccgacgtcgtgcccgacgagcgcagccggactcgccgccgaggccgcggtgccgacgacgccgacgcaggtcgccctccacagccagacggcggtgctcgatcttcgtcagggaacccaggtcgtcggacgctacctcgtggggccagccttgctcgacggcaacgccatcaagagcgtgtacgcggcgcccgacaccacctcctcgaccgggtcatggctcgtcgacttcaccctgacgccgaaggcctcgccgctgttcaatcagatcgcgaagacgttctaccaacgccagctcgcgatcgtgctcgatggcacggtgatctcagccccgcagatcacctcgacgtcgttcaacggacaaggacagatcaccggcaacttcaccgaggcgcaggccaacaaccttgcgctcgtgctgcgctatggcgccctcccggtgcagctggtccagcagacggtgcagaccgtctcgccgacccttggtgcgagcgcgctccgtgcgggcctcgtcgccggcgtcgtcggcctcatcgccgtgttgctctacaccatcgtctactaccgagtcctcggcgtcgtggtcctcgcaggtctcgtggtgacggccgcggcggtctgggcggtcgtcgcctacctggggagggcggcgcagctcacgctcgatctgtcgggcgtgaccggtctcatcgtgtccatcggcctcatcaccgactcctacatcgtcttcttcgaacggctcaaagacgagatccgtgaggggtcatcgatcgggtatgcggtcaaggcggggttccagaaggcgtttcgcaccatcatcgcggccgacctcgtctcgttcatcggcgccgccctgctgtggtacttctcgatcggtcaggtgcgagggttcgcgttcttcctggggctcgcgacggtggccgacgtcgcctccgcctggttcttcacccgaccgctggtcctcatcgtcggcgacgccctcggcaagacgcatccccgatggctcggtgtgggcccggtgcagctgcgcgaacaggcacccgagacggccatcttgcggccacgggccagagtgagtggaagtgaatcatgagtcaggttcgcatcgtcgaagatgcctcacagctcagctggtggcggcgtgtcggggcgggcgcgacgcgcattcgcttcgtcgaacgggcgcggtggttctgggcggtctcgctggtcgtgatcgcggtcggcgcggcggcgctcgggattcgcggcctgaacttcggtatcgattttcgtggaggcctcgcctggcaggtgagtgcgccgacgctcagcgtcacccaggctcgtagcgcccttgccgggctcccgctctctggcaccacggtcgtcagcttggggaccggtcagcaccgaaccatcgaggtggaggcggatctgccgacctcgggtgcgcgagcccatgcgctcgagaacgaggtcgccgctcgactggctgccgcagctcaccagccttcgtcggcggtggcgatcaactacgtcggtcccacgtggggatcgcagatcaccgacgcctccctgaaggcgctcgtggccttcttcgtcggcatcacgctctacatctcgttgcgcttcgagtggaagatggccctggcggcgctgatcgcggtgatccatgatctcgtcgtcacggtcgggatctatgcgctctcggggttccagatcacgccatcgacggtgatcgcggtgctcaccgtgctcggttattcgctctatgacaccatcgtcatcttcgatcgcatcaaggagaacgtcgcgacgcacgtcgatcaggcgggggagatgacctactcggaggtggtggaccgctccgtcaatcagatgctcgcgcggtcgatcaacacgagcgtcgtcgcggtgataccgatcctgtccgtcttggtggtgggggcctacctcctcggtgcgacgaccctgcgcaacttcggcctcgccctcgtggtcggcctgaccagcggcgcgtactcctcgatcgccatcgcatcgccgatcctcgcgttcctcaaggagcgagagcccaggtaccgacagctcaagcgacggattgccgcgcgtcgtatcgcacctgcgaccgaggcggcgggtaccatcgatacgtaggagggggcgatgctcgacgagcggtggttagcggagcgctacgccgacaacccgctcgtgctcgacgccctcgcgctcgcgacgaaggcgcaccacggccagctgcgccggtctggggagccctacatcgtgcatcccctcgcggtggcccgtcgcgtcgccgaactgcgcgccgacccgatcaccgtcgccgcggccttgctccacgacacggtggaggatacctcgatctccctggaggaactcgagcagcgtttcggcgcggaggttgccgcactcgtagacggagcgacgaagctcgaccggctctcgttcgactccaaggaggtcgcgcaagccgccacgatgcgcaagatgctcatcgcgatggcgcgtgacgtgcgcgtgttggtgatcaagctcgccgatcgcctgcacaacatgcagacgatcggcgctctcgggcgcgagaagcagcgccggatcgcgcacgagaccatggacatctatgcgccactcgcccatcgcctcggcatcgaggaggtgaagtggcagctcgaggatcatgcgttcgcggtcctgcatcctcggcgctacgccgagatggagcacctcgtcagtcagcgggctccggagcgcgaggcgcggctccaggcggtcagcgaacagctcgctgccaagctcgcccaagtcgggatcgtcgccgaggtcacggcgcgccccaagcacgtctggagcatctacgagaagatggtgctgcggggcaaggagttcgacgcgatctacgacatcctcggggtccgcatcatcacacacgaggagcgtgactgctgggcagcgcttggcgtcatccactcgctgtgggcgccgatccccgggcggttcaaggactacatcaacgctccgaagttcaacctctaccagtcgctccacaccaccgtcgtcctcgagggcgggagcccgctcgaggtccaggtgcgcacccgtgagatgcatctgcgcgccgagtatggcgtcgccgctcactggggctacaaggagggttctgatgcggccgagctcgcctggctcggtcggctcatcgacctcgacgaagagacgcacgatccggtcgagttcctcgagcacctcaagctcgatctcgggaccgacgagatctacgtgttcacgcccaagggcaaggtcatcaccctcccgacgggcgcgacgccgctcgacttcgcctatgccatccataccgaggtggggcaccggtgcgtcggtgccaaggtgaacggtcggctggtcgcgctcgagacggagctgcgctcgggcgacaccgtcgaggtggtgacgagtcgctccgccacggcgggtccgtcgcgtgactggctcgcgatcgtgcgcaccccgagggcgcgctcgaagatccgccagtggttctcgcgagagcgtcgggaggagtcgatcgacgcaggtcgcgaggagctcgctcgtgagctgcgtcgcgaggggttgtcggtgaccaagcacctctcgggaccgggtcttgcgcgcctggccgagcaggccggctatcgagaggccgagaccctgctcgcggccatcggtgagggccacgtctcggcccggagcgtgctcgccaaggtgcagcgagccgagctcgagcacgacgggttcgagccggcggtcgcgacgccgcagcggcggcgccgtggaggcgggggaccgtcgatctgggtcgagggtctcgacgacgtgctcgtgcggctcgcacgctgctgcaacccgctgccgggcgatgcgatcgtcggcttcatcacccagggccgtggggtcgccatccaccgagaggactgcccgaacgtcgaggcgttgctcgcccaagggcccgagcgcatggtcgaggtcgactgggcgggtgagcacggctccggcttccagatggcgatcgagatcgaagccctcgaccggccgcgtctgctcgccgacgtgtcccgtgtgctcgccgagcaccacgtgaacattctcgcctcctcgtcggggcgcgggagtgatcttgtcgcggcgatgcgtttcgagttcgagctcgccgatccgagccacctgtcgtcgatcctggcgggcattcgccagctcgacggtgtcttcaacgctgcccgagtcgttcccgggcgacgtcgcccacggaccgcgacccagcacgacggccgctgagtcggtcgccgaggcgaccgtgtgtcgcggattcgtcatggatttggtcctacgacgcagcattacggcgtccgtgacgggatattgttgggccaccgacgcatggggagcgtcggaggaacgggcgtgagcccgtccattgctacgacaagggggattgctggatgcaacagcaggcagtagagggcggatcccttcgcagggagatgtccttcgttgatctggtgatggcctgtctcggtgccatcatcggatcgggttggctcttcggcgtgctctatgccgccaacgcagccgggcctgcagcgatcgtcagctcgctcatcgggggcattgcggtgatcttcatcgccctcgtgtacgccgagctctcagggatgctcccggaggcgggcgggatcgctcgctacccggagttcacccacggtccgctggtagggttcgtcggctcgtggggcgcgttcctcgcctacgcttcggtgcccgccatcgaagccgaggcggtggtgcagtacgccgagcactacattccgaagctgaccgggaacaccgcactcgacttcgtcatcgaggcggtgctgttgatcatcttcttcgccatcaacgtctacggcgtcaaggcgttcgcgaaggtgaacacggtcatcacgttcttgaagttcgtcgcaccgacgctcacggtcatcgcgttcttgttcgccgtcggccactggagcaactacacggcgacctcgaccggaggtttcatgccggagggtagcgcgggtatcctcggcgccgtggcgacctcgggcatcgtgttctcgtacctcgggttccgccaggcagtggagctcgctggtgagtcgcgcaacccacagcgtgacgtgcctcgcgcgatcatcacggccgtgttgctcgcggtcgcgctctacacgctgctgcaggtggtcttcatcgccgcgattcctcactccgcgctcgccaagggctgggcgggcctgtcgctgacgtcgccgttcgcgcaggtcgcgtccattatcgggctgggctggctggcggcgatcctgtacgccgacgcggtgctgtcgccctcgggcacggggctcatctacctcggctcgacggggcgcgtcgtcctcggatcggcgcgcaaccgctacctcggtcagctgttccgtcggatctcggacgcgggtgtgccgctctacgcgatgatcgcgacccttgtcgcctcgatcatcttcttgctgccgttcccgacctggcagagcctggtgggcgtgatctcgtcggcgacggtcttcacctacatgatgggtccggtgtcgctgggtgtcttgcgcaagcactacgcagaggcgcatcgtccctatcgcttgcctgcggcctcggtgctctcgccgatcgccttcgtggtgggcacgctcatcatctactggaccggttgggcgacggactggaagctcgccgtcggcctgctcggcggcgttgtcgtgtacctgatcgcctcgagtgctggtcagggggtcaagaagatcgacggggcggcgatccgtcacggtgcgtgggtgatcgtctatatcgtcgcgatgctcgccatggcctacttcggtgcgcaccgcttcggcgcgccgttcgatcacggcaaggggctcatccattatccgctcgatctcgtcgtcgacatcgtccttgccctcgtcttctactactgggcagtggcgtcgggtcgtccgagcacggatacggaggaggccatccagcgtgctgccgagctgcgtcgtcagaccgcggctggcggttccgcagccatgagcggttgagcctcagctcgccattgcgagagggggtcgggctctgcccgacccccttcgtgcgttggcgggccagcaccagccggggcggcggcatggcccctcggtagtatgggcgccgtggaggtctcccggtgagcgtgctcaccgtcatcgtgctggtcctcgccgtcgtcgtggcggtgctcttggtgcttggcctctggcaggtgagcatgctgcgtcgccagatggaggcgtttgcgagcgagtggcgcgaggagatggtccgcatggtgcgcacctcgacccaactcatcgaggaggcctcggccgctcagcggcgggcgcgcgatctcgtcgaggaggccgaggccgatgtcgacgggctcgactgggcgctgcgtgcggtcgtcgagcctgcgcggagcgttcggcgcctgggtcttggggttcggcgcgctcgcgccgtctttcgggagcgtcgtggtggtgaggtgcgccgcgcatgaggcgggtggtgtggctcggtatcggggcgaccctcggggccatcggggcccgccggttggggcgtcttggcgcctcatcggtggatgcgcgggtgcggcgtgagacgcgccgactgcgccgggatctcgcggccgccatcgaggcgggtcgccacgaggtgcgcgtcgccacggcgaacgagcggagccggcgccgcggctcgaggaggagcgggtagtggattcgaatgacctgagacgtgcgtttcgggagtacttcgtcgagcgaggacacgttcccgttccctcggcgtcgctcgtgccgcacgatccgacgctgctcttcacggtcgcgggcatggtgccgttcaagccctacttcttgggcgaggaggtcccgccgtatcgtcgggcgaccagcatccaaaagtgcatgcgcgccggtggcaagcacaacgatctcgatcaggtggggaccacggcccgacacctcaccttcttcgagatgctgggcaacttctccttcggcgactacttcaaggagggtgcgattccctacgcgtggggtctcgtcaccgaggtgctcggactcgatccagaccggctctggatcacggtgcacacgagcgacgacgaggcggagcgcatctggatcgaggcctgtggggtccgcccggagcgcatccaacgactcgacgaggacaactggtggcagatgggggagacagggccgtgcggtccgtgctctgagatctactacgacaagggcgagtcctacggcgcgggcggtgggccggcggtcgggtccgacgagcgcttcctcgagatctggaacctcgtgttcatgcagtacgaccgccacccggacggttcgttgacgccgctgccggcaccctgcatcgacaccggtgccgggctcgagcggatcgtgccggtgctccaggggcacgactcggtcttcgagaccgatctcatgtggccgctcatggaggaggcacagtcgctgacgggccgacgctacggcggtcgcttcggtgcggacgccggtggcgacgtcgggctgcggatcatggccgatcacgctcgggcgacgacgttcttgctcgctgacggggtcgtgccgacgaacgaggggcgtgggtacgtgctgcgtcgtatcatccggcgtctcgtggcgcgcgcgcagctgttgggcgcgaagggtccggtcgtcgagccgatggtgcgcatgaccgccgccgtgatgggcgaggcctaccccgaggtggcgcgcgagctcgagacgatcgtgcagcacgcagcgcgcgaggaggagcggttcgcggcgacgctggcgctggggcgcccgctgctcgacgcggccctcgagggcggctcggttcccggcgcgctcgcgttcaagctccacgacacctacggtttgccgatcgagctcacgatggagctggcggccgagcggggggtgagcgtcgatcgtgccggtttcgaggaggccatggccgcacagcgcgagcgggcccgccaggccgggctcggtaccgaggccgtggagcacccggtgagcgccgaggtgctgcgcgagcacggccggagcgagttcacgggctacgaggccaccgaggacgaggggcgcctgctcgcactcgcctccgaaggcgacgtgctcgtcgccgtcctcgatcgaacgcccttctatcccgaaggtggtggccagctcggtgataccggcacgatcgagggggatggctttcgcctcaccatcatcgacaccgaccagcccgtcgcgggggtgatccgccaccacgtcggagcggtcgagggcgagccggtgatcggggcgttggtgcgggccgtcgtcgacgcggagcggcgcgagggtcttcgggtccaccacacggcgacgcacctgctgcactgggcgcttcgcgaggtgctcggtccgcacgtcaagcaacaaggctccctggtcgcaccggatcacctgcgcttcgacttcacgcactggggaccgctcacgcccgacgagatcgaggagatcgagcggcgggtcgcggccgagatcatccgcgactcggtcgtcacggtggagctcatggatcgcgacgaggcgatccgtcgcggtgcggtcgccttcttcggcgatcgctacggcgacgtcgttcgcgtggtgcacgccggtgagtcgtcggtggagctgtgcggtgggacgcacctcgaccgactcggccgcatcggccacctgcgcatcacgtccgagagctcgatcggcgccaacacgcgccgggtcgaagccgtcgtgcagctcgccgccctcgaggtggcacaccgcgatcggcgactcctcgacgagctcgagcggatcgtcccgggcggacgcgatgggatcggcgagcgcgtcgatcgcatcgtcgagcgtgccaagcgcgccgaatccgagctcgcgcgtgagcgcacgcgcaccttggctgagcgcgcccgcgcgctcgccgagacccggggggccgacggactcgtggtggcgcgcgtggacggtcttgaccagcggggggttcgggagctcgcgatgctggttcgtgaccacgagggcgtgctgggcgtcgtgatcgggggcgtcgccaacggcgtggtcgcactcgccgccgcggtgcgcgagggcgctccctggcgtgccgacgagctgctgcgccccgtcgcgcaggcggtcggtgggggcgtcggtcgagccgaggtggtggcggtctccggtgggcgccgtgccgaagcccttgacgcggcgctcgaggcggtgcggacggcttcgtgagcgaggggttcggcggccgcgctctcggcgtggaccttgggacgaagcgcatcggcgttgcggttgcagagggctcgctcgcgctgccgctcgaggtcatcgacgcgcgggggccgtggcgtgcgaggctcgccgagctggtcgcgtcggtcggtgcgagcgtcgtggtcgtcggtcttccgatcggcctcgatggatcggagggtcgggcggccgcccgggtgcgccagtggtcggaaggcctcgcggagcacctcgaggttccggtcgtgttcgtcgacgagcgcttgtcgtcgcaggccgccgagcgtcgtctcggggccgccggtgtcgacgccaggtcgcggcgcggtgcggtggacgcctttgccgcgaccgagatcctcgagcggtggctggtgacgcagcggtgagagggtggccgaagcggctcgtcgctctcgcgctcgtggtggtgctcgcgctcggggcgatcggggtcgcgtatctcgccgaggcggcgccgagctcgtcgggtcacgaggttgcggtactcatcgagcccgggacgtcgctcgagggggtgtcttccctcctcgcgcgcgagggcgtcgtgcgcaacggcacgttgttcgacctctacctgcgccttcgcggatcgccgacggtggatgcgggggtgtacttcttgcgcaccggggagggctacgccggcgcactgtcggccctgacggcggggccagcaacggtacggctcgtggtggtgccggggatgacgatcgctcagatcgcagccaggctcgccgcactgccggaggccggtcacaacgggggtgcgttcgtcgcggcagcgtctgccgtgcacagctaccacaatcccttcctgcgcggcgcgaggtcgctcgagggcttcctctaccccgacacctacttcgtcgatccggcccagacgccgcacgagctgatccaggagatggtggatcgcttcacccaggaggccctcggcgtgggtctcgagccgggggggacctaccacggtctgagcgcctaccaagtggtcatcgcggcgtccatcgtgaccaaggaggccacggccgcgtccgatgcccccaaggtggcccgcgtgatcctcaatcgactggccgcggacatgccgctcgacatggactcgaccgtgcgctttgcgaccggcaacgagaacgcgccgctgacggcggccgaactcgcctcgccctcgccgtggaacacctacacccatcgagggttgccgccgaccccgatcggtcagccgtccgtggccgccatcgacgcggtgctccatcccgccaccggaccgtggctgtacttcgtcgcgctccgcgggcatcggaccgagtcgttcttcacgacctatgccgcgcagcaagcggcgatcgcgcgctacggagaggccgggtgaggcgcgcggatcccgaactcctcggggtgatcggccatccgatcgcccacagcctctcaccagcgatccacgccgcagcggcccgcgccgagggtcgtcgcttcgcctaccacgccttcgacgtcgagcccgctgcgctcgcggcagcgatcggggggcttgtcgtgctgggagcgcgcggggtcaacgtcacggtgccgcacaaggttgccgctgctgcgctcgtggatcgactcgagccggaggctcgggcgacgcggtcggtgaacacgatcacgatcgaggacgacggcacgctcaccggtgcgacgagcgacgtcgagggcgtcctcacgtccgtgcgcgacgatctcggtctcgaggtcggcgggttgcgcgtcgtggtcgtcggggcaggaggtgcggcgcgcgcgacggtctatgcgctcctccaggcgggtgcggcctcggtcggcatcctcgcgcgcgatgtggcgcgcgcggccgagctcgctcggagccttggcggttccgtcgtcaccgcccatgacgacggggcggcggcagatctcgtggtccaggccaccagcgtgggcatggcgggcggccccgatcccgcgggatctgcggtgccggactggctcctcgatcgtgccggcgcggtgctggatctcgtctatcgcccgagcgtgacgccgcttctcgaggccgcacgccggcgcggacttccggcggccaacgggttgacgatgctcgcggcgcaggcgcgtgggtcctatcggcgttggttcggcgacgcaccgagcctgtcggtcttcgtcggcgcggcccgcgaggccgccgccgagggctgaggcgatcggcgcgagccgcgaacgggctcgccgaggctgcccgggcacgaccggttctggccgtgcgcgcctcgcgtgatgtcacagtcgccccagctgcgcggagcgcctcgactgccctgtcagcgggtcagcgtcgccgagccctgcggtgctcagtcgttcgtcgatgcgtcctggttggcgtcgtccgagacgagtgccttggcctcgtcgagggtggtgtcgggtgcggggacgacgacctcggccgtcacggcgggatcgtcggtcggcgtgccgttcgtccggacgagctcgatgacctgtgcgagcagtcgcgtgaacccgtcggcgtcgtcgtgatcgagggcctggtcgagcgcgtcgtcgagtccgtcgagcgccggtcggagcgaggcaggcacgaggtagacgtggtccgacaagatgcgcaccgccaccgtggcggccgacgtcccgggcgccgggggtgtcgcgggcgccggaggtgtcgtggcctgtgccggctcgctggccgcgatcgccgcgggcgctggcggtgctccgatggcgttcgtctggtccgcaggggcggcaagctccgccttgatctgggcgagctgcagatcgacgtcgttgccctggttgccggccgcgagggctgcctcgatgtcgtccccaccaccgccgagcgctggtgagtcgaggaccccggagtccgccagttcgccgacggcggcggagcgcgcttgcatctcggagatcttgtccttcgcgcgatccatcatcatggtcacgtcggtcatctgatccgacaggccggtgaggccctcgagcgcagcggtggacgccttggcggcggtgtactgcgccttcatggtgtcgcgttgggcgcgaaacgcctcgatcttggcgttgagttgccgtccggtctcctcgagcgcggcctcctgcttggccagctgctcgatctggggcgtgagctggtcgatctggggcttgatggtgctcgcgcgctcgagggcgagccttgccacctgctcctggccctgctgcacggcctggcgcgcctgtccttgcagcttgtcgtactgggcctggagctgggcgcgctgagcctcgagtcgcttctgggacgtgaggacgtcggcgatcgacttacgaacctgctggaggttctcgagcatcttctggtaggacaggtcgagcgcctgggttgggtcctcgaccttgttgagcagtgcgttcgacttctgctggaacacctggctcacacgcttgagcaggcccattggcatctccttcgatgagacccacccgcgcgccacggttcgaggcgcgctaggctccacagagcatggtagcagcagcgacgcagcgttcgtgggccgtgcgcttagcgttctcggtgcctgcttgcgttgcaacgcccaaggcctgaggaggtgctctccatggcgacatcgctcgcccccagatcccgcgggacgacgtgggcgcgccttcgcagctacgacgcgctcctgtggttgctcgccgcggccgtgggcgtcttcggtgtcgtgatggtgtactcggcgacccggaaccaactggaacttgctggcctctcgccgcactactacctcgatcgtcaggcgatcttctgggtgctcgggctgatcgtgatgagcgtcgtcgccgcgctcgatctcgagtggctcggtcgtctcggctactggatctacggtgcggtgctgctcggcctcgtggccgtgttgtcgccggtcgggtcgtcggcgctcgggtcccagcggtggttccagctcggcccgatccaggtgcagccgtcggagttcgcacccatcggcgtgatgttcggtatcgcggcctatctctcgggacgcgatggaccgcggacgtggcgcgaggtggccgtggtcctcgcgctcgggggtgtgccggcactgctcgtggtgaagcagccggacctcggcaccggcatcgtggtcggtatcgtcaccatggtgctcctcgtcatgggtggcgccaccggtcgtcagctcctcgtgatcctggttgccggggtgctcgggatcatcgccgtcgtgcacctcggtctgctgaagcactaccagctcgagcggctcctctcgttcgtgaacccgcagtcggcgacccagacctacggctacaacctggtccagtcgaagatcgccatcggttcggggcacatcttcggcaccggcctcttcaaggggagccaaacgaacctcgcctacgttcccgagcagcagaccgacttcatcttcacggcggtgggcgaacagctcggcttcatcggtgccggttcgctcgtgctggtgtacggcatcatgctggccaggtcgtatcgggtgctgcgttcggcggcggatcgagtctccatgctgctcgtcgccggcgcgatcgcgtggatcggattctcggtgttccagaacatcggcatgacgatcggcatcatgcccatcaccgggatcccgttgccgttcgtctcctacggcggctcggcgatgctcggcttctcctcggcggtgggcatcgtgctctctgccgggtcgaggcgactgcgacgtgccagctgaggagccgccgcagaccgaaggcgcgcccctcgtcgtctgcgacgttgcgagggtgcacgtcgccctcccggagccgttcgcgcggatcgagctcgtgtcccgtcaggccgagcacccgggtcggttgtcgttgccggtgagcgtcgagcaaggtcgtgccgtcgcgctcgcccttgcgcgccgacgcgcaccgcggccgttcacccacgaactcgcctccgagatcgcccacgccgtcggggccagcgtgttgcgcgcgacgctccacggctccccagaggggggcgagtccaccttcgcagcgacgctcgagctcatgggggccgatggttgtcggcacccgatcgacgcgcgaccgtcggacgccatcgttttgtgtctgctcgaggccgtcccagcccccatcctcgtcgaggcaccgctcctggccggcccacccaccgacggctgacgtcgacggttaggacgccggccagtcgagcccgagatccaggctcggtgccgagtgcgtgatccacccgacagcgaggtagtccacaccggtgagggcgacctcgcggagccggcccggacgcaggccgccggaggactcgagcttggcccgccctccgttcagacgaacggcgtcgcgcgtggcctccagggtgaagttgtccaggagcaccatcggcacgtcgagcgcgagtgcctcctcgaggccgtcgaggtcgtccacctctacctcgatgggaaggtcgccgaagcgctgacgtgcggcggcgacgaggtgctcgaggggtgcctgggcgaggtggttgtccttgagcaagatggcgtcgtcgagactgaaccggtggttctcgccaccccccgcacggacggcggccttctcgagcccacgcatgccggggagggtctttctggtgtcgcggagccggcagcgggtgtcggcgatctcggcgacggcccgggcggtcgtcgtggcgaccccggagagatgggtgagcaggttgagcatggtgcgctcggctgcgagcaggacacggttcgatccggcgagctcggcgatgagctgcccgggctcgagcgcgtcggcgtcgtgtgcggaccactcgatggtgggcgcggccgcaccgaggcgcgcggcggtggctcggagcaccacctcggcggtgttggacccggcgaggacgccctcgtcgcgggcccggagctcgagtcggacggtccgttcgggcaccaaggagccggtgatgtcgccacgctcgccgaggtcctcgtcgagggcgagcgcgacgaggcgttccaggctggaggcgcggagcgccgtcatgggcgcagctcccgggtgacgcggtggtcggcgtcgaccgcgagctggtagtggggatcctcgtcgatcgcgtcgcgacgggcatgcgcgcccacgctgccgcgacgggccgccgccccagccagcatcgcaccgacgagccacgtcgccccagcctcgctgggatcgccgctcgactcgccagtgaggccggcggtcttgatcgtccggtacgccgcggcgagcgtgtccccgtcgcgcagcggaccgagggcgagggcggcaagggcgcgcagacgcgcgagtgggagtgcgggacggcgcacggggcgtggtagagccgtcggcaggggtgtcgggcgcggcaggtcgccctccgtgatggcttcgccgacacgccgtcccatgacgacggcctcgaggagcgagttcgaggcgagccggttggcgccgtggagtcccgtgacggcgcactcgccgacggcgaagaggcccgggaggctggtcgcgcccagctcatcggtcgcgatgccgcccatggtgtagtgcgccgcgggacgcaccgggacgagctcgcggagcgggtcgaggccgagcgtgcgagccgcggcgacgaagctcgggaagcgatcgacgagcgatggcccgatgggccgcgcgtcgaggaaggccggggtggcgtgcacgctgaggtgcaaggcgagctggtcgcgggtggtgagttcgcgcgccgggaggtcgtcgacgagggacgtaccgtcggcatcgacgaggagggcgccggccccacggagggcttcggtggcgagcgcgaagggcgcacgtgggcccccgatggcggtcgggtggaactgcacgaactcgaggtcgaccaccctggcacccgcccaggcggccgcggcgatgcccgtgccgagattggtcggggggcaggtgaaggcgtcgaagagcgcgccggcccctccggtcgcgagcacgacgcgacgagcggcgatggcgtcgaggcgtccgtcggcggtgcggacccaggcgccgacgacgcggccatcgagcgtgatgagctcgacgagcgtgccgtcgaggcgcgtgatggagccgagccgagggcggagcgccgccatgacggccgcaccggtggcgtcgccggccgcgtggcggatccgtgcgcgccggtgaccggcttcaaggccatagtcgggtgcgaaggccacgccctggtcgccaagccagcgaatcgcgctcggtccgtcggcgaggatgctcttcgcggcgcgctcgtcgaccaggtgggcgccggcgtcgatggtgtcggcgagatggtcgccgatgtcggggccgtcgacgggggctgcgatgccgcccttcgcccagtcgcttgaggtcgctgcgcctcgaggtgcgacgatggcgacgcggagcgtgggcgccacgctgagggccaccgaggctgcagcgaggccgtcgcctatgatcacgacgtcgaagctgctcaccatggtcgcaccgtgggatcgagcatcgcgagtacgggtcggcgtgcggcctcggcgacggccggatcgagtgtgacctcgccctcgttgcgctcgagggcgccgaggagcagctctggcgtcacccgctgcatgtaggggcacgtggcgtcggcgcgcagcggttcgaagctgatcgagttctcgcgccggagctggtggagcacgcccgtctcggtggcgacgatgacgcggcggtgctgctcggcgcgggccgcctcgatcatctgcgtggtcgacaggaggcgcacccgttggcgccacgggtcgtcgacgagcagggcgctggtggtgcagccgcactcggggtggacgtagacgaccgcctcggggtcgtcggcgagcgcggtctcgagggcgccgggctcgagcgcggcgtgtacgtgacactcgccgtgccagacgtgcatgcgttctcggccgagcgtacgcttgacccacgagccgaggaagacgtcagggaggaagaggacctcgcggagggtggggatggaggcgaccacctcgagcgcgttcgcgctcgtgacgcagacgtcggcgagcgccttcacctcggccgaggtgttgacgtaggcgacgacgatggcgtcgggatgggcgctgcgccactgccgcaggtcgtcggcggtgatggcctcggcgagggagcagcccgcatcgtgtgccggcaggagcacggtcttcgtcggcgacaggagcttggcggtctcggccatgaagcgcacgcccgcgaagacgatccgccgtgccggatgctcggccgcgatgcgggagagctggagtgagtccccggtgacgtccgcgaggtcctggacccacggtggctggtagttgtgtgcgatcaggagtgcgtcggtggcgagggccttcgcggcacggaggcgctcgaggacctcggccgagggagtgggcccgccgacaccgagggttggcttcgtcgcggtcgatgcggaactacttagtctcatcaagagacaaagttagtgggtgacgccatcgccacagctcggctggtcggccggtaccggtacggatccgaagtccgacgggctcgatcagcgtggactcgacgaggcgcctgcgcgcgttgggcgcgtggacctgttccccggtgagggcctcgatgcgcccgatgagcgcggggagagtgaaggtggcggcgaggagcggggcgaggacgctcgttcgatcgaggaggtcgcggaggaggagcaggccacggccgacgagggcgagttcgtcggcggtgagcgtgctgggccgcgggctgcgggcgctgcgatggtcgagggccggcatgaggtcatagacccggaggcggtcgacgcccgaggcgttcgaggcgagcgaggcgaggaggccgacctcggcgtagcggatggtgctgggatcggcggctgaagccgtgagggcatgcgtcggcccgggatcgagaccgacacgagcgtggaaccagtcgtgcagcgcatccgtgagatcggcgcacggaggtgcgagggtcgtcgtggggaggtggccgtcgagggtcaggaccacgggatcctcgccctcgacggtgagcgcgatcagggtggcttcgaggcgccagcagggcgtctcgttcatggttgtggcaattcctgcaatttgcttgacaatagcgccgggctgtggcatgctccatatgcgcaggtgcgcatatggcaatgctccgagcgtccggtggaggaaccggggcgaggagcggagccggcggggacggtcgacatcggggctgggaacctcccgatgaggtgccgtcgtcggtgtcgtacctcgcgcaggcaccggggggtgcatggatcgcaagatccgaggtgcgtgttgtgacaaggggggactcgtggacgaaccagcagtggtcttggactgcaccggcctgcagtgtccgatgccggtgatcaagacgtcgaaggcgatcaaggacgtcgaggtaggggcggtgctcgagctgctcgcgaccgatcctggcgtcgagccggacatgcaggcctggacgacccgtacgggcaacgagctgctcaaggtcgaccgtcaaggtgacgtgttccacgtcttgattcgtcgcgccaagtagcgctgcgcggtcggtcgcggtccgagcgaccacgtggcgggcacgagccgtgtggcgcgaaaggctgcgtacggtctcgctccgcgcgtgatcggtgctcacgcgacggcgagctgcgatggtggcgtctcttgctgggcgtgcgcgaccaccatgacgggttcgcgtccatggaggtggctggccctcacaatttccgtcagttccgtcagtcgagtcgctgcccgcgaggcgggccaggtggtgaggaggcaggcatgtggaccaacgagggtgaaggaaagatcgtctacgtccagacgcacgggatcaacgatccagggcgctcggcgacgccgttcttcctcgctgcctcggccgcggcgatggaggtggaggtcggcatctacttcacgatgtacggtccgcagctgctgcgcagggacatcgtggacaagatcggaccgaagggcgatcgcgggcagccgctctcgtacttcattcggcaggcgaccgatctcggcgtgcgtctgtgggtctgtcagccttcgctggacctgaacgacctcaccctcgaggagctcatcgacggtgtcgagatgatcggcggggcggccttcaacaacctggccatgaccgctgacgcggtggtgtcgttctgatgcccacgttgagtgccgacccctacctgaagcgttccgacgccaccggctatggcgaggtcgatcgtgcgaccaaggaacgcctcatcggcgaggtgttcgaggatccgcggtttccgcactacctctacgggtgctacgagtgcgggatctgcgtggcggcgtgtccgtcggccaggttctacgacttctcgccacggcgcatcgcgcaagctgcggccaggcgtgacgtggagctgctctatcagcagctcgaggaggacgtctgggagtgctcgcagtgtttctcctgcctgcgctgcccgcgaggcaacaaccctggaggcatcgtgacgatcatgcgcgaggtggcggtccgtgagggcctggcgtcggccaaggaggcgctcgcgggctactcccggatcatctacaagatcatgtcgacgggcacgcaggtctcgcccgacatgctccagcccgacgccttccccgactggggaccggaggtcaaggacgtctcggtcaacctcgacctgtggcgtcggatgctgccgcccgagacgatgcacaccaccaccactgggtggcaggtcgccgatcggacgctcgtcgagctgtacgtcatctggttggaaacgggggcgctcgacatgatcgcccaggtcgacaaggggatccacatgatcctcgccgaactcatggaggagcgactcgaagaggagggcatcgagctatgaccacgagcgctgtcaacgtcatcctgtcgcgcaaggagcggttcgagcgagagcccgatcgccgctccgaggacttccaccatcacctgttcgagctcgaagccgagggcgaactggtcgtccagcgcgtcgccggggaggtcgtcgaggtcccgaccaagtacgggatcgccaagcggatcccgaaggctcacctctggcatcacaagtcgtgcggccagtgcgggcacatcccgggctactcgacgtcgatcttttggatcatgcgcaagctgggctacgactacctcgatcccgaggatcagacgagctgcacggcctggaactactacgcctcggcgacctcgaaccaggccgcccaggccgccgtcgccgtgcgcaacttcgctgcggcgtacgagaccgggttcttcccactgatccactgcggcaccagctacggccactacaaggaggttcgctccgagctcctgcacgacgcggcgctgcgtgcccaggtgcgcaaggtcatggagcgactcggcaagcagctcgtgctgcccgaggagatcgtgcactactcggagtggctgtacgcggtgcgagacgagatcgcccagcgggcggttcgggacgtgtgcaacgtcgccgttacggtgcatccggcgtgccactactacaagctggtcgagggcgacgccatctacgacccggatgtctaccacggtcagcgcacggcggcggtgtcaggcctcgtgcaagccctgggggccgaccttcggagctactcgacgttcttcgactgctgtgggttcggctttcgccacatcctggtgcagcgcgacttcacgcggtcgttctcgacgctgcgcaagatcgaggtgatgcgagcggaggccgaccccgacgtcgtgctcacccacgacaccggctgcgtcacggccctcgacaagagtcagttcgcagcccaggcgcacgagcgcaacgtgggcgtgccggtgatgagcgaggcgcagttcgccgcgctcgccatgggcgcccatccgttcaaggtgtgccagctgcactggcactcgaccaactatcgaccactgctggagaagatggggatcgactggcgggccgcgtgggccgagttcgaggaggacgccaagcgcctctcggacggtcgtcagcagttcctgacctgggccgacgtggatgcgtgaggggggtacatggatcgaattgtcgtgatcggtggtggcccggcgggcctgtcggcggggatcgccgcggcggagctgggtgcacccgtgacgctggtcgagcgcaacgccttcctcggtggacggccggtcgaggagaactacgcctctatcacgccctatctcgaggacgcggcgatggtgatggggcggatggaggagcggctccgggccgccggtgacgtcgaggtgctcttgtcgtccgaggtggtgcacgcggccggtgacggaccctacgggctcaccatccgtacacccgatggcgaacgagtccaagaggcctcggccgtcgtggtggcgacgggcttcacccacttcgatccgggccgcgagacgcagctctatggctactacgagttcccagacgtgatcgcgctccaggacctcgaggccatgctgaaggagcaccacgtcgtgcgcccctcgaacggggaggccccgcggcgcgtgtgcttcatccagtgcgtcggcagccgcgatcgccagatcggcaacgagtactgctcgaaggtgtgctgcggtgtggcctcgaaggaggcgatcgaggttcgccagctcctgccggattcggaagtgttcatcttctacatcgacatgcgcatgtacggctactgggagcgccagctctactggccggcccaggaagagcaccacgtccagtacgtcaagggcatcgtgaccgaggtcctgccgaaggacgggcgcctgctcgtgcggggcgaggacaccaccatgggtcggccgatggagacgctcatggatctcgtggtcctgtcggtgggcatggagccctccccgggaacccgcaagatcgccgggatcttggggctcgcacagaacaagttcggcttcatcgaggcccagcagcccccgctcgacacggtcgggacgtcgcgtcccggtgtgttcgctgccggtgcggctctcggaccgagcgatctcgaggactgtgcctcctcgggtggcctcgctgcggcacgcgccgtcgcgctgtggcgtcagcaccagaccgtcggcgcgcgatgagtgtcgtgagctcgcagctgtgcgacctcgagagcgtgcgtgcgttcttggaggctttcgacgagcaagccgggagcgcgacccgcgctcggctcctcgagcgggcgcacgagcgtcgagcacgggtacgtcgagcgctcgagctcggtgacgccgatctcgtgctcgagacccaagtggcgagtcggcggcgacggcggacgctcgctgggctgcttgcacgagacgagctcgaagcgctctgtcgcgatgtcgcagccggtatgggcgaggcacgcgcgctcgaggacgatcctcggcgcgaggttgtcgagttcgttcgcgagctcgtgcacctgtgggaccctgcgaaggtcgcgctctggacgtcgtgggtctgggcccccgacgacgagaccggcgcgctcgcgctcatggtggaggacccagcggcgctcctcggtgccgacgatgccgaggtggccgcgcgggtgggcgaggcgagtcgctacctcgccgccgtgctcgaggcggcggggctcggtgtcgacgctgccgatccgttgagcttcgacgtggcggccgctgccgtctgggccacctacgcggtgacggtggtgcgcctgcgcatgaccaaggagttcacacagctccttccgccggccgctggctttgcggaacgagcactgggactagcgagggagggctgatgccggtcggagggcgcaaggtggcgcctcaggtggtcgaactcgaggaggccagggtcacctcgaccatctcaggcagggagtgggacgtctcgggcggcccgagtcgcatgctgatgccgcgggtgctcaccgactacacccagcgcggcttcgaggcgatccgtgcgctcgccggtggcgagagcctcgagtggtgctacggctgtggcaagtgcgtaccggtgtgcccggtcgatctcgtgggcgagtacgggccgcgcaagctccaccgcatggtccagaccgggacgaacctcttcgaggccgatcagctctggatgtgcacgacgtgcggcaactgcctgcgcgtgtgcccgaagcaggtcaacatgatccagatcatgccggcggtacgcgaagtggcggtcgccgacgggaccatcccgaccgagctccaaggggtcatggagaagaccttccgctacgggaacgccttgggcgagaatccccggcggcgccatgcctggacgaagggcgcgggcgtcccggtgcgggtgctctcgcaggatccgagcccggtggacgtgttgttctacgtcgaggactactggagctaccacccgcgcggacagcaggcggcacaggcgttcgcgcgtgtgctgaacgcggctggggtcgactttgcgatcctcggcgccgaggagaagaccatcggcgactcgcagcggctcgccggcgagaaggggctgttcgaggccctgatggaggacgtcgtggcgacgctcgagcgctacgagttccgacgcatcgtcacgccggacccgcacggcttcaacgcgctcgtgaaggtgtacccctcgtatgggcatcactacgaggtgctccactacacgcagctcctcgcgccgctcatgtcgtcactcgagctgacgaacccgatcgacgcgaaggtgacgttccacgatccgtgctacctcgggcgtcacaacggcgtctacgacgcccctcgcgaggtgctgcgagcgatcccggggctcgagctgatcgagatgggtcggtgccgtgagaactcgtactgctgcggtggcggtggcggcggcatgtggctcgacggcttcaacggcaaccacctctcggagcgcctgtcggagcgacgggtgcgcgaagccgcggcgaccggtgcggacatcttggctgtgtgctgcccgtacgaggtgtcgcgcttcgaggacgccgccaagtcgaccgggaacgaacatctccgcgtgctcgacatcgccgaactcgtggacatggcaatggcgccggcgctcgctggccaggttgggtgaaggaggggggatggacatcgtcgtcgtggtccgtcagctggcggacctcgtggaggaactcgaggtcaacgacgagggcacggatatcgaccgtgacttcgtgaagttcgtcgcgaacgagtgggacgaggccgcgctcgaggaggcgctgtgtctcaaggaagcggtcggggggaccgtcaccgtggtggccctcgacgagccggacgtcgaccagacgctctatgccgccgcggccaagggggccgaccgggtcgtcaagctgaccgggcacgatcccgacggctgggtgcgcacgcgcgagcgagccgctcgggtcgctacctggctccgtgatcagcatccggacgtggtcctgacgggcgtccaggcggccgacgacctcgacgggcagatggcgggcgtggtggctgcgtatctcggatggccgcacgccgccgtcgtggtggtggtcgaacccgccggcaacgagctcaccgtgacccaggagctcggcggtggcacggtggcgacctcgacgctcgccatgccggcggtgctcgggatccaggcggcgcgccaggcaccgcgctacgcgcccatctcgaggatccgccaggcgcagcagtcgacgaccatcgaggaggtcgagatcgacgagccggcgatcggcgccgtcgcatccgtgcgtcgtctgttcccgccaccgtcgcgcggtggcgctgagatgctggaggggtcggcggccgaggtcgccgacaagatcgtggagatcttgcgggcccgcgggctcgtgcgcgcgtaaggggggttcagatgtcggtggcagtgttggtggtgagcgagcgggtcgtcggcgaggttcccgacgtcacgttcgagctgctcggcaagggccgtgagatcgcctcggcactcggtggcgagctcgccatcgcggtgctcgggcaccaggtcggcgagctcccgttcggggcagccgacgtcgcctacgtggtcgacgatcctgcgcttgcgaactacgcggcgagcgcggtcgaggcagcgctcgctgccgtcgtcgaggccgcgtcgccaaaggtcgtgctgatgagtacgggcacggtcgggctcgatctcgccgcgtcgctggcggctcggctcggcgcgccgatggcgtcctatgcggtcgacgtcgcgacggaaggcgacacggtggtcgcgacgagtcagctctacggcggcaagcttctcgcagaggtcgccctcgagggctcgccggccgtcgtgagcgtgatccccggcagcttcgcggccgatgcgggtcgcgtcgggggtgcgccgcgcatcgagaccatcgccgtgtccctcgatggtgctggtgcacgaggcgagggtgtgcgcgagcccgaggcgagtggcgtcgacatcaccgcagcggatctgttggtgtccgtcggtcggggcatcggctccaaggagaacctcgagctggtccaagagctcgccgatgcactcaaggtgccgctcgcggcctcccggcccatcatcgaccagggctggctccccaagccgcatcaggtcggcaagtcgggcaagaaggtcaagccgcaggtctacctcgcgctcggcatctcaggggcgcccgaacacctcgaaggtatgcgctctgccgggaccatcatcgcgtgcaacaccgatccgaaggcgcctatcttcgaggtcgcacactacggcacgacggtggatctgttcgatctcgtgccggagctgaccgagcggctctaagggtgagcatggtcgcgctggttgagacgaggccgatcttcggcggagagacggagacggccaagctcgtgttctacgcgctggcgctcatcgtcatcgtggtcttcttctgggggctcgctcggcgagtgcgggcatggtcgcggggtcgccggcccgccggttggcactggctccgtcggcgagaccctgccgacatcgccgacgtcaccgagcgtccgaaggtcgcgtcgtcggtcgcggtgatcgcagccaacaagacggtcacgaagacgaagcactcggtggggatggcgcacctgttggtgttctggggcttcatcggcctcttcgtcgccacgtcgatcctgtcggtcgactacgacatcctcggcaacctgtcgcggctgatcgtcggccacaccgtgagcttcttccaaggtccgttctacctgggctacaacgcggtcttcgatcttgcgggcctcgcggcgatcgtcgggacgctcctgctcgcgctgcgacgctggttcagcccggagatccaactcgacctgcaccgcgccgagcagcccgagggaggctactcgcgcgcgaagatcgccctcggcgaccaggtgttcatcgtcgggctcttgctgatcctcctcaccggtgtggccatccaggcgctccgcatcgatggcgagggctttccgagtttcgagcgctggacctggctcgggtggctggtggcgaagctcttcgtgagcctgggtgtcggtcgggttgcggctcgtcacatccacgcctggctctggtgggtgcacgtcgggatggcactggcgttcatcgcctacatcccgttctcgaaggccctgcacatgctgtcggcccctgccaatctcatcgtgcgcgatcccaagcaggttcgccagctgccgccaccgcccgagggcaaggtgggctacagcgagctcggcgacttcacgcccgccgaattgctctcgctggacgcgtgcaccaaatgcggccgctgccatggcgtgtgcccggcgcggaccgccggcgcgcccctctcaccccgtgacctggtgctggatctgcgttcctggctcgatcgggcccaaggcatcgagctcctgctcgactcggaggatcggcccaccccgaccggcccacgggccccatcggggccgctcgcaggcaacgtcgtggccgagcgcgtgctctggtcgtgcacgacgtgcatggcgtgcgtcgaggtgtgtccggtgggcatcgagcacgttccgctcatcgtccaactgcgccgccccctcgtcgacgctggccagatggacccgacgcttcagagcgcgctccagaacatcgcccagcaaggcaactccttcggcaagtcctcgcgtatgcgggcgcgctggaccaaggggctcgagacgccgatccccgatgcgcgcaaggagccggtggagtacctgtggttcgtgggtgactacgcctccttcgacgagcgagtcgcggagctctcacggaccttcgctcggatcttgcagggagcgggcgtctccttcggcatcctctacgagggtgagcgcaacgccggcaacgacgtgcggcgcgtgggtgaagagggcctgttcgagatgctcgtcgaatcgaacttgcaggcgctctcgcaggcgacgttcgagacgatcgtcacgacggacccgcacagcttgaacaccttgcgcaatgagtaccccgccttcggtctcgacaagccggtgctgcactactcggagctgctcgcgaagctgatctatcagggaacggtggagccgaggcagctggggttgcgggtgacctaccacgacccgtgctatctcggtcgttacaaccgtgtcttcgatgcgccgcgtgccgtcatcggcggtctcggctgcgacctcgtcgagatgccgcgcaaccgacagggatcgttctgctgcggagcgggcggcgggcgtatctggatggacgattccttcttggccgagcgcccgagcgtgaaccgcatcaaggaggcccttgcgctcggcgtcgacgtcttcgtcgttgcgtgcccgaaggactacgcgatgttctccgatgccgtgaagagcgtcggtgccgaagggacgttgcgcgtcatggacatcaccgagctctttgccgaggccgtgctcggggcgcctgcgctcgaaggggcgagtgagtgagcgatggcggcgagttcatcctcacgtgcttcgtgtgcggcgagcaggggagctaccggagcctgcacgcgcaccttgtcgacgcacacccggaactcgtcgtcatcgaatcgggtccgcgaccgagctatgcgcttcgctgtccggtgtgcggcgaggcctaccgtcaggcgatcaagcgcgggcgggccgatcgcgacttcgtcgccgcgttcgaacgcgacgtgcgggtggtcggcatggacatcatgctccagcacgtcatcggcgagcatcccgatgcagtcggcgtcgacctcgacgcgttggcgacggatgccgatgagccggaggagtgaggggagcgagcccccgcgcgctcgtggagcgatcgtcgtcgcgggaccgcagcgagagcgcagaaccgagtctccaagagaggaaaggatggattggcatggctgaggtgcgatcgtgcaacctccccgaggacctgtactacctcgtcgaccggcacgtctgggttcgcccggagggtgacgtgttggtggtggggctcaccgatgtggcccagaacctggcgaagacgatcatctcggtgtcgctgaagcctgcgggcaagccggtgaaggctggacgctcgctcgcgaccgtggagagtgggaagtgggtcggcccggtgcccgcaccggtggacggcgaggtggtcgaggtcaatggtgcccttgcgacccatcctggcctcttgaacgacgatccctacggcgagggctgggtcgcgaagctgcgagcagacgccttcgatccggctgctgccggtctcgtcaccggcgatgagggcattgcgcgctacagcgccttcctcgaagagcaggggatcagctgcggctgaggtggcgcgatgagtgagacctgggcgggctgcgaggtcccgccggagctgcgctacgacttggatgccgacgtgtgggttcgcttcgagggcgagctcgtgcgactcggcatgaccgatgtggcgcagtcgcgcatgggcaagctcgttcagctgtcgtggaagcgcgtcgggcggacgatcacgcggggacgacccctctcggtgctcgagagtgccaagtgggtcggaccgatggtctcaccgctgacgggcaccatcgtcgcgacgaacgaagccgcattcggtcgggacgtcgcgatcgcaaaccgagatccctatggcgacggttggctctatgtcgtcgagccaacggtgcctgctgagttcgacgccttggtcgacggacgaaccgcgttcgagcactaccgacgtgtgatcgacgagtccggattgcgctgtttccgctgtgaggacccggtgatattcgtggatgaagatccttgaatgatccctgatcatggcgtagactcaccaggtgaacaccgcgggggatttggtgttcacctggagggtgatcgcgttggacgagcggttcagagtcggtgcggtcgtcgcacgctgatcgagtaggggcatggaggctcagtcaacgacacaagggtgacagaggggcatcgaggcgtcgcgggcgtggcgcgcgtggcgcgcgacccggaggagccgttgcggttgaatccgacgaccacgacggtagccctcccgaagagccgatcactacggcgcatgccgcagcggaacggttcggcatcacagagacaggtacgggttgtacgaagggggaaccatggcaaaggatgacggcacccagtcgatggcgatgatctgctggagttccgatctcgatcgggtctggccggtcttgatcctcgcgaccacggcagccgcttccgggctcgaagtggacgtgttcttcacgttctggggtctgcgagtcctgcagcggtcggacgttcgcatcacgggtgagaactggaagcagaagctcgagtcattgatggatccgggctcgaccgatcgccttcgactcgggaagttgaacatgggtggcatgggcacgaagatgatcaagatgctggcggacgagcacaaggtgtcgtcgcccaccgagctcttggagatggcgctcgatctcggcgtgcgcttgcatccgtgccagatgacgatggagctctacggcctgtcgaaggacgacttcatcgagggcctgcagcctcccattggagcggcaagcttcatcaatatggctgccgaagccgacatcaccctgttcatctagtgctgagcgtcgccgtcgtcggtgacgaaggggtggtcgcgcgcgtagtgcgcgccgcctccccattcggctgggaggtaacgagcgaccttggggctgccgatgtcgtggtcgtgccggccggcgaccccgaggcacttcgagcggtcggtgctcgccgtgcccgaggcgaggcgatcgtcgcgatcgcctatgtcgccgagccagatcagctggcctggcgcgcagccgagcgcggcggtgcggatcgcgtcgtcaacgtcggtgcgttgacgaagacgcttcgcgaggtgctcggggatccctcgcgaggcgtcaggcgcctcgtcgtggggcacgtcgaggacgtggcggggcggttgggcctcgtgggcgaggtcgagatcgacggcgcttcgttcatggtcctgcgcgtcgagggacgatgggtctgcctcgaggcgacctgtccgcatcagggagcgcgtcttgccggggtcccgtgcgaggagggtgtgctgacgtgtccggcgcacggctcgcagttctcgtgcgagagcggggagcgcgtgcgtggtccggctgaccgggcactccgttcgctcgctgtggtggtggaaggatcggagctggtcgtacgtgggggaggggttggctgactcacgaggggtcggtacccaggcgcggtattcggctggatggtccccagtggtcccgggccggtcagcggaaccacttctgtcgtatgttgccccgtgcggcttgtgaatcgattgacatccaaaggggcagcgagactcgcaaggcgtccatggcaatgggactcccattgggcagcggctcccggtgacaaggttccgcttgccccggaggtcatggtgcagggaggtgatgccgagcaccacgatctggggagctagtccctatagctgtgtcgcgggtgggtcacttctgaccggtgatcccgggtcaaaagaaggccggtgcctacacacccccgcctgcgcggggagcacctcgccagcaacgtcacggaccacaccgaggtcggatcacccccgcctgcgcggggagcaccgaaatccagttgagccaggcgcaagttcaggcggatcacccccgcctgcgcggggagcaccccaacgcactcctcgtccgcacgcccgaggagggatcacccccgcctgcgcggggagcactcagtcaacgcggccagccgcgcgcaagtacggggatcacccccgcctgcgcggggagcactcgacggtgatcccctcaatctcggtctggccgggatcacccccgcctgcgcggggagcaccagaacctggccatccagcagtcgagcgtcgccggatcacccccgcctgcgcggggagcactccgtcatcgcgtcctttcttgagtcctgctgaggatcacccccgcctgcgcggggagcaccccgccgcgaccgacagccgcaggcgatcttcgggatcacccccgcctgcgcggggagcacgacgtgggtgcccctcaccgacgcgagcgggtcggatcacccccgcctgcgcggggagcactatctatccaccgaacctggcgagcgcccaggtggatcacccccgcctgcgcggggagcacagcttgccctcaatctccagcaatccacgtaccggatcacccccgcctgcgcggggagcacagatcccacacaaggacgccctcggggagctggggatcacccccgcctgcgcggggagcacacgcggggtggtacggatccatcctcaacgcgcggatcacccccgcctgcgcggggagcacacgaccaccaccacgtcgtcgggcttcggcttcggatcacccccgcctgcgcggggagcaccacgcgcggattgctcatgtaacgccacgcggcggatcacccccgcctgcgcggggagcaccgaccatcagaagcttcggttggcgaccgagaaggatcacccccgcctgcgcggggagcaccgctttgcagcggcgtgaggccgaaggtactgcggatcacccccgcctgcgcggggagcacaaaagcccgacggggagtattgcatgcgacgccggatcacccccgcctgcgcggggagcacacccgtgaagagatgcgctcgtgggtagagcgcggatcacccccgcctgcgcggggagcaccggtaatgcccacttctgtctcctttctgctcacggatcacccccgcctgcgcggggagcacctcacctgcgcggcgcgctgagccaggaatgtcggatcacccccgcctgcgcggggagcacttgggcagctcaggacagtagacctccgctgcgggatcacccccgcctgcgcggggagcacatcgcccttggccttggccttggctgcctcagcggatcacccccgcctgcgcggggagcactcggcgtccttcgccacccagttcgggaggtgcggatcacccccgcctgcgcggggagcacacggtggcctgggggctgtcgccgggctggatcggatcacccccgcctgcgcggggagcactacttgaccaccatgtgcagcacacagataccaggatcacccccgcctgcgcggggagcacgggtcgccagcgcggagggcgtcgaggatcgggggatcacccccgcctgcgcggggagcacacgtgggacctccagatcgccggacagacgaccggtgggcttccccccatttgcttgacagtctgaatttaggccacggccacctcccggcaggcccaggagagctcgtactcgacgggcggtaggtacccgaggcttgagtgcaggcggaccgtgttgtaacggtgaatccagctagcgatggcagagcgagcccctgagaggttcgcgaagcggtagcgagccaccagctcgcgcttcaagctcccgaagaaggactcggccacggcgttgtcgtagcaggtcgcgaccctccccaccgactggcgaatgccaagggtcgcgagcaggctccgtaccttccgggagaggtactggctgccgcgatcgctgtgaaagatcgccccagccaggctgccccgagtcccgagtgcttcgcggatcgcctcgaccaccaggtcatcgggcatgtgacgcccaagtgaccagcccacgatgcgcctcgagccaagatctgccaccgtggcgagatagcagaacccctcatcggtgcggacgtaggtgatgtcgctcacatacctgcgcttcggctcaccaggagcgaagtcctgacggacgaggtccgggagcgctgcgtcctctccccgcctcgtcgtgactacgaagcgccggcgtgggcccgctgccatctcgagctcgcgcatcaggcgttccacccgcttgtggttcacgcagaacccgcgccgtcgcagctcgtgggtgatgcgggggctgccgtaggtgccgtcgctctcgtgccagatggcgcgaagctcgctcgcgagcaccaggtgctcgggatcctcgcctcggtcccgacggtgtcgccaggcgtagtaggcctggcgagagaccccgatgactcgtgggcttccccccatttgcttgacagtctgaatttaggccacggccacctcccggcaggcccaggagagctcgtactcgacgggcggtaggtacccgaggcttgagtgcaggcggaccgtgttgtaacggtgaatccagctagcgatggcagagcgagcccctgagaggttcgcgaagcggtagcgagccaccagctcgcgcttcaagctcccgaagaaggactcggccacggcgttgtcgtagcaggtcgcgaccctccccaccgactggcgaatgccaagggtcgcgagcaggctccgtaccttccgggagaggtactggctgccgcgatcgctgtgaaagatcgccccagccaggctgccccgagtcccgagtgcttcgcggatcgcctcgaccaccaggtcatcgggcatgtgacgcccaagtgaccagcccacgatgcgcctcgagccaagatctgccaccgtggcgagatagcagaacccctcatcggtgcggacgtaggtgatgtcgctcacatacctgcgcttcggctcaccaggagcgaagtcctgacggacgaggtccgggagcgctgcgtcctctccccgcctcgtcgtgactacgaagcgccggcgtgggcccgctgccatctcgagctcgcgcatcaggcgttccacccgcttgtggttcacgcagaacccgcgccgtcgcagctcgtgggtgatgcgggggctgccgtaggtgccgtcgctctcgtgccagatggcgcgaagctcgctcgcgagcaccaggtgctcgggatcctcgcctcggtcccgacggtgtcgccaggcgtagtaggcctggcgagagaccccgatgactcgtgctgctgccgctacagagaagcccttggcctcctggcgggagatccagtggtagcggctcactgtcccccctccttcacccagaaggccatcgctcgcttgagcagctcgcgttccacggtgagctgcttgacctggcggcgcagccgtgtcagctcctcgcgctcggcgctcgtcaggccctctcgctcacctcggtcgatgcgttcctgacggacccagttaccaagggtctgctcgttgatgccaagctcacgggcgacgtcagcgatggtgcggcgctggtcgagaaccaacgctgccgcgtccttgcggaactggctcgggtagcggccgcgtcgtcgtccagcggggccgtcgcccggtggtgggttcggtgtctggctcatcccttcctcctatagcaggtgtcaacctggaggggggaaggccatcgtgctgctgccgctacagagaagcccttggcctcctggcgggagatccagtggtagcggctcactgtcccccctccttcacccagaaggccatcgctcgcttgagcagctcgcgttccacggtgagctgcttgacctggcggcgcagccgtgtcagctcctcgcgctcggcgctcgtcaggccctctcgctcacctcggtcgatgcgttcctgacggacccagttaccaagggtctgctcgttgatgccaagctcacgggcgacgtcagcgatggtgcggcgctggtcgagaaccaacgctgccgcgtccttgcggaactggctcgggtagcggccgcgtcgtcgtccagcggggccgtcgcccggtggtgggttcggtgtctggctcatcccttcctcctatagcaggtgtcaacctggaggggggaaggccacggatcacccccgcctgcgcggggagcactacttgaccaccatgtgcagcacacagataccaggatcacccccgcctgcgcggggagcacgggtcgccagcgcggagggcgtcgaggatcgggggatcacccccgcctgcgcggggagcacacgtgggacctccagatcgccggacagacgaccggatcacccccgcctgcgcggggagcacttgagggtggcgggtgaggtaccccaatgcgagggatcacccccgcctgcgcggggagcacgagggtgacgctctcgaccggatcgcggacctcggatcacccccgcctgcgcggggagcacggctactcagtggtcagtcttgaggagaccccgggatcacccccgcctgcgcggggagcacccgtcggcgacctctctggttgccttgtatatcggatcacccccgcctgcgcggggagcactcgaacagcacgagcgacgagccgacctgcaacggatcacccccgcctgcgcggggagcacctaacgtcacatggtatgtggtgatgctcaggaggatcacccccgcctgcgcggggagcactgcgataagccatggggagctgtcgaccaagcgtggatcacccccgcctgcgcggggagcacggcctcaccggcctcaccacgacccgccaagtcggatcacccccgcctgcgcggggagcactgctgaactcgtgatcgtgttccccgccaagtaggatcacccccgcctgcgcggggagcaccgaagtcccagctcaggggcactgggggaaaaaggatcacccccgcctgcgcggggagcactgcccgccgatcccgtagccatcgaccggatcgggatcacccccgcctgcgcggggagcacacctcgttgaccccgaggttctccacaatcgtcggatcacccccgcctgcgcggggagcacctcgctcctccctcttcgtcctctcgtccccacggatcacccccgcctgcgcggggagcacggtaggggccgtgctcatcgctgagggcgctggggatcacccccgcctgcgcggggagcacccgttcgttgcccggggcaacgcagcccactggggatcacccccgcctgcgcggggagcaccgccgttaccgatcacgatccaaccgggaagcaggatcacccccgcctgcgcggggagcactcgcgttgatgacccggacgagctctggctggcggatcacccccgcctgcgcggggagcacttgatgcagaccagtgctgatccgcgcatcgacggatcacccccgcctgcgcggggagcactgccgtggcgacctgcgcgtcgtcggcgttcagggatcacccccgcctgcgcggggagcacaccatagcgtcgagggggtactgcggatgagcaggatcacccccgcctgcgcggggagcacctgctatcgatgactgctctcatgctcttcagaggatcacccccgcctgcgcggggagcaccaagttcagcttcagaatgcgtactgagtcggaggatcacccccgcctgcgcggggagcacgtcagttgacagatcgactacctgaggcgactcggatcacccccgcctgcgcggggagcacccgtcgtgattctgtccttcttcggcgtggtgaggatcacccccgcctgcgcggggagcacgagttgtcgaggtgcatgtgctccgagcaagggggatcacccccgcctgcgcggggagcacagctcgcgttgcgggtcgtcaccaggcacgaggggatcacccccgcctgcgcggggagcacccccagtcgcccgagaagctgagcttgtccgagggatcacccccgcctgcgcggggagcactcaaccgcgtgccccccacccgcgaggccaagcggatcacccccgcctgcgcggggagcacggaatcttgactacttcaccatccactgcctccggatcacccccgcctgcgcggggagcactcagcctgagactctctgatgatggataccgccggatcacccccgcctgcgcggggagcactacattgccttcactggcccgtacctgacccagggatcacccccgcctgcgcggggagcactgctcccgttgctgtcgcagtgcgttggccatgggatcacccccgcctgcgcggggagcacccgatagtcccgaagatcggagagtatcccgaaggatcacccccgcctgcgcggggagcacgtctcactcgggaagagctcgaggagtctccgcggatcacccccgcctgcgcggggagcacccaacccacatgaccaacgtcggcccggttcgaggatcacccccgcctgcgcggggagcacttccgtgtgcggcccgtacttaccagtcatcccggatcacccccgcctgcgcggggagcacatgtcgtctgtgtaggtagtcacttctgccaccggatcacccccgcctgcgcggggagcacacttcaccacatggatgtttaccggctgggcttgcgaataagtgtaagtccctcaaagtccacgggctcccatgtgccgcctacgactttgaaggcaaggccctgttcgttgcgagcggggtagaccatgaccgctcggccgccttctcccaggtgctcgttgactcgttgccacatgaggtcacgaacgcgggcggtcacggttcccacgaagaccccaggagcgatttcgagcagccacctggtgatgtggccacggagcccaacggggacagcggtaagcacgagaaccgtcatacgtcggagctgtagtcggtgcccgctgggacctcgccgatgcgatcgtcgaagagaacgagaccgggttcgcccccaaggtcggcatctggcgtaccaagcaagagacgaatgtcgtcgacggctcgttcgaggagatgtgcctcgtgaatccgttcccgcatcgttcgtcggacctgactcgacagacttcccgttcgctgggcggctgcctcgaaggccaccggtatcgccagttctaccttgtagaggtcggcgacgtcgtagacgaacgacagcgagtggccagtgtggacgaagcccaggccgggactacagccgagtgcaacgatcgccgtatggaccacgccgtagagcacgctgttcgcgatggagagcgcgcgattgacatcatcgcccgcggacgagttgttggggtcgtagtgccgaccatgccagtcgatcccaaaggcgctggcaaggtgacgatacgtgcgacggatgcgcgcgccctccatgcctcggagccgctgcatagtggccttgctcacgtcctcgccgggaaagcgcatctgatacatctggcgcgcgacccggagtcgatcttgccgattcgagacgagacgagcttgcgcctcgaggaagcgcgtagactggaacagcgacggtgcccaggcgtacagacgagtatcaccttcgcccacccagcacaccacgaccccggattctcccaggagcagcatggcttgatgggtgatgcgcgttccgggaccgaggaggagcgtgccgaccgctgctgcaggcaggtaggtcgtgccggactctgttaccgacacgactgcattcgcatcccgatggacgacgcagtgctcgaggtagacgaacgaggatcgtcgtgagaccggctggagttcgcctatcccgacgcgctctccactgagtgggacacggccttcagtcatcggggtctcgctggtgcagcaagcgtgagcaggccgcaaccataggcgcgtgcgtggcctatgccggtgaccaagctgcgccgaaggagctcccggtcgagaacctcgagatggcccatgaactcggtcaacgcgatggtcactcgttggccttgcctgcggaacaccatccggcgaccgcctgtcaccgccacgtctggttcgcctgtcgaaccggtacggatcgtgaaaccgtgctgctcggaccgcgcaaggagccagccgagctgctgtgtgatggtgacgtggccgtggcgcttcgtgtctgcggatccggacgaactccgaccgctccgcaccgcattggctgcgagccggaaggcgtagacctggcctgtctcgagtcgatcgaggaggggcccgtagggcttcgtgtcgtagtccgtgcctcggacgacttgccctacgctcgccgcgaagtgggcgaactgcggctggactgcgctcaccacgtagagaatcgggacccgagggtcgtcgccgtcgacgcgccagagcgttcggccaatcgaattcgcctcctgcggcacactggccgacgtcgcttgggcgatgatcgcgtgcatgcgctgcgggttccgcagaacgctgagagcagcctgcttctgtgggtcgatgtagagccgagtgaggaacatctcaatcgccctcctcgagcagggccatcgggtcatgggtcgagcgagccgattcgtggccgtggccgatggtcacctcgacgtagtgatgactgacccggcggcgcgtgtaggagcgcgtgagtgggtcgaagcttcgtgcctggtccgcaagctcgacatcgccggcgggattctcgacgacgagttcacaccgtatcgacgtcgcggactgcgcggggtcgttggcctgccacgggatgcttgccagcacgtcgatgagcccgccgtcgtagacgccgagccgcagcggcttgtccggggggcaggagcgtcgcccgaggtacaggggaaacaccggagtcctgagtgcgtcgtcgagctcttggagctgcgcggcgtcgccttcgagcccagcgacgaagcaggcgtcggcgaggtagaaccgttcggtgacttgcgtgctcgtagcggcagagcgatagccgcccgatgcagtcggcagtctcccctcgccgggcgcgaaccgcttcttgtcgtcgaacagactcgacagtgtgtggaagtctcgcaagacttcacctggtcgatcgatgcgcacggcgaagcgcagcgcgccgagatcgtcgagagctgcggaccgaggacgccccagggcggctgcgagcagcccgatgacccctgacttagttgggaaacgctccgttcgtcggtagtggtcgagacgctggctgctgccccaggcctgcaatggtcctccaaggcgcagtgcgagcacgctcatgatgccatgtgctccgcggttgcggcctcgacggcgtcgaggagctggggaaaggcgatggagtcgccgaggtgagtcgcgaccgcctgctccagcttcgggacatagctcgcccagccgttcaggcgaggcacgccatagagtccgtcgatgtcgtcggcgtaggtcgccaagcgctcggcagatgcgtggacgtacccacgatcgctctcgactggtgcctcgaaggccccgaccagactgaccggctggtcgcctcgcatggacacaaacaccaagtcgggcaccgtcaatgctgcaaacgtgttctggtgtcccgttggcaggctcttggcaaacgcttcgataaaggcgcgcacgcccgtcggtaccgcgtcgggatcccccaggttgtctgccagtcgtccaaggctcacggtggcgaagcgatagacggtcgcggaattgaactcgatgaaccccatcatggccgcgccggtctcgtcgtcgcctgccaggtcgtcgacggtggtgtaaaagtcgaactcggaggtgacgcgatgggtcgagatggcatgcgcgacctggcacgcggcgtcgacgttgagattcggggtgtcagcgatcatcctgccgaacagagcgacatcgagggagagatccctgcccatcgcggtcgtcagaacgtcgaggtcgaggtcatcgccggcacggagggagcgttccagctctcccaccgccgcatcgattgcactctcggagacgaacaacgcgtattcgagatctgcaggttgggtctcctgggcgcgcttcttgagcttctcctccttgaggccgagcagcgctcccgcggcgaggttgacgagtcgtgcgacgtcgtcctcgcgcacatcgagatcgcgcacgcgggcctggactcgctcgtggaggaggccggcaagcttacgcgtgcgaattccgcccccgcggctgcgcagccagtcggtgccgatggttgcgaggttctcattgaagtagcgcctcgtcgcgcgcttccacgactgtgacgacacccgagctcgacgagcaccgccatagagcgcggtctttggtgcgttggtgtcgtcgcggttcagacatgagggcggcaacgtttgcaggacgtgcacgtcgatgactgcgcgggtgggatggttcatggttcctccttctgttcggcgggtgattgctggtcagggtcgagcgcgtagtagtctcgtgcccatctcaggctgactctctgtagtttctcgggcaggagccaggtactgagatcttggtagagccggggatagtcgagggacacgtccgcaccgcgcatgagcgtgaccagtccccgaaggtgaacgccgagggcgtcgatggtctcgctcgcgagcgcgctccggaagcgccgttctatcccttgctcggatgcgccgctatcgccgcgagaggttcgcaatctccgagttgcgagcccgaaggtcgagccttccttgtcgagggcgccaggcgtcttcgattggtggtgcaacgcgaagagaccgagcgcgaggtgcgcagccggctcacgccagcgcgagcgtcccgtcaccatgaggacgtacggccaagagtcaggggactcgtcaaagctccggccgacgttgcggcgaagcgtcgcgagcgctcccgggtctcgggcgatcatgtcacgtacctgacggaacagtgtgtcgttcgtcgaggtcgacgaagttgtggtcatgcagctcccttctctgggctatccgatggactgaactcgttgcgagcccgtgcgagcattcgtcggaagcggtcctcgccagcgacacccgcgaaggcctgcgccggggcgagctgcgctagctcccggctcgcgagatcccgagcgacggcctcgacgagggcagcccactcagcccgagggcgctcgaggtcgtcgatgttcgcgagtcccgtcaggaagtggcgatagggcgcgtcgagccgaccgtagagctcctcggcgagcgccgaccgtgccgccttggcgagcgctgccttcccttcgggcacccggtgtcgctttgattcctcgtggaaggagaggtcgtaggagaggtagcgagcttcggcgacgtagccgagtgcttgggcagcgtgcgctgcgaaggtgactgcgtcgattgcgacggtggctgctgcgggatcctcctggttcagtacggcaagaggagtgtcgagtcggtcgtaggccaggtcgtcgagggtggtcgacatgttcccgaactttgcggaagtgacgaggagggacacgagggcgatcccccgcgattgcagaccctcgacgaaggacaggacgcctgcgcgctgttcctcagcgccgagcgcgagcacgctgctcaggccccgccacacctgctggcccgggcgcgcccgcagtggcacatagctgacctctgcaccacgcctgctctccatccgccatccgacgtgaggatcgacgtctcgcgcggcgcgacgatcaacctcatcgccagcgcagatgagtacccgcgggacgacgatagcatcgccgcggcgctccgggaagaggcgaatccgccgaccttgccaggtgaacaggtcgcacacaccgtcgggcgcgcgcatcacccgtgtcggccccagcgggtcacgttcccatgcgggcacgtcgtcctcgcctccacggatgagattgcgatactgccacgggacgaggttgaggaggagtgtctcgcgcagtgtctgcccgacgggcgcgacgaacccgatccaagcgaggtagccgatcgcgggggtgtccttgccgcccttgaccttcggattccccttggccccagtcttgtcggatgccgagccgaaggcatggcgctccacgagccagcgtgctgcctcggcggggctcagtgccagctccgtgcggtcggtgatgggcgtgaagacgggcacgttgttgcctgatggcgcgtaggccaccagactgttggcggtcttgacgccgcccttgcctgctggctcgaggtcggcgacctgaaagaacgggaactccttcgagaacaggtcgaagcgatggcgccaacgggcgaagtaatcgtcgatggcgtcctccgaaaaccggtcagcctcccagaggcgaccccactcggcgtcatccttcgggcctcgcaagatgcggtaggcgagggcgagcacgagtcgaagcaaggccggctccagggtcgggaagtcgacgtcgaagccaacgatcgtatgggcgagcacgaatatgtctcgaagactcacctcgcttcgccgaccgtctctgaaccgtacgggcagccacggctcggaggagaggtcaaagtgcatctcaggctccaccgctcaccacctccaatccctctacgtcagtatatcgaatgcgataatacccgagcgagcattcaccgtcaagtcccaacacgagcacccgctgacgccgtagccaggggtgacgacgccaaccctccggcacggcgagactggttgcagcttccgtgaggtaactaggcagccggaccaccgagccgaggaccgcctcgacgtcatcgggcgtcggaggatgctcgagactgacctcggtcgtcccgaagcgcgcgatgttcggcgaggggccgacacacgcgatcgcaacctcgatgctcgggacgctgtcgcgcaccgccgcttggacacgaggatcatcgtcgtcttcagggtcgccaagacggatacgttcaagttccaggagataccccgccctcgtcgggtccgagatgacgaactgctccgcccgtcgttctcgttcgtgttgctccgattgccattcgacggcgacccgagcgccatgatcatgccaggctggagcgatgacgtcgtcgtccccatagacggccgccaccagggaggggacgtcatcggggagcgtcagcgagtcccgagcgagcagcagggcggccgttcgaagcaacaggtgctctccgtacactcgcaccgagcccgaaggaaacgcgggtggtccggttggcgagcgcgtgaaccctgtcacgatgacacgaggctctgtgaagccgacggggcgtcgcgtgccgcggtggcgatggaccctgccgattcgctggaggacgaggtcgaccggcgcgaggtcggtcgcgagtacgtcgaaatcgatgtcgagcgattgttcgagcacctgtgtgccaacgacaacctgccctgagaggcgtgtgccaccgcggccgaagtgctccgcgagccaggactccttcctcagtcgatcagctgtggtgaatcgagcgtgcagcaggtgtactgtgcccatgggtcgccgctcagcgacggcgcggtaggtgcgttgcgcccttgccacggtgttgcggatgacgaggatgttcgccccggcctctgccatttgggcgaccatctccagtagcggcatcgaggattcgtcctcagggtcctcgtcaaggtgctcgaggcgcaccgtaaccgatgatgcgtccgtagcaactggagtcgtggtgacgtggccgtcggtcgagacagttgtgatcgagggatagcccacgagcccgagtggtgtcgagtgtcccgcatacgcctcgatgagacgtgcgcgcacggcaggagggagcgttgcggagaggagaatcaccggaatccgctccgcgccgagccactcgaggacacggcggaggaagaccgacatgtaggcgtcgtaggcatggacctcgtcgaggatgaccacttttccggcgagaccgacgtgtcgcaaggccacgtggcggaccttggcggttccgagcaggatctgatcgatcgtgcccacgacgaagggggcgagcaggcggcgtttgggaccggtgaaccatgcttcggccgtgacgcgtgcgatgtcgccttcgtcgacatcgaccgcggacggagcgccgttctcaaggaggtcacggaacgctggcacctgctgtgcgcggccgtgggcaagttcgagcacaaaggtgccgggcccaagctgctccaaccagcgcctggtgcggtggaacatctggttgctcgtggcttgtgttggcaggccgatgaaggctccgccgtgaccttggcgagtggccaagacctcggccgcagcgagggcggcttcggtcttacccatgcccatcggcgcctcgataagaactaggcccccgtcgccttgctcgacggcctcgagcgtctggcgctgtagggcgttcggcgagaagccgaaacgatgctcgaaggcgggcgcgccgaccacggctccgaggttggcgactccgtgccatccgagttgcacgagcgcctcggcggcgcgctgctgagctgcgtggaggtaggcgtcgtcataggggaggcagaggtaggggaagagctgctcgttgctcgcgatccagtccgcgaggatgacgaaccctgcgagtgcgagtcgccgcgcactgccgagttcggttgtgcctgcgaggccgagtacctgctgcgcaccggcgacctcgacgacgaggtcgaacaggcgctcgcgcgcggcactccaggggtctccggcaccgccgagaggtcgtcccgccagaccatagagttcggggcgcttgatcggttctcgctcatagcccagaggagggaaccaaccgtggtgaccaccgaggatcgctgcaactccgcggatagcgggttcgctccagccgcgagctgcgagcagcggctgcaccgtggccgccgaggcgagtgcgtgaggtgccttcgagcgctgggggagcggcttgtccacggcgaggccggcgtcgcggagttgcgggtgcagccagtcgacctggatttggaaagcgggtgttcaggacgaacgctggcggcgtgcttaacacatgcaagtcgaacggggtaccaaggtagcaatactagaagtacctagtggcgaacgggtgagtatcacgtgagtaacctgcctcaaagtaagggataacaccgggaaaccggtgctaataccgaatactctcattcggccgcatgactgaatgaggaaagatttatcactctgggacgggctcgcggcctatcagcttgttggtgaggtaacggctcaccaaggctacgacgggtagctggtctgagaggacgatcagccacgctgggactgagacacggcccagactcctacgggaggcagcagtggggaatattgcgcaatgggggaaaccctgacgccgcgacgccgcgtgcgggatgaaggccttcgggttgtaaaccgctttcagcagggacgaaattgacggtacctgcagaagaagccccggccaactacgtgccggcagccgcggtaagacgtagggggcaagtgttgtccggatttattgggcgtaaagagctcgtaggcggctcggcaagtcggatgtgaaatctccaggctcaacctcgggttgcagtgggatacgggcatggctagagtgcggtaggggtgactggaattcctggtgtagcggtgaaatgcgcagatatcaggaggaacaccaacggcgaaggcagcgatctgggccggtactgacgctgaggagcgaaagcatggcgagcgaacaggattagataccctggtagtccacgccctaaacgttgggcactaggtgtggggcctatttcgacgggttccgggccgtagctaccgccttaagtgcagcgcttggggagtacggtcgcaaggcttaaactcaaaggaattgacgggggcccgcacaagcggcggagcatgcggcttaattcgatgcaacgcgaagaacctcacctgggtttgacatgtagggaaaagctgcccggatgcggtgtcctttcgaggccgtacacaggtggtgcatggttgtcgtcagctcgtgtcgtgagatgttgggttaagtcccgcaacgagcgcaacccttgtcctatgttgccagcgggtagtgccggggactcgtaggagactgccggggacaactcggaggaaggtggggacgacgtcaagtcatcatgccccttacatccagggctgcacgcatgctacaatggccggtacccggcgtcgccaacccgcgagggggagccaatcccaaaaaaccggtctcagttcggatcgcagtctgcaactcgactgcgtgaagtcggagtcgctagtaatcccgaatcagcacgtcggggtgaatacgttcccgggccttgtacacaccgcccgtcacaccacgaaagtcggcaacacccgaagccggtggcccaaccagcaagggagggagccgtcgaaggtggggtcggcgattggggtggccctaaatccatccgatttttcaggcgccggatgggaggtgggtcagcctggctgcgcgtggacgagccgagccgcggctacggtcaccgatgtcggcgtagttcagatcctgaggcgtggcgtcgggggcagcggcacacatcctccggcctcgggtgtgtcctcggctctgacgtgctgaggcgggagctgtcgtgatggacgatgacggacctcgacgcagcccggtcagtgccatctcgtgcggcctcgtgggcacggtgaccccgctgcatgagctgcgctgtgttgtaccagtgcaccgaggccgaggtgagctccgcgagcgtcgcgatgggtccgcgacgaaagggcgagcgaaggtggagtcgttggcctacgggctggtcgtggtctctgtggggcgtggcgtcgtcgccgtcctcggcgaacttcgaggcccctggacctgttggcaatggcaccacgtcgctgtggacggcggcgctcgacgatcctgcgtctgcatgagaggtggcgatcgcagccaagagcatcctcggcctgctggaggcccttggctgtgcacgcggcgctctcgacgaactcggtgccgctgcgaagcgagcctgtctccctggtgatggcgtgccgacgaagacgcagctgtgaacgccgtgcagccgaaccagttggtgagcccgacgtcggtggcgtcgaccacgtcgagctcgcggggcagacggctagcggtctcgtgcgcccgaagcgccactgaacgaggcagggggcgagttgcaggctcggattgcggaccgtcgcgtgtcgtctcgtgtcccgtcgcatcccgcgccagctatgggggcacggggagctgcggacgcggccggtcgcggagaggctcgttgcgcccttggtacgggtactgatcgtcgttcagggggcctgagccgatggacaggtggagcctcggacgatcgaggtgcgcgtgcggtgcgcccgagcgatcggtgcgaccccgaatgcgtgcgttgcgtggccacgtcaaggagtcgcagatcacactgatcgtctcatcttccgcacgcgtcggacgccgtcgtcatgtgtcgagatcatgcgcttgacgtcgaggttcccgggttcggagcgcgcacatcgcgggcgtgatcggtggtgaagcccggctgctcgcgagcttcgatgcagtcctggtcgtgcccctgtggcgcgtcgttcgggtggcgtcgcgccgttcggccgtgggcttcgggaatgagtagcgagcccggcatggttgttcgatggtccgtgtgagcttcgatggctcagctacgatcgtcgagaccggtgatcgcagcgagcaggctctcgactgtgaactcggacgtcggggcgtcacgtaccactcgaccgagccgcaacacgatgatccggtcgcagacctccagcacgtgggggagcgtgtgggagatgaagaggacgctgagcccacggtcgcgcgccgcgcggatgaccttgagcacctcgaggctctggcgtgctccgaggtggttcgtgggttcgtcgaggatgatgacatggcgagcccaggtgatcgtgcgcgcgatggcgaccgcctggcgctgtccgccggagagctcggcgaccgtgcggcccatgccctcgatggtgatgccgacacgctggagttcggcgagggcctcgcgctccatgcttcgctgatcgacgaagccgagcctgccgagcaacccacgccgacgtcgctcacggccgaggaagaggttcgatccgatggagagatccggtgcgagtccggagtcctggtaaagggtttcgataccggcggttcgcgcctcgcggggtgagcgccagtgtcgttgctcgccgtcgacccagatctcgcccttgtcgggttcgaggacgcccgagatcgtcttgatgagggaggacttgccggcaccgttgtcgccgacgatgccgatgacctcgctcgggtacacctggaggctgacgtcctcgagggcgaccacggatccgtaggtgagcgagaggtggcgcagttcgagcaccggttggcgcgtcgtcgtggtgctggtcatgtggtcatcctcccggtcgcgttcgaacgacgtcggagcgtctggagcagcgccgcgagggcgataattgcgccaacgacgacttgaatccatgtcggggccacgttgatgaagatgaggccgtcgctcaccacggtgaggagagccgcgccgaggatcacaccccaccacctgccgacgccgccgtagagggaggcgccgccgatcacgaccgcggcgatggcgagcagattggccgagttgctgacctcggtcgtcggggcggccgagccggatcggatgtagaaaaacatcccggtgagtccagcgaggacccccgagaggatgtagatcgaggcgacgtgacggcgggtcttgatgccggcggcaagggcagcaaactcgttcgagccgatcgcgtaggtgtagcgcccatagacggtgaagtgcaagacgacgccgagcacgatcgcgatcacgatcacgatgatgtcgagccaggtgaacaggctgatgcccgaggtgctccagacgatggcccgcggatcgtagcccaccggcgctccgttggagatcacgagtgcgaggccggcccctgcgctgtaggtgatgagggtcgccacgaacggcaccaggcggaacaccgtgatgagcaacgcgctgatggctccggcgactgccccgaggcccgcgcacaggatcgtgccgagcaccaagatgacggcgaggttgtcgccgtgggtgacgagtggctggatccatcccgccacgatcaccccggtgaccgcggcggtcgatccgacggcgaggtcgatgccaccagcgatgatgacgaacgcctcggcgatggcgatcatgacgagaccgctgaagtcggtgagcaggttcgtgaactcgccgatccggaagaagagcgtgttgcgggcaccgaagaacaagatcagtgcaatgagtaccacgacgagcacgaactgctggttggtgacgatacgccgcaaggttggcgtcgtcggtcggctcgtcacggccgctggggccgcgtcgtcatcacgcgtcaggctcacgtcaactcctcccgccagggctcatggcaaccacgagatgcgtgtgtctccccggccccgggggttgggtaccggggagacacgtgcgcgtcgagctagctctggacgtactggtacttctggaggatgctctgtggtgtcgagggcgtgagcaagatgttcgggatgagctgcaggtggggcaccggcttgtggtgcagtgcgtccacggcgtactcgatgatcagcttgccctcgagggtcggctgctgggagatgatcgccgagagcgacccctgtccgcccgcctccatcgactggatgttggtcgcgtaggcgtcgtagcccacgatcttcacgttcgcgccttcggcgccggccgccttgacagctgcgctcgcaccttctgcatccgtgccatccaccgcgaagatgccgtcgaggtggtgggcgctgatgtcctgggcgaacccagactgcgcgacgctcggctccgactcgctcacgacgtcattgagcacctggatgttcgggtagtgcgccttgatctcggccttgaagcccgcgacgcgttgggcgtcggtggtggtggtcagcgacgagacgccgaccgcaaccgtgcacgggttggacgcggtgcagttctttgcgtagtccatggcggaggccagtgcttgggccgccgtctcgccaccttggtagttgtcaccggtgacccaggaggtgatcatgctctggtccgacgatccggagtcgacgttgaggaccttgataccttccttgacggcctcttgcatgtaggtgttcaaggccttcggatcggtgggcgcgaccacgatggcgttcggatgcagcgcgaggacctgctgcaggatcgggatctgcgtcgctggcgagtagtcgaccgggtcgccctgccagacgagcttcacgccgagcgccttggcttcggcggccgcgccgacgtacatcgactggaagaacggatcggcttctgcgccgacgacgaaaccgatggtggtgccgctgctcgaggccgtcgtggacgacgacgtcgtggacgaggacgacgacgtggatccacacgcggcagccaggagcgatgcgccagcgagcaccgcgccgacgacggctggccgacgccaggtccgaagagaccgagtcatgaattcccccttctcccacgcgggacgtgctctccgttccgcggttgggtgtgagactagcgggctctgatatcgttgtcaacgaccatcgggcgcggggatctcacccgatcctcgagcgacgaggcgccacggtgcgtacgcggtctggatggggagcgatgggtcgtccatccgtgcgaacagcagggaggcggcgagcgctccgatctgctcgacctcctggctgatgacactgacgggcgggtcgaggaggtcggcgaggtcgaagtcgtcgaagccgatcagcgcgacggatcgctcgagccctgcggcgcgcagtgcgtagatgacaccgatggtgatgaggttctgacccgcgagtatggcagttggcgggtgcgggccagcgaggagttcacgggtgcgctcggcggcctcgccgacggagtgcacgtccatgaccgcgaggcgcggatcgatcactagaccgccagcgaccaggccgtcgaggtagccaagcctccggtcgacggcggtggcgatcgtggagagatcgccgagaaaggcgatgcgccgatgaccgtgggcgatgaggtgctcgacggcggctcgcgcgccagcgcgattgtcgatgaggacggcgtcggcatcgagatggcgcgggggtcgatcgacgaagatgaccgggacggacgcgcgctgaagctcggcaaggtagtggtggtcgtcggcggccggttcgacgacgatgccgtcgacgccgtggcgccacatcgctgcgacgagctggcgttctcggtcggggcgctcctcgtggctcgcggcgagcaccgagacgccgcgatcgcgcgcggccagctcgatcatgcggaggatccgcgctgggtgggggttcgagagatcgtcgaagatcgcggcgatcgtggaggagcgtcgatcgagacgacgcagcgagcgcgcggagaggttgggctcgtagcgtaactcacggatcgcggcgcgcacgcgctcggtgacctcggccgtgacgcctggctcgtcgttgacgacgcgcgacaccgtcttcagcgagacccccgcgcgatgggcgacgtccttcatcgtggctcgagccttcggggtcgggcgcgtgaactcggtcgtcacggtgctccttcgtggtccggtgcccaacgggtacgagtgctcattggtcgactcgcgctcagcataggcagctcggcctggtgcgtcgaggcacgtcccgagctcgggcctcctcaggactcctaggtccaagtcgacgtcggcaccgatcgcctcggtgggtcggcgcctcggcgggtgcaggtctcgcgagcgacctcgatgccgtcgcgcacggccgcgagcacaaactcggtgtcgtcgaccgtgcgccggccgtggtaggcgaacgtcgcggcgacggtgccggtgagcgcgtcgcccgcgccgacggtgtcgacgacgcggaccggagcgacgggaagctcgaccacgcgaccgtgtaccgagacgaggacggggcctgccccctggctcatgatgacagcggctggtcccgaggtcgcgagatgggcgagggcctcggccacggtcacgtccggctcgagccagcggaggtcgtcgtcggaggccttgacgatgtcggcatgggcgatggcctcgtggaggcgctcgcgatagcgctcggggctcgcgaccgcactcggacgtacgttgaggtcgacgatgcgcaacgatgcggcgcaggcacgaaggacctcgacgacgctcgttgcgagcgtgtcgagcgcgagggcgagaccaccggtgacgaggacgtcgccggcgtgcgcggcgtcgttcacgcgatcgtggcccaccgggtcgtccagggccgtgccctcgaggtagaagcggtagtcggcgacgccgtcgtcgagggtcgcgagcgcgagcgtcgtcggcagccgcgagcgccacgagaagccgaggtcgaccccgtcgtcgcggagaaagcgcaggaggcgctcaccgaggggatcgtcgccgacgccggtcgcgagcgtgaccggcacgccgtggcgagcgatggtgcgagcgacgttcgcgggtccaccaccgggcgtgaacgatggcgagcccgaccctggaaggaggcagtcgaagagtgcctcgccgatgacgacagcctgagacgtgctcggggagcctagctgcgagctggctcgatcacgacgtggaaggcaagctcggggcagaggtgctcggcgtggcgggcggcatcgaggtcctcggtgacgatcggatcggtgacgagagggaagtgccagggatcgagctcgagatggcgcgcgaggagggccacgcaggtgccatggcctcggcatcgggtcgggtcgatcacgatccgagcgcggctagccacggctcggctcccggctctcgagcgcgaaggggcgctcgtggcagcgccggcgctggtggccggccgcatcggccggggtgatggccgtcgcgaggtgtgctgcggcgtcgggtagcgcgcaagcgcctcggcgggcgatcagcctcgccacggtcgcaagttcggcgggacgagccccggcaccgagtgcacgggcaagttcggggagcccacggtcacagggtccgcactggccggctcgctcctcgctgaggtagccgacgagctcgctggtcgcacagacgacgcaggtcgccgatggggcgagcagcacggagcccgcgccgagcgccagctcgtccgatgagtcggcacggtcgacgaggacacgtgccatcgcccgctcgtcggcgaccgagatgagctcgccgaagagaccgccgacgagggcgagacccgtggtgacgccgaccgcgtcgaggaggctccgaacggtcgcccctggggcgagttcgaccaccgtgggcgtcgagcccgggagcgcgatcgagacgatgcgcgtcgagcggtcgtggcctcgggttccggcgctctggtgccaggaggtgccaaagcgcgcggcgagggcccactgcgcgagcgtctcgacgttggcgacgagggtcggcctgctcttgtagccgcgctctgcgacgcgtgcgagctggaaccgcgggagtgcgggacgcccctcgagcgcggcgagcagcgccgtctcttgaccggtgagatacgagcggtcgaggagtgcgacgcggaccgcgtcgctgcgttcacgaatggctcgctcgaggacgtcggctgcggtcgcgtcctcgacggccacgatggcttctcgggcctcgaggagtcgtgtcgcgagcccgaggccatcgagcacgaggtgcggcgcatgggtgagcagcgccttgtccttgcgcgcgccgggctcgctctcggcgccgttggcgaccacgacacgtggcccacgctgggacgcgaccgcagcaagcttgcgcgccagggggaagcccgcgccgcccctgccgacgatgtgctcggcggtggcgagtggtggtcgtgggggcagggagccgtagatggcgcggtgcgcgtcgagcgagagaggcggcgcatcgagctcagcgatcgcgaggtcgtcgctcacgagtcggctccagccggcgctgaggcgtgcgacggacctgggcggcggcgtcatgcgtcgctgccttcggagccatcggcctcgggagcgccgatcgagggtgcagcgttcagggcttccgatggcgcggtggagaaggagacctggcccgtcgcaccgttcgcgtcgatggcgagcgccgcggtgccttccaccgtggcatgggggcaggcgagcgagaaggagatcgtcgagcccccgagcgcggtgacgctcccgtggcacaggtttggcgcgctgggggtccccaaggtcaccgtgccacccgagacggcaaagacgccctcgctcggctgtccggtgagcacgaccgtgagccgttcgttcgtgccgccgatggcgcccgcgatcgtgaggtccgtggcgctcgtggcctgggtctgcgtcacggtggcggtgatgggcccgccgaggggctcggacgagcgtgtcacggcggcggtggtcgccgtcgtcggggcggtgccgtcgatgcgcgcagaccagccagggcgaagcggtccgctccgtgcccacagcgccacgaccccgggcacgccgaggacccccaccatgccgagggtacgggcagtatgtgcgagatcggggtcgcgacggatgcgcaagaccgcgaggacgatgacgcctgcggtgatggcaccgtagacggcgaggaccgcggcgagccgcgtgtcggaaccggtcccgagcccgtggacgatggcgagcgcgagcacgagccacacgagcatgtgcgtccgcttccagagcgcaaagccaaggtgctggcgtgcgagcgaggaggcgatcacgatcagcaggccatcgaaggcgagcgtgccgaacccgacgaaggcgcgtcgatagtgggagaggaacgggatgacggctgccgtccagccgatcggcacgaagctgtcggcaagtgccgtcagaatgtggatcgcgagcacgaccaccaaggtgagcgagagccgtcgatggaggtccgggccgaggaagcgggcgacgccggaagggaggattttgcccgccaccgcgatgccgagcagggcgaccgcaccgagcatgacgagcgcggcgagaccgctcacgcgggtcaggtaccacagcagcggggatgtcgtcgcgatcagcacgcggccgcttcctcgagacgtggtggccagccgccaagggggaggcgttcgccggcattcgtcacgacgagcgccgacagctcgtagcggcgccacatgcggtgccaggcgcgtccagcggcgatgatcgcgaggctggctgcattggccgccgcggcgctctcggcgacgacggtggcgcggcgggcagcgccagggagcgtggaggcaccgacgatgtgatcgagaccccgtggcgatcggcgcgtcgcgcggtcactcgtcgcgaccgcgccagcggggatgtggatccgctggccgggcgcgtcgggccgcaaagatccatcgtcggtgacgaggatcgaccagggggcttctccgacgcagcggaggtcgccaccgaggttgacgaggatggcaccggcggcgtcggctgcgagttcgagggcgatcgcatcggcgatggccgccttggcgaggccgccgaggtcgatcagcgttccgggtgggcgtcgaaccatgtcatcgtcccgttcgacgtcgtcccaggtcgcgctggagcgacggccgaggcgcgccaccgggtggtctggttcgagcgcgctcggatcggcggcgcgcaccggatcgatgacgccgccacttgcgcggaccgcctcgtcggtgacctggaggaggtgtgcgagacgtgccgacacccgcacctccggtgtcggatcggcgttcagctgcgagagctcgctgtggggatcgtggaagctcgcgacggcgccccactcgtccaggagcgcacgaaacctgtcgacgagggcgcgatcagcggggtccgtgccgaccagttcgcagcgtgtggtgtaggcaggcagcacgctcgaccacacgttaggagcctccggtcggggtcggggttgcggcagagggagcttggctcaccgtgggagcggacgatcccgacgacgtcgacggtgaggagctgcccgacgagcccgacgacacgaagggtgccgtcgagttcgacgtcgaagaggtgtgggaatgggtcgtggccttggtggtgtggccggggaacgatcggatcgcttcgaagccgagtgcaccggccgcgaggacgagcgctgcgacgaccgtgcggtggatgcgcttcgcttgggccatgaggtccgtcacgggtcctccttgggtcgggggagcggggacgacgccctcaagtcaaacggcgcgatctggcgtggaccttgagtcaggctcgaaagcccctgagaagggtggtcctgcgaagggcgttcaggactggtgggtctccaaggagaaggcgtcctcgaccgcctcgcgcagatggacgccggcgaggccaggagcgtcgtcgagcgttcgatcaccggcctcctcggcaaccctcgcgagagccgcgggatcggccggttggccgatcagggcatcggcgatctcgcgcggtgcctccatgggccagacggtgaagtccccctcgacggtggcgtcgatcacgtggccctcggcgacgacgaggaggatccgcacgagcccgctcggtgccttggtgcggccgacgaggacgtcggcaccttcgcgaatgtgcaccccgaggacgcgccgccccccgccatcgttgacccaggcgggatcgacgagtcgttcgcgcaccgcggcgacgtggcggcgctcgtcctcgctcaaggtgccgagttcgagtgggcgtccgagtgcctcggcgaggatcgggaggtagcgctcgacgatggcgtcctccgacggtgccgatccgagctcgcgctccatggaggtgacgtaggtgcgcatcgtggcggcgagcttgtcgcggagcttcacggagtcgacgcgcagcacggcggcgagggcgtcggtgtcgatcgtgcggatgaacgaacccacgagcacctcggcgcccgcgatgcgagccgcaccggtgccgccgatcttgcggtcggcgacgtggatgtcgttgaccgggcgatggcgcgcgtcgatcccgaaggcacgcagcgtcgtcacgagtggcgcaatgtaggccgcgtagcgtgcctccagcgagagcggtacgtggtctgggtgcatgatccactggacgaacagctgaccagcgtcgaggtacacggcgcccccgccgaccatgcgccgcgtgatcggtaggccgcgcgccgcggccgcttcgacgtcgagttctcgttcgaccgcctggtggtagccgacgcacacgtaggggtctcgcggtgacaccaggcagatggtgtcggggtcgtcgggaccgagcctctcggcgagggcgtggtagatcgcctgggagtcgatggcctcgaggccggtggcgacgatgatgcgaacgggtcgtgtcatggtcgtagctccgtcatcacgatgacgtcgtggccggcgtcgatctgtcgattggcttggtgggagatgcgcacgagtacggcgacgaggagatagttcgcgagcagcgacgaccctccgtaggcgacgaaggggagcgtgacgccggtcaggggcaggagtcgcacgatccctgccatgatgaagaaggtctggagtccgaggatgaccgacagggcgaaggccagcagcgacgagaactccgttcgcgcacgcagggcggtgcgcacgccggcgccgacgaggagcacgaaggcgatcacgagggcactcgtgccgagcagacccatctcctcgccgaaggcggcgaagatgaagtcgctggtgacgaccgggatgagctgcgggtggccgagcccgagcccggtgccggcgagtccaccgatgccgaaggcgtactgtgcctggacgagctggtagccgatggtctgggcgtagcgccatggatcgagccagaccacgacgcgctcgtgcacctgggtgaagagggctccggccaggaccgccccgatggcgaaggccgcgaggccgaggaccaggtagctccggttcgccgtgcccacccagaggacgatgacgaaggtggagaagatcaacagcgcgaagccgacgtcgcgctcggccgccatgacgacgagtgcgagcgcgaacgcgagtgcgatggggccgaggcggcggatgccgccaccacgaagccggctgagcatgtcgcggcgctcgacgatccaggacgcgaggaacagagcgagcaggagcttggcgatctcgacgggttggaagctgaaggggccgacgtggatccagagccgcgcaccgttgatgtcgagcccgagcccgggtagcagcggcaggaacagcagggcgatcccgccgatcgcgaggaggtagcggtagcgatcgagcgcgtccgcgttacgcacgacggcgagggtcacgacgtaggcgatgacgctgagagccgtccagagggcctggagggtgccctcgtgggggtcgagtcggttgatcatgacgaacccgagcccattgagcagtcccacgaggggcaccatcgtgggatcggcggccggtgcgagcagccggttcgcgatggcgaggacgaacggcgcgaccatcacgctgacgagtgcgaggttggggtccaggtgtgccttcgggttctcgccccaggtcgcgagcgcccacgcgaagacggtgatgacgtcggcggcgagcaccagttcgagttctcggcgtcgccggtcacgagcccatggtgatcgctcgcgacgggcggcgagcatggtgcgcatcggtccttgtccccctggctggtgcgagcggattctagcgggcatgacgctggcgcaggtggtggcggaccgggcgtcgacgcactacggcgagaggctaggttggcggccaaggaggtgctggtggctgaggcgcaacgcatgctggccgagggctccctgcgcagttcgtctgagcgcttcgtgaatcgggagttgtcctgggtggacttcgcctcccggatcctcgaactcgccgccgatgcgcgcgaaccggcgctcgagcgcgccaagttcctcgccgtgctcgcacaaggcatggacgagttcttccaggtgcgcgtggccggcctcaaggatcagctcctcgcacagcatccgattcgctccccggacggactcgatgccagggcgcagctgcgcgcgattcgcacgcggctcgagccggtctgggagcgccagagcgaggtctggcacgacgggatccgaccggcactcgctgcgctcgggatcgagatcgtcgccgtcgaggacctctctccgacgctccatcgtcgcctccacgagcgcttcttggaagagctgttcccgatcctcacgcccttgtccgtcgatcccgcgcatccctttccctacatctccaacctgtcgctcaacctcgcggttcgcgtccgtgacagccaaggcggtgagctccggttcgctcgtgtgaaggtgcccacgaatgtgccgcgcctcttcccgctcggggacctgcgctactgcttggtcgaggacgtcatcgcgagcttcatcgcccgcctgttcccgggcatgatcatcgaggaagtcggcacgttccgcgtcacgcgcaacaccgacctcgtcctcgaggagggcgaggcggacgacctgctcgagctggtcgagaccgaactgcgacgccggcgcttcggtcgtgcggtgcggctcgaggtgtcgtcgcgcatgagtcgtgagctcgtcgacgtgctcgtcgacgagctcgagctccatccggatgacgtctgggcgacggacatgccgatcgacggttcgttcgcatgggagatcgtcgcactgcccatcgacgaggggcgaggcatcgccgccgcgggtgtgacgccgtcgatcttcaccgtgggcgacgacggcgctggcgcgctgttcggccgcctggcggccggcgaggtgctggtgcaccatccctacgagagcttcgcctcgacggtggaggcgttcgtgcgtgcagcggcggccgatccggacgtcctcgcgatcaagcagacgctctatcgcacctcgggtgactcggcgatcgtcgaggccctcgtcgaggccgccgaggctggcaagcaggtcgtggtcatcatcgaggtcaaggcccgcttcgacgagctcgccaacatcgcctgggcgcgtcatctcgaagaagccggcgtccacgtggtctacggcgtcgttggtctgaagacccacctcaaggccgcgatggtggtccgccgtgagggcgcccgcctcgtgcgttactgtcacgtcggcacgggcaactacaacgcccggacggcacggacctacgaggacctcggcctcttcagcgccgacacggtcctcggcgacgacctggccgaggtgttcaactacctcaccggattctcgcacccgaatcggttgcggcgcgtcgtgctcgctccccagcagctgcgcgggtggttgctcgagcgcatcgcccgagagcgcgatcgcggaccgagcggacgcattcgcttcaaggtgaactcgctcgtcgatcccgagatcatcgatgcgctctacgacgcgtcggcggccggcactcccgtcgagggtgtggtccggggcctgtgctcggctcgcgtgggggtcgaggggctctcggagcaccttcggatccgatcgatcgtggggagcttcctcgagcattcacggatctacgtcttcggccaaggacccgacgccgatgtggcgatcgcctcggccgatctcatgcagcgcaatctcgatcggcgcgtcgagctgttgatcccgctcgaggcgccggcgactcgagcgcgcgtggagcacatcctcgatctcgccttcgcggacgacacctacgcatgggagctcaccgccgatggccgctggcatcgtcaacgcggtggcgagggcatctcgctccagcggcggctcaacgacgaggcgggggctcgggggtgagcgaaggcgcgatcgggaccgagcgggaactgaagttccgcccgcgcgacgtcgacgaggcacgagtcctcgtcgccaggttccgtgaccggctcggtctgcctgcggcccccgcggtgacgaccacgctcgagtcgcgctacctcgacacggccgatcaccagctcgcgcgctgcggccttggcgtgcgagcccgctgggcgctcgaggctttggatcccgaggccgcacgctggacggccaagctcgcactcgaagaggacgacggcacctacgtgtcggtcgagttcgaggtcgacggcgagcgcgagcgcctcccggccgagatcgctggtcggcttcggagcgtcgtcggatcggcgcggttggtggagctcgcgcggattcgcaaccaccgtaccagctggcgcgatgcgaccggtggtgtcgagatcgagctcgacgtggtggacgtgctcgctccgcgaactgggcacttcgtcgaggtcgaggtcgaggtcgccgacgacgagcagctgcgcgcgctgcggcgctgggtcggggcggtcccggtgtcgacgacccacaagctcggcgcggccctcgggcaggtcgtgagcgtcgatccggagtgcgtcgcgcgggtgcgtgccctcctcgaggcgccgagcgaccccggctggtgcgaggagcctgctccatgggcacgctgagtgcggcggcgatcgatctcggctccaactcgttccatctcgtcgtggcgcgggtgcgtccggagcgcctcctcgagcccgtctacgaggacaaggtcatgctgcgcctcggggaggtggtcgcacgcctcggtcgcttcgacgacgaggccgaagcacgtgcccacgaggcgttcgagcgcttcgtctcgctcgcacgcgcgttcggcgcgacggtcatcgtcgccgcggcgaccgcgagcttccgtgatgcccagaacgggcgtgacgtcgccgacgcgctcgaggcgcgaaccggggtgcacgttcgtatcctcaccggtcacgaagaggccagcacgatcttctcggcggtgcgctcggccggcagcatcggccaggtccccgtcgtcgtggccgacctcggcggaggcagcttggagctcgcgctcgggacccaacgatccctcctgcgcgcgcgcagcctcccactgggtgtgggcaagctgtcggtgcgctaccgctgtagcgacccgccacggcacgacgaactggctcggatccgggcccacgtcgaggcggtcgccggtgccgagctccgcgagatggcctcgttcgagccgcgccggctggtcctggcgagcgggacgttcgccgcgatcgcgaaggtcgcgcgtcgactcggtcgcgtcgatcagctcgccgacgggcaggtgttgcgggtcgtggacgtcgcctccctcaccggtgcgctcgatgcgatcgtgcgtgccgatcgagaggcccgcatcgaccgtctcgggatcgatcggcggcgcagcgataccgtcgtgccgggcgtcctgatcgttcgcgccctcctcgatgagctcggggtcgacgaggtgtggaccagtcggtgggcgcttcgggagggcctgttgatccaggccgtggaggagggcgacgccatgggcttcgccttcgacgctgccgagctccgcgctggctcgctccgacacctcatgcggaagtaccagatcgaggaggatcacgcccgcgctgtggagcggcacgcactcgcgctcttcgacggactgggcggtgccctcgagctcgtgcccgaggatcgtgacttgctcgcggtggcggcgctgctgcacgacgtcggtgcgttcgtctcgggccggaaccacgaccgtcacggtgcgtatctgctcgcggccgacccaccacgcgggctgtcggtgcgcgagcggctggtggtcgagggcgtcgtcggctcgcaccgtcgcggcgcgcctcgttcccccgacgccctctcgacggccgatcgcgaccgtgtggctgcgctcgccgcactcctgcgcgtcgccgatgggctcgatgcctcccacacccaagtggtcgaaggggtcgaggtccagctcgaggcggacgagatccgtctcgtggtgcacgccgacgaggcgctcggtgccgagcgcgttgctctcgagacgaagaccgagctgctcagctccctcctggggcgcagagtcgaactcgacgtggtgccggtggcgcgagatggggcggcacgagcgcggtccgtgctcgactgagcgctcgcactccgcggtcgcgctcacggatcggggagcaggacaccagggttcacgatgccgtagggatcccagatccccttcagcgatcggagcgccgcctcgtcgatggggtcgaggaggagccgggcccagcgacgtttggtgcggccgatcccgtgttcggacgcgatgacgccgccgagggccgccacacgtgtgagcaccgtctcgtagagcggaccgggatcggccccgtgtgcgatcgcgaggttgacgtggcacgtcccctcggcgagatggccgaagaggacggtggcgcgcacctcgtcgcgctcggccaccaggtcgaggtgggccgcgagctccccgagtgccccgagtgggacggcgacgtccagcttgaccggggtgccgaagcgctcggcgagcagcgggagcatctcgcgcaggtgccagagccgtgccctctgggaggggtcggtcgccacgtgggcgtcgaggtgggccggtgcgagcaggaggggccgatcgtcgtcgggatagggactcgtgagctggaggatgaggaggaggggatgcgggtcgggcggggtgaggccggcgcttcggacgtcggccgtacgcacgaactcggctgcctcgagccacggcgcaacgagtggccggagcgtctcgaagaggctgacgaggtcgacgaagtcgtcagcgccgatggcgatggcgatgcgggtgcgtgggcgcgggtggacccggagcgcgacggccgtgatgacgccgtagatgccctcgctcccggcgacgaagcggcaggtgtcgagcccggcggccttcggaggccgaccgatgcgacggtgggttcgcccgagcccgtcgacgaggtcgacgtggacgagctggttggccgtcgagccgtagcggacgacccgttgaccgcccgcgttggtcgcgacgagaccgccgagggtggcgttggcgcgcgatccgaggtcgataccgacctcgagtcctgcagcctcgagctcggcgtcgagatcggcgagcgtcacgccggcttcggcgacgacggtcatcgtggccggctccagtcgaacgatgcgtcggagtcgttcggtgctgacggcgatggcgccggggtggggtaccgcaccggccacgagcgaggtcctgccaccttggatggtgatcgcgacacgagcgctcccagccgcctcgaggaggcgcgcgaccgcgggagcgtcggcggggcgtgcgagcgctgcggcatcccctcgcgtcgtggcggtccagtcgaggttgatcggctcgagggccgcggggtcgtcggtccagtcgacgttcgcctcgtcgaggacgcgagccgcatcggacgctgctgccatggggccatggtaggtgtgggcatgctgctcgcgccatcgcccgagggctcttcgagggatcgggttaggctgcctagcggtacgtcggagcgtgcctgtgtccggatcgtggccaggctgctcgagcgagtcgcccgacgacgagcgcgtgtggcgcatggtcgggcggcgcgcgtcgtggcgatgcgacagaagggagcgctcggtggagacggtggatccgagatcgcttcgggtgtggcgtgagctcgaggccgaggccgcggagctgcgcgacgtgcctcttggcacgttggtggccgagggaagcgatcgcgagcgtcggctcgtcctcgatgccgggctgctccggatcgatgcgacgcgacagctcgtacgcgctcgcacgttggagctgctcggtgagctcgcgcgcgagacgaaggtggtcgagctgcgtgaggcgatgttcggcggtggccacatcaacaccaccgaggatcgagccgtggggcacgtatggctgcgcgcgccgcggggaggggcacccgtcgtcgacgggatcgacgtctcttccgcggtccacgacgtcctcgagcgcatggcggaggccgccgttcgtctgcgcgacggcagctggacgggtgtgaccggcgaacggatcgagcgcgtcgtgtcgatcgggatcggcggctccgatctcggccctcgcatggcggccctcgccctggaggccttcggccacggcgggcccgaggtccggttcgtctcgaacgtcgatcccgtcgacctcgagcgagcgctcgtcggcgccgagcccgcccggacgctgttcgtcgtggtctcgaagacgttccggaccctcgagacgctccagaacgccacggcggcgctcgcgtggctgcgctccgagctgggagagggccctgaggtggtggcgcgccacgtggtcgcggtctcgtcgaacgtcgaggccgcgacggcgttcggtgtcgaccccgccaacgtcttcggcttctgggacttcgtcggtgggcgctactcggtgtggtcggcggtgggttttgcgctgatggtcgccgtcggaccggagggcttcctcagtctgctcgccggggcccacgccatggacgagcactttcggaccgagccgatggatgtgaacgcccccgtcctgcacggcttgttgatgctgtggtatcgcacctttctcggcgcccagacctacgcggtgctgccgtacgcggagcgtctcgcgctcttgccgtcgtacctgcagcagctgaccatggagtcgaacggcaagtccgtccgacgcgacggcgagcgcgtggactacgacacgggcgccatcgtctggggagagccggggacgaagggccagcacgccttctatcagctgctgcaccaggggacgaccctcgtgcctgcggacatcatcgtggtcgccgaggcacaagccggtcccgagcgccaccacgacctgctggtggcgaacgccttcgcgcaggcccaggcactcgccttcggccgggacgaggcgtcgttgcgggcggcaggggtgcccgagcgcctcgtgccgcacaaacggatgcccggttcacgcccctcgagcgtggtgatgatgccccgactcgcgccggagacgctcggcgcgctgatcgcactctacgagcactcggtgttcgtccagggggctgtgtgggggatcgactcgttcgaccagtggggcgtcgagctcggcaaggagctcgccgaccagctcgcgcccttcacgacgggcgagcgcgacgtcgagggtgccgacctcgacccgacgacggcgcggctcatcgagtggtaccgttcgtggcggcaagggccgccgaagagagaggagatgccatgaagagggctcgcttgctggcggaacacggccagagcgtctggctggatgcgatctcgaggcgactgctcgccaagggcacgctcgcgcactacatcgacgagctcgcggtgaccggcttgacgtcgaacccgtcgatcctgtcgcacgccatcgccggttcgaccgactacgacgagcgcattgccgatgcggtcgctcgcggtgtccacgatccagaggccgtcgtctacgaactcgcccactgggacctcgccgaggctgccgggctgttcgcgccggtgtacgagcgcaccgacggcgtcgacggctacgtgtcgatcgaggtgcctccccagtacgcgcacgacacccaggcgacgctgtcgtgggcgcgtgagctgcggtcgcgcttcgcggagccgaacgtgctcgtcaaggtacccggtaccccagagggcctccccgcgatcagcgagttgatcgcctcggggatcggcgtgaacgtcaccttgctgttctccgtcgagcactacaccgcagccgcggaggcctacctcgagggcatcgagcggcgttcgagcgccgggttgtccctcgtggtgccctcggtcgcgagcgtcttcgtctcccgctgggactcggccgtcgatccgctcgtgccccgtgagctccagggccgtacgggccttgcgatcatgcgtcggatctacgcggcctaccaggcgctcctcgcgtcggagcgcttcagcaggctcgccggccagggtgcgagagcccagcggctcctctgggcctcgacctcgacgaagaaccccgagctccccgatacctactacctcgggcgactggtggcgccagggacgatcgacaccgtcccggaggggaccctgctggccttcgacgaccacggcgagatcgagcccgtgctcgacgacgacctcgcgggggccgatgcactgctcgaggaggtcgcctcggcgggagtcgatctcgcgggccttggcgacgtcttgcaggagcaaggtgcccacgccttcagcgccgactggacgacgctgctcgacaccgtggcacggcgggtgaaggggtgagcccgcgcggcgtcgtcgtccgcgaggatgggggcacggtcgcagctcgcgtcgaggagctcgacgagagcctgctcggccacgatccagtgcggatccgcgtgcactactcgaccctcaactacaaagacggcatggtcctcggagggctcgggaggctggttcggcgctacccccatgtcgccggtgtcgaccttgccggtgaggtgatcgaagaccggacggggacgttcgctccggggacccgcgtcgtggtcacggggttccacgtcggcgagcgccatccgggcggtcttgcccaagaggccagggtgcgtccggagtgggtcgttccgttgcccgagggcctcgatgcgcgaagggcgatggcgatcgggacggctggcctgagcgccatgctcgcgatcatggccgtcgagcagcgggggcgttccgatcggaccttccccctgctcgtgactggagccgcgggtggggtgggctccatcgcggtcgctgtcgccgctcgacgagggtggggggtggctgcgtcgaccggtcggaccgacgaggcgccctacctgcgctcgctgggtgcgagcagcatcatcgccagagccgagctcgcgagggacgacgtgcgcccgctcgagtcggagcgcttcggcggggccatcgatgcggtcgggggctcgacgctcgcgaccgcgcttgcccagatggcccacggcgcggccgtcgcatccgtgggtcttgccggcggcgaccgcttttgcgcctcggtgatgcccttcttgctccgcggcgtgagtatcgtcgggatcgactcgacgctcgcaccgctcgaggatcggcgagcggcatgggcagcgctcgcgagcgacctcgaccccgcactgctggcggaggtgacccgggaggtggggctcgaggacgtgcccgccctcggacctgagatcctcgccgggcacgttcgcgggcggatcgtcgtcgacgtgaaccgctgagacgtgcccacggtcatcgtcgtgtgtggcccgaccggctcgggcaagtcgacgttgcgtgctcggctcgtcgagcgaggtgcggtgggcatcgacgccgacgaggtggcgcgagcggtcgtcgagccaggttccgaggtgctcgcctcgttggtggcggctttcggcgatgacatctgcgacaacgaggggcggctccggcgtgacgtgctggccgcgcgcgcctttggctcggccgagacgacggcgctcctcggtcggctcacccatcctgcgatccgtgccgagatcgaggcccagttggcgtcagccggcgatggggacgtcgtcgtcgtcgaggtcccgctgtggcggcgggcggacgactggatctgccccgatctcgtcgtgtgggtcggggcgagcgccgagcgcgcgggcgctcgcgtcgcggaggaggggcgcatgagcgaggcggagctacgccagcgtcgtgctcgcttcgacttcgaggcccagcggcacgaggcggacctcgtcatcgacaacgacggtggtccagaggccctcgccaaggctgccgatcgtgtgtggtcgctcgcgctcgctgccgacggtaaaggtcatcgccgcgcgtgacgatgggttcgcgaggaggtgaccatggctgaggtgatcaccgcggagcagctgacggcccggatcgcggagttcgaaccatcgaggagcgtcgccgaacgcgtgctcgcggtcatcgatcgcgacgacatcggtgctgccgagctcgcgactgtcgtcggcacggatccggcgctcgtcgagcgggtcatgcgaacggcgaactcggtggtcttctcgagtcaggccaacgtgcgcaccttgcagcacgcggtggcggtgatcgggttcgagaccgtccgttcgctcgcgctggcctcgttcgtcgagggcgtcatgagcgtctcccggcaggactggcaacgatcggtgatgtcggcggtgggtgcggcggccgtcgcgcgggggatcgggctcgatccgcagctcgccttctcgaccggactcctccacgacatcggccacgcgctcctcgagagtctggacccgagctacgccgccgtcgtcggggcgttccgtgccgagccgctcacggcctcgtccgaggccgccctcgtgcgagccgaacgtggtcgctacgggatccaccatgcgctcatcgcgggcgacgtcctcgcctactggaacttcgccccggacatcgtcgaggccgtgagccaccaccacacgccgaagggttctctgtcgcgactccacggcgccatcgtcgacggctaccgtctcacccactggctcgcctcggggctcgatctcgaggagtacagccgcgccgacgacgtgctgctgccgacctacctgcgacccgagaacctccacgtcgtggccgccgatgtccggtcgcgggccgagacgctcctcgaggatctgttcgggatcccggcgtcgcacgcgagcgcacggtagactcccggtgtagtgccggagcgcttcgaggtccacgcgccgtatcgcccgagtggcgatcagccgagggcgatcgacgagctcgtcacctcgatcgagtcgggcaaccggttcacgacgctgctcgggatcacgggctccggcaagagcgccaccatcgcctggacgatcgagcgactgcagcgccccacgctcgtcatcgcgccgaacaagtcactcgcggcccagctcgccaatgagtttcgcggcttcatgccccgcaatcgggtcgagtacttcgtgtcgtactacgactactaccaacccgaggcctacataccctcctccgatacctacatcgagaaggactcgtccatcaacgacgagatcgaccgactgcggcactcggcgacgtcggccctgctcacgaggcgagacgtggtggtcgtggcctccgtctcgtgcatctacggcctcgggagcccgagcgcctacgaaggtcagatcctccccatcgaggtcgggatggatcagccgatggggctcgtggtgcgaaggctcgtggccatgcagtaccagcgcaacgacctcgagctcgcccgtggccgtttccgcgtgcgaggcgacgtgctcgaggtccacccggcctacgaggagcgcatcgtgcgcgtcgagttcttcggcgacgaggtcgagcggatcgtgagcgtggatcagacgacgggggaggtgctgcgcgagctggaggacatcgttctgttcccggcgacgcactacctcgcgagcccggaggtggtcgagcgtgcgcttcggtccatcagcgacgagctcggggagcggctccgtgagctcgagagcgcgggcaagctgctcgaggcgcagcggctccgcatgcgcaccgaactcgacctcgagatgctccaagaagtcggctactgcaatgggatcgagaactactcccgccacctcgatggtcgcgagcccggacaggcgccctacacgctgctcgactacttccccaaggacttcctcgtcgtcatcgacgagagccacgtcggcctcccccagctccgcgcgcagtacgcaggcgatcgctctcgcaaggagaccctcgtcgagcacgggttccgcctgccgagcgcactcgacaaccgtccgcttcgcttcgacgagttcctcgaacgggtccctcaagccatcttcatgtcagcgacccctggtccgttcgagcgtgagcacgctgggcgcacggtggagctgatcgtgcgtccgacgggcctcctcgatcccaaagtcgaggtccgccccacgaagggccagatcgacgacctgctcgcggagatccgcgctcgggtcgagcgcgaccagcgggtgctcgtcaccacgctcaccaagcgcatggccgaggacctcaccgagtacttcgagggcctcggcgtcagggtgcgctacctccactcgacgatcgagaccttggagcgcatcgagatcgtgcgcgatctgcgcctcggggtcttcgacgtcctcgtcgggatcaacctgctgcgcgagggcctcgatctgccagaagtggggctcgtggcgatcatggacgccgacaaggagggcttcttgcgctccgagacctcgctcatccagaccatcggccgagccgcacgcaacgtcgagggcacggtgatcctctatgcggatgccgtcacgccctcgatggcccgagcgatctcggagaccgaacgccgccggagcatccaggccgactacaacgcacgccacgggatcacgccgcgctccgtgagcgcgaggatcgacgacctcgtcaccgagcgcacgcgcagcgcgccgacgccgacgctcgggcgtcgagcgatcgaagagcggaccgctggcatgaacccggagcaggtgcgcgacgtcatcgactcgctccgcgaagagatggagcgcgccgccaccgagctgcgcttcgaggaggcggccaagctgcgtgacgacatccgggcgctcgaggcactcctcggttcggacgcgatctcctagcgagcttattgccgctatcacaccccctatggtataatcggagataccgctgggggtatagcggttggtacctaggaggacacaggatgctcgatctcatcatcgtcccgacgctcgagctcggcgaccggtcgtacatcgtgcacgacgggcgtcgcgcgatcgtgatcgatccgcagcgcgacatcgaccgtatgctcgccatcctcgcggagcgcggcctcgaggcggtcgcggtcggcgacacccacatgcacaacgactacgtcaccggcggctatgcgctcgcgaaggagctcgacgtcgactacctcgtgttcgagggcgagcaggtgcacttcgagcgccgagcggtcgccgaccgcgaggtgctgcgcctcggcgacatggaggtcaccgtgctgcacacgcctggccatacgccgacgcacatctcgttcgtggtgcgcgatccggccgacgatcggccaccggtgctgctctcgggtgggtcgttgctctatggatccgtaggacgcacggacctcatcagcccggaggcgacctacggcctcgcgaaggaccagtggcactcggcccagcgcttcgcgaccgagctccccgggccgacgatcttgatgccgacgcacggcttcggctcgttctgctcgtcggtgtcggtcgaggaggccggcgactcgacgctcgatggcgagaagcgcgtcaacatcgtctacaagtacgactccgcggagtcgttcgcggacatgttggtggcgacctacgatccgttcccggcctactaccgccacatggggcctgcgaacgtctcgggtcccgcgccgctgcgcatcgacagcctcccgaagctcgacgttgcccaggtgaccgagctgcgcgatcatcacgaggccgcggtcgtggacatccggccccggaagcagagcctcgagggtcgtccggccggcacgctcgcgttcgagtactcgaacgtgttctcgacctatctcgggtggctccaccactacggtcgcccgatcgtcttggtctcgtccgacgaggcgaccgcacgtgaggcggcgctcagcctcggtcgtatcgggatcgacgaggtgcgtggctggatcgagcccgaaccgctgatggatgcctggggcgtcgagcgtctcgagcgcatcagctggcaggagtacgtgcagcagtatcgggggagcgatcacacgctcctcgacctgcgcaatccgtccgaggctcgggccctgccgatcccgggcgccatccagatcccgatctacttcttgccgaaccagatcgacgaggtggcgacggatcggaccgtggtggtgcactgcgccggagggtatcgcgccgcagcgggtgcggcgtggctgtcggcgaacaagcacattcgccctgtcgtcatcgacgacggggccgacgtcggcgcgcagctgctcgcggcgcagtcgtagtccgtcgcggcccgacgacgagacgttaggctcgtccccgccatggtgggtggggacgagcagcgtcgcggcggcgacacgccgctcgtcgtggtcgtcggcggtgcgcgctcagaggttccgatcgataggggcgcggtcgcagcgatcgtgcgcctcgttggtgtcggcgacctccacgaggcggcagcgatcgccgatgagcccagcagcgaacgggctctcgtgggtcgtcgtggcgtccttgcaggactctcgctgaccagcgatgagcccgccatcgcaggcgccctgatcgaaggggtcgccttcgaggcggcgcggatcgtcgatgggctcgacgaggcggtcgcgggctctcctgaggcccgcatccttctggagggtctctacgccgtctcggcggtggcgcaggtggtggcggacgtcctgggacgtgcggtcctcgacggcgccgggcagagggcgatgcccggaccacgcgcgagaagccggcgttccaggtggcgccggtggctcgaggatcaagggagcttgacgtaagcccagccgtcgccctggcgcgccacgaggtgagcgatggcggcaggcacatggccgacatcgctggcgaggtcgctgctcgtcgcgccgagtgcctggaggctgttgtcacaggcgaggacgcggcgccattcgagggcagggctcaggagtggctcgagcggtgagggcgccagcaggcggcgaacggccgcaccttggcagacgacctcgatcgtgaggtccggagcggcccgatggaggttcgcggccgacccgagtgctgctcgcagtgcgtccaggtcgtcggtcgtgacgtggatgagggcacctcgtgcgatcatcggatctgctcggcgtgcaggtccgaacggctccgtccgaagagggcgaggtgcatgaaggcgaacttggcgaaccacagcacgacgaaggaagcgaagtaggttccctggaccacgatgtcctggtcgagtcgggatgcaccgagcgcgagggcatgggcgtgcgccacgtcgactgcccaggtcgagacgatcaggctggtgagtgacatcgcgacgtagggcaggacctcacgggcgagcgacgagcgatcacgacggcgccaggcccaggagcgattgagccagtaggacggtgggatgccgacgagcgtggccacgatggcagcgtcacgcgcatcgaggagatgccagagtgagtagacgacgaggaggaccagctgcgacaagacggcggtcgctgccgacccggccgcgtagcgccagaagcgatcccacagcgggacgaaccgtcgcaggccgaccacctcgaggagtcggcgccccatgcgatcgattcggtccacgctctcccagcatagaaccgggcgccgagcgagcgcggatggtgacgtgttaccgatcggttaggaaccctcgggttgttgctcgtgcatccggatggtcgagtaaggtaacgaggtggtagcgctgcggtcgccacgaggtggcgaagcgcgttgcctgaccggagagtcgctggcgaaaggtggtcacgtgcggcagcaggcagagtgggcgatcgtcaccggcggctcgggattcatcgggaccgcggtcgctcgtgcgcttcgagcgcgcggcgtgcgggtcgcgatcgtcgatcgcaacgcgccgcagcaccgcgaactcgatgtgttcgtcaagggcgcgatcgagcacgagcgcacctggctcgccctcgcgaccgagctcgctggcgagcacgtccgtgcgctctaccacttcgcggcccgcaccagcgtcttgcagtcggtgaacgaccctcacgacgtctttgtgtccaacctggtgggctacgagaacgcgctcgagttcgcgcgcacgcacgaggtcgcgagcgtcctcttcgcgtcgaccaacgcggtcgtgggtgcgggtgacagcggcaccatctcggagcgctcgccgttggcgccactcacgccctatggcgcgacgaaggcggcaggggagatgctcgggagcgcgtacgccgctagctacggcatccacgtcgcgtcggtgcgcctgacgaacgtctacggtccggggatgtggcacaaggactcgatcgtgccgcgcctcctgcgtcatgtggtcggcctgtctgaggcgaccatctacggagacggtgagcaggtgcgtgacttcgtctacatcggtgacgtcgtggacgccttcgtgcgcctcgaggagctcggcttcgtgggcgcggtctcgttcggttccggcacgagcgtcagcgtgaatgagctggtcgatctcgtcggcgacgtcacgggccacgagctgcgcctgcgtcatgtgcctgcgaaggctggtgagatgccgggcgtgagcgtggacctgtcgctcgcgcgctcgctcggcctgaaggctgacgtcgaactggcggagggtctgcagttcgcgtggtcggacttccaggaggatcagggccgcgtcgccggctgagcgcagatcgcgcgcgctcgacgcgcctgtgagcgcgcgttgcggtgaccaccgacgcgggtgcttggcacaggatcgggttcgcgagccccggtggcggctcgcgctccatggcgcgtcacgcgtgtgggcggcctgagggtcgcaaggtcgaacgatcgatggcggaggcggtgtgcttcgagcgccgctcgcggccgagttcgctgcgctgtgcgctctcgctgctcgggtggggcggagtgggcaggcgctgccgacggctcgtgccgtgacgcgcccagcggcggagcgctcagcgttcggagccggggcgtgcttcgagttcggcgaggcgcgcgagcagtgccgagcgccgctcgtgccaccagtgctcgacgggggcgaaggcgctgccgagacgccagcgatcttgttcggtcgcgctctggcgtacgagggcgagggcctcacgggggtctgcctcgaggagcgatcggaagctgaagcgacggcctccgaagcggatgggcacctcggcgcggttggcggcggcgagaatgccgcgccgcgtgagcacgatccccgacagggcgggggagaggcacagctcgaggagcccgtcgaggtcatcgggagtctcgagatccggggcggctcgcaggtgcagtgggagagccgagggcacacccaggcgttcggcgaggctgttgagggtggcgaggaggtgttctgcccacggtgcgtactcggggggaccgagtgcgcgagcggcgcatgcgtacaacggaccgatcggtgcgagctgctcccagaggaaggcgcgtgcgaagtcgagcgcatcgcgatcgagcgcggcggcgaggacggagagcaagaagcccacgtgatcgcagagcgctggggtcgtgagatcggcgacgtaggtcgcgaggaactcgcgtgtgcgctccgtgggctcgccgccgagcagcgggccgcgcgtcaggaagaagctcgtgtaggggggcagctcgaagtcgaacagctcggtgaaggcggcacgcgagcgtcctaccccgaagagggcgaggagctcggggtcgggctcggggttctcgctgagctcggcgaggccccggacgacctcggcgagcttgcgcgtgtcactgtcgagttggttcactggcggtcgccgaggtcgggagtcggaaggcctctggggtcggcttgagcggacgcatgagccagcgagggcggcgcgtcccgtcggggctgacctcgcgggcggaacgagcgagctcgagccagcggtggaacacctcgcgcgaacgagcggtgtcgacgtagacctcggcgtggcggtcgccaggctgggctcgggtcacggtgacgacctggtgccagcagtgcatccccgagatcggatcggggtgcacgccgaaggtgaggttctggtgcacgcccacgtcggtccaccagatgcgctgggtgtcgggatcggccgactcgtagggcgcgacgccgtcggaggggtcgagcgtccagcgtgatccctggcggcgcagggcgacgagacgcatcatgcccttcgatccgacgtcgccgaggcgccaccgtcccatgtggtgcgagcaggcgacgacaccgggacggatgccttcggtgacccacgccttgacgacgaagtagccgagatcggtggtgacgcggacgagctcaccgtcgcgcacgccgatgcgggccgcgtcggtcggatggatccacagtgggttcgtgtgggcgatctcgtcgagccacttcgagttggccgaccgggtgtggatctgcacgggcaggcggaaggtcgagatcaggggcatctgcccgtcggcgagcttcgacggatggacgtggctcgggatgtaggtcgggatggcgtactctggccatccccacgaggcgacggtggccgagtagaactcgagccgaccggagggcgtggggaagcctcgcaggatcgcgccgtcgacctcgacgccgacgggccgacgtccctcgtcgtcggggctcgggtcgccggtcgggacgatgttggcactcgcgggcttcggagctcgagtccagacccggccatggtcgtcgacgtggacgtcgtcgagttcctcggccgggacgggccgttcgtagacctggccgacctggcgcgcgacctcgaaggcaccgtagcggcgcatgtagccgagcggcgtgaggccctccttggccgcggcttcggggagtcctggcaccgaatgctcgaacatccaggcgtagtactcctcgacggagagcttctggccggggttggctcgagactcgaagtagcgccggatacccagggagccgtcggggtcgatgcgccacgacagctcgatccagaactcgttctcctcccacacctcaccgggattgacctggcgggtgtcggtgacggtctcgccgagacgctcacgagccgctcggagcacgggttggcgaaacccgatccactggccgtcgtactgctcgtaggagtgggtgtcgtggcgttcggaggcgtgacccatcggcaagatgtagtccgcgaagaacgcggtctcgttccaggtgggcgtgagcgcgacgtagcacccgactttgtgctcgtcgagcagcatctcgatccaggcaaagccatccgggttggtccacacggggttgtagaccctcgtgaagtacacctcgagtcgcttgccgtactcctccatgaggtgcgggagcaagaacgagagctcgttctgggcaagtggatagtcgacgggccaggacagctcctgccagaccttcgggtgcggcgggacgtggatcggtcgtggcacgaacttgttccaggcattgaggttcgtgccccctggcgtcgcgacggcccccagtagtgcgttcaggaggaacagcgtccgagagacctgccagccaccgaggttgccggcggctgccgagcgccaggtatgcgtggcgagctgggtgccggcgtcggcgacgagctcggcgacctcgcggagcgtggcttcgtcgacaccgctctccttggccgcgtacgcgaaggtgaagtcggagtagagctgcttgagcacccccacgaaggcatcgaaggtcaccgggagctcggggtggaccgcctcgaggtactcgcgccagttccaccaccgctcgacgaaggcgcggttgaagcggtcgtgctggatcaggtagttcgcgatcgagaggttgatcgccgcttcggagccgggccacggcgacatccacacgtccgcgtgcgtcgaggtgttcgacaggcgcgtgtcggcgacgatgagcttcgcgccgcgctcgcgggcttcggtgatgcgctgcgcatgagggttgaagtagtgaccggtctcgaggtgggagctgatgaggtagatcaccttcgcgttggcgaagtcggcgctgggccgatcgatcccgctccagaactgatagccagttcgtccacccgacgagcacacgttggtgtgcgagttgtggccgtcgacgccccaagcggcaaggacacgctcggtgaagccgtcttccccaggacgaccgaggtggatcatgatctcgttctggcggtcctcgacgagcgcctggcggaggcgacgggcgagatcgtcgagcgcctcgtcccagctcacgcgctcccacttcccgctcccgcgggcccccacccgccgaagggggaagaggatgcggtcagggtcggtgatctggttgagcgtcgcgggacccttggcgcagttgcgccctcgcgagccgggatgttcggggttgccctcgaacttgcgcacggccaaggtgtcgcgatcgacataggcgaggaggccgcaggcgctctcgcagttgaagcaggtggtgggcacgagcatcgatcgatgctcgacgcgcttcggccaggcgcgcgagtcgagctcgacccagtcgtcccagcgctccttgggcgggaagctcgcgaggtcgatgcgcgagggcccctggtagaaggtttccccgcgtgcctcggtctgctcgcggagcgcgcgaatgcgagccgagagagattcgacgtcgttcgtagccatggtggtcgtacctccgagggttacgccaacgggacgcgttggccggcttggacgtaggcgtgttcgagcgggaggatgcacaggagcgctgctgcggcaagggccatgccgagcggggtgaggatcccgacgagatcgagcgcgaatcccagccagaagaggcgcccgagtgcgccgtgggtcatctcccacacggcaaggtgggccttggccgtggggtgcgtgatggtgatctcacccaccacgagcagcgcgttcaggatcgcgagcgcgcctgtgagacgctcgaggtagccgaccgtcgagccgggatcggtgatggccgcgacgaagacgctgacggccgatccgagcaggagcgcctggatgacgaggtggatcggcatcagggggctctgccagagatcgcgtgctttggcttgggcgaacaggaacgcggtatagagcgccgcgagtgcggcaaggggaatccccgggatggcgaggatgcccatggcggtcgagctgtgcaggatgccggcgatgagggtcagcgtgtcgatgccgccgaagaggaggagtccgtagccccccctgacgagccagctctcgggtcgacccttgaggaagagcaggtagaagcgttcgggatgcttgaggtcgccgatcaggagccccccggtgatcgcgaggaaggcgagcgagatcgacggtccccagatgcggacgaggtccgacgagaacggcagcttcccgagcaaccacagcgtgatcggcacgaggtaggcaccggccgagaggcccttcgtccaggtgtagaggctgaccaggccgccccacggtgcattgtgggcgacgtcgtagaccagcttggccttggccgacgagttcggcacgtgggcgtcggccgggtggcccgaggcgatgacgtgcggtccgctcgggatctgggaccacatgtacgtatcgccgcgcggacgctcggccgcgatgggatccagggttgcctggtgtgcgccgcgatagaacagcttcggacgggtccccttctccgggttgcgcacggccaccggggtgcggtggacgacgcgggtcgcgcgtgcggtgtcgtcctcgagcttgccgatgaggatggcctcggtcgggcagacgacgacgcacgccggttcgaggccgatgtcgagacgatgcgcacagaagttgcacttctcggcggagtggtcctcgggattgatgaagatggcgtcgtaggggcatgcggccatgcacgccttgcagccgatgcagatggccttgttgaaatcgacgatgccatcgggtcgctgatacatcgccccagtcgggcaggccgcgacgcacggtgggttggtgcactggttgcagcgtgtgacctggaacgagcgccgaacctgcgggaacgtaccgacctcgacggccttgacgtaggtccgcgtcacccccagcgggacctggttctccgacttgcacgcggtcgtgcacgcatggcagccgatgcacttggtttgatccaggaccttgatccaggtctctttggatgtcgtccgttgctccgtgagcacgctcgccccaccccctgcagcacacagccgtgcgtacgatcggcgcacgcacgcatgtcaacgcatacccagtggggattctaggaacgtgctgcggctacgtccaggaggcgccacggcggccccgggacgacaaaggcagcccatcagggcgtgtgagctgcgatgatgggcgattctgccgccagaggctcacagctggccgggtggcgagatgtgagccctggcaacgctattgcctgcgtgacaggcgttattcgaggagtgatcgagccgcagaattagcgcatcgcgtgttcgcgctcggctcgggcgcagaaggcgcagccgacggtcgttcgatcgccgaagagccgatagagcgggcagtagccggtcagcccggtgatcagcatgatggccgcgagcgcgtagagaacaacgctgccgacgctgccgttgccgaccatgacgccaagcgcccagaacactggcgtcgcgacgacgatccgcagtgctcgatcccagatacccatgttccgtcgcattggtgcctccttgagtggtcctagaccatccaacgcgcggctccgacgagcaacgtcccgggcggcaccgacaagcgacgagggtcctaggaggtcgggaccttcgtccgacgacgggtgaggacgagagcccctacgaaccaggcggcgaggccgagggcgctcgcggcgaggccctcgccgaaccgtggagcgtggtagctcatgacgaggtgctggcgcccagctccgacgtcgacggtcatctgatcggaagggctggaaccaacgggagccgggtgaccgtcgagctgggccgaccagccgggcgcccacgcgaaggggaggacgagccgggtcgggtgggtcgtgacgacggtcgccgtgatggtgcccgatgcagcttgggaggcgtcgaggacgcgcaggccctgctcgggctcgatccagtgggcgggctcagggagctcgaatgcgagtgctgcgccccgaacgatcagttcgtgccaactgctcggagcgagggcagtgtcgagcgggccaccgaggaggtaggcgccgctcgaagcgacggcgacgacacggacggggagcgtggcgcccttggaagcgctgagacggacgctctggaccgtctcgccgccgggaatggcgagctggacggacgatgcccggtgctcggtcgcggcctggatcgtcgcgccgctcgtgagcgtcacgctcatggccaggcgtcggacgggactggcgacggtggcggtgagcttcgtgacgccggtgagatcgccggcgtagacgtcgaggcgaccgtcgcggagcgagagcggagatgacgcggggagtcgggacgccgtcggagcttccgtggcgaagtagcggcgtgaggtgacgacgaggcggacattgaagtcgcgaaccaaggtggacagatcggccggatcgaacgtcgactccggcttggtgccggtggcggcgtcgtagcgagcgaggccgagcgagctgtagcccgaggccgacagtgtgtgggcgtagatgttggtgtcgggctgcgcgtcggtcgcgatcaggctctcgtagagatagagctcagggtcgtagacgacgtagcgcagaggtcgtcggagcaacgatgcgaccgtcggtgccgtcggcattcgcaccggtggcgagagcgacgagagcagcgggaactcgaggacttggttggcgacgtcgaggacgaggacgaggacgaggatgcgcagggcccaaccgcgcaagggcgagccgaggagcacgatggtcgccgctcccacggcgatggccatgacgacgaggtagccgcgcagtgcggcgagggagatccctgtgggcagcgacaccacgttgaagtgttcgagcagcgcagcgggcgcgacgatctcgacgagcgcaaagcccacggcgagggtgccaaagacgatgagtgccactcgagtcgggaggtggtggcggaaggagtcggggtgggcaagtgcccagtcggcgctgccggccgcgaggagcacggcggcgaagtcgaccccgatgaggtaacgggacgcgagtcgctggaggtcgaacagcgggagccggtagacgaggtgcgcgaacggcgtgtggccaccgagtgcgaacagcatgctgagcaccgccgcactccacagggcaggtgctgcaccacgtcggagcgtgctcgcacggggacgcacggctgcgaggaggaggaaggcgaggccgagcgcggtgatcgagacgttgatctcgtaggggttgtagttgccgaagtaggagatcagctctcccccaaaagccatgggatagacggcgagcggcgtgaagatccccgaaaacggtccggcaccggcgtagtgcgggggcaggtgggctcgcgtcgacagggcggtaaaggcgagcccgggtacccactggatcgctgcgagcatgagtgcttcgagcgcgcagatcgcgatgacgacgagatcacgaacgtcgagtcgtcgcccgagggtccacacgacggcggccaccgccaagacgacgaggcccgcgagcatggcttcgggcgcgccggcgagcacgtcgagcgcgaagccggcagcgagcccgagggcgttggcaagtcgagaggagcgtccgtaggcgaggcgagccaggaagacgaaggcaagcatccatcccgcgtcgccttcgatcatgtcgaggtggacactctggccgatcgccgcacccgtgagggcgaggacgaggccggcgacggtggcgaccttgaccccgatgcccagggttcgcgccgagagataccccgacagtgcgatggtcgcgaaggcggatccggcggcgacggagaaggcgagccccgtcgggaggacgatgaacgggatgatgaaggggctgaaggcacccgcgttgaagccagcggcgaggggcacgccgctccagatggcgggatcccacagtggccaggagccatggcgcaggtcgaggccgacgagcgtgcgaagcggtgcgttctgcgtcgcgttgtcgccaaagaggagtgggtgccccgcgagtgccgggacgacgaagaggacgatcgggacgacgatgaggatgacgacggctcggcgcgcaccggcatcgcccgtggtcgtcagcgcggcgcgatccatcgctcacgaagataggtacgcgccaccacgcgcccatagcgcaggccgtagcgccagttgcggcccttcttcgaggtgccggcgcggcgagcgaccatcgtgacagggaactcgacgatcgttgcgccggcgaacgctgcggcgaggaggagttcggcggattggtactggggctggtcgagccggagccgtccgaggagctcggccgcgatgacgcggatacccgatgacgtgtccccgacccgctgaccgatgagcgcggacacgacgagcgagaagactcgaacgccaaggtcgcggatggggtcgcccaccgtgctcgtgccgagtcggcgtgagccttgtgcgaacgtggcgacgtggtgatcgacgagatccacgcccgtcgcaaggtcggctgggtcccactggccatcggcgtcgacgatgccgacgatgcgtgcgccccgacggatcgcgaggaggtaaccgagacggagtgcagcgccttggccgcggttgatcgggacgtcgaggacgagcgcaccttcgcggcgtgccacgtcgacggtggcgtctcgggaaccatcggacacgacgacgacgagcggtggtgagccggcgagctgtcggggcacgcgccggatgacgtcggcgatggtggcttcctcgtcgaatgcggggatgaccaccatgactgccgcctcgggcaacctcgggttgtcgtcgtcgaagcgtgcgaggacgaggcggtcgatggcgtcatccgggtcgaaggctgcgctgcgcacgtcgggtgtgacgcgcacgggaccaccacctttctcgagccggatcctcgcgatgtccgaggctcggctcatcctaggggcgcgcgcgaggaggccagggccgagcgctgcgaaggcggcgcgaacagcgccaccgcggccccgatcggtgctagcatgcgctggcacaaaccctacggatagggtgcgaacgacacacgagggcactagttctgtggtagcgtttcgcaacacggtcgatcggctacggacggtggtggatcggggttcggggctggaggcctccagtccagaggtggaggacgagcaacgtcggtgggctgcgtcggtcggatgggacgcacgttcacgcggtcgtgactcagcaggccaacggacgttggcctgaccaagaaggggagtgagagggaggcgcagtggcaaggtccacgagtgcacggattcagcggcatttcacggctccggggctgcacccgtacgagacggtgggatgggagcgtcgcgacgcgcggatcacgaactggcgtaccggcgacgtcgcctttgagcaacgagacgtcgaggttcccgtgacgtggagccagaacgccacgaacattctcgcgcagaagtacttccggggccatctcggcacaccggagcgggagggctcgttgcgccaggtcgtcgatcggatcgtgaatcggatcgtggcctggggcgaggccgatggctacttcgccgacgacgacgagcgcgatgccttcgcggacgagttgcgctggctgctcgtccatcagcgagcggcgttcaactcgccggtctggttcaacatcggggtcgagggcgtgccgcagcaggcgagcgcctgtttcatcctctccgtcgatgacacgatggagtccatcttgaactggtaccacgaggaagggatcatcttcaagggtggttctggtgccggggtgaacctctccaccatccgctcctcggtcgagccgttggcaggtggtggcaccgcttcggggccggtgagcttcatgcgaggcgccgatgcctcagcgggcaccatcaagtcgggaggcaagacgcggcgggctgccaagatggtcatcttgaacgtcgaccaccccgacgtcgaggagttcgtctggacgaaggccatcgaggaacgcaaggcgcgcgtgctcgcagaagccggcttcgacatgggcgtcgacggcaaggatgcgttctcgatccagtaccagaacgccaacaactccgtgcgcgtgaccgatgagttcatgcaggccgtcgtcgaagaccgggagtgggaactgcgggcggtgacgacgggcgaggtcaccaagacggtgcgtgcccgtgacctcttccatcagatcgccgaggccgcctgggagtgcgctgatccagggctccagttcgacaccaccatcaatcgctggcataccacgccgaatgccgggcggatcaacgggtcgaatccgtgcttcccgggctcggccagggtccacaccaacaaaggcctcatcgccttcgaggagttgaccaggcgcgtgctcgatggcgaggagttcctggtctacacgcacgacagcacgagccctgacgatcctacggagcaggtgctgctctcctcgccagaggcgttcatggtcaccgggtacaaccaagtcgtcaagttgcgcttcgacaacggcgccgaacttcgctgcacaccgggacaccgcatcttcacggtcaatcgcggttacgtcgcggccgaggacctcaccccggaggacgaggtgcagctgctggatcttccggcgccagccacggatgcatcctgggtgttgccggtggcaaccgatccggagttctaccatcacaagggcgaccgccgcgacccgatgaccttcccagagcgctggagcgaggacttcgcccacttcttgggttggctcatcggagacgggtcgctctccaatgggacggtcgtggcgacctatgggtctccagacgaccagcaggagatcttgccgatccaccagcaactcctgctcgagatcaacggcaacaggcctctgaaggtgtcgacccaagccaacggcaccgtccagctgcgctttggcaggcaacggttcatgcggttcttggaagcgctcggcatgaagagggcgaagggaccggacaaggatgtgccgtgggcgatcgagcaggctccagcggagatcgtcggcgcctttcttcgaggcttgttcgacgccgatggcacggtgatcgtcgaccgcaacaaggggtcctacgtttcccttggctcgatctcgacgggcttgctccgctcggtgcagcgactgctgacgacgttcggcatcacgagccggatctacaagacgcgttcggggtcgtcgaatgggtcgttctcgtacaccgggcgtgatggggacgtgagggtgtacccgaaccacgatgcttatcagctacggatcacctcggcgtcgatcgtgcgcttcgccgagcacgtcgggttcggcctcggcgccaagcaggcgcggctgcgcgacatcgtgggtggacagcagtcctacgaggttcggcggacggcgcggctgacggagcgtctcgaggacgggatcgagctcacctacaacctgagcgagcccaagaaccattcctacatcgtcgatgggattgtggtccggaactgctcggagtacatgcatctcgacaactcgtcgtgcaatttggcttccatcaacctgcttgcctacctggacgaggacggcaacttcgacgtcgaggggttccgtcacacggcgcgagtgctcatcacggcgcaagacatcctcgccggcaacgccgactacccgacaccgaggatcgcggagacgtcgcgggcctatcggcaactcgggctcggctatgcgaatctcggggcgatgctgatggcgctcgggctcccatacgactcagacggcgggcgcgcctatgcggctgcggtgacggcgctcatgacaggagctgcgtacgagcgttctgcagagctcgccgagcgcctcggccccttcgctggatacgccgacgatgctgagtccatgctgcgggtgctcgggatgcatcgcgacgccttggcgaaggtcgatggcgctccggaggcgatcgtcgaggccgctcgtgcttcgtgggacatggccatcgcgcgcgcgagcgaggtcggcgtccgtaatgcccaggcatcgctgctcgcgccgaccggcacgatcgggtttctcatggactgtgacaccaccggtatcgagccggacttctcactggtgaagtacaagaccctcgtcggtggcggcaccatgaagatcgtcaaccagaccgtgccacgggcgttgcggacactggggtatccggagcacgagatcgaccagatcacggcctatctcgccgagcacgactccatcgtcggtgcgcctgggctcaagccggagcacgaagccgtcttcgcatgcgctgtcggggaatacccgatcagcccgacgggacacctcgcgatgatgggggccgtgcagccgttcctctctggtgcgatctcgaagacggtgaacctgccgagcacctccaccgttgaggacgtggagcagacatacctggatgcctggcggctcgggatcaaggcggtcgcgctctatcgcgacggatcgaaggtcggtcagcccctttcgacgacccatgaggaggattctgaggccatcacgtcgctcaaggaacagctgagcgagctcgaacgccagctcgcagcctcgcggacgcgccccgttcgggaacgcttgccgcgacaccggcggagccgtacctatgcgttccaggtcgctgacgccgagggctacgtgacggtcggggagtatgacgacggtcgtccgggcgaggtgttcgtcaaggtctccaagcaaggctcgacgctcgctggtgtgatggacgcgttctctatcgcagtgtcgctcgggctccagcacggcgtgcctctcgagacgttcgtgcgcaagtacgtcaacatgcgcttcgaaccggccggcatgaccgatgacccggatgtgcgcatcgcctcgagcctcgtcgactacatcttccgccggctcgccatcgactatctgccgcgagaggtgcgcgaggacctgggggtgctgacgacggcggagcggcgaacggagttgctgttcccagtcgaggaggtcagtgagccgacaacgcgtgcgagtgcgcagacgtactctcaggctgagcatcgcttggactcgggtcgggatgacgtcgtgcatgagactgcgactcgtgagagcgggctgcacgtctcggcgagcgcgtcggacgcaccgtactgcttctcgtgtggcaacgtcatgcagaggtctggctcgtgctacgtctgtcctgcgtgcgggacgacgagcggttgtagttaggtcgagcctgtcgcgagttttcgcgttgcgagttgcgagtttcgcgacccggggtagacgcagacggtgaagggtcatgatgcaaccaggggcgccgcatgagcggctcccctggtgctgtcatacggtagggcgggagccgccttggcagcggttcctcacatcgatgctgctctccggtgagaagagtcgggcctctgatccctgcgagcgatcggccgagtagccgcgtcggtcgcccgcagagatcgtggtcgcggtcgaggcgtcgggccggcgggacgagagcgagcagcgctctcgtcgtgaaccagggccgaacgtcgggtcgtgctggaccacaagtcccttcgtggacccgctctgggagcgacgccatggccctactaataccctctggggtatgacgaataccacaacgtcgcacgagcggccggagggggtggggcggcgcatcgtcgtcgtcggtggcgtcgctggcggtatgtcggctgctgcgcgtcttcggcgactctgtgagcatgcttccatcaccgtgatcgagcgatccggacacgtctcctacgccaactgcggtttgccctactacgtcggctcggtgatcgaggaccgtgaggacctcgtgctccagacgcccgaacgtctccaggcccgcttccggttggacgttcgagtcaacgccgaggttgtctcgatcgatcgtgagcgtcgcgaggtccgtgtccgcagcgtggagaccggtgaggcctcggtgctcccctacgacacgctcatcctgagtcctggggcggtcccgatccgcccgagcatccccggggcagaccggatgcgcgtgctgcgcaccgtcgaagatgccgaacggctcgcctcggaggtgacgacgcggcctcggagcgcgatcgtcgtcggcgcggggttcgtcggtctcgagacggcagaaaacctggctcaccatggcatcccagtgacggtggtcgaggcgcgatcgcaggtgctgccggtgctcgatccagaactcgccatcgcgatcgaagagacgctggagcgccacggcgtccgtgtgatcacgggggctggggtggccgaggtccatgcgtggggcgtcacgctcgacgatggccaggaggtcgagggagacctggtcgtggctgctgtcggtgtgcgtccggacgttcgactggctcgcgcagcagggctcgagctcggtccgcacggcggcatcctggtcgacgagacctctcgcacgagcgacccggcgatctatgccgtgggtgacgcggtcgagaaggtcgacgccatcagcggatcgctcgagctcgtgacgctcgcacatgtcgccaaccgccaaggccggcgagtcgccgatcacatctgtggacgcgcggtcgaggcgcgaccgtcgatcggcaccgcgatcgtgcgcatcttcgacacggtcgccgcatcgaccggcctgagcgaacagcgcctacgggcactcggtcgtgcgtaccaggtcgtgcgcgcgcaccccatgagtcacgcgagctactacccaggtgcccagccgatgtcgctcaaggtcatgttcgacccgagcgacgggcgcatcctcggcgcgcaggcggtcggcggcgaaggggtcgacaagcgcatcgacgtgctcgcgacggcgatcgcggcaggattgccggtcgacgagctcgcgaacctggagctcgcctatgcaccgcccttctcgtcggcgaaggaccccgtgaacatggtgggttacatcgccgagaacatccggagcggtacctgcgacgtggtggagccggaggaggtggagtcgctggtgcgcgatgggtggacgctgctcgatgtgcgcaccgccgaggagcatcggcacggtgcaatcccaggcagcgtctcggtaccggtcgacgagctgcgcgagcacctcgaatcgctcggggacgggccgttcgtggtctactgcgccgtcgggctccgtggtcacgtcgctaccacggcgctcctcgagcatggcttcaaggctcgcaacctgaacggtgggcatcgctcgtgggcagcgtggaaggctgctgaacgcatggcgctcgccgggtgagccggctgaggctcacccggccacgatcggcgtcaccatcgacccatggctaggcccgctcggattctgccgtggtggcgaagtagtcgcggtactggcttcgaaggaggtgcttctggaccttgccggtggcggtgcgtgggagttcgtcgacgaggatcaccgcctttggcaccttgaagccggggagggcgctgcgggccgcggcgaggacgtcggtctcggtgagtcctgagccggggcgtggccgtacgatcgcaacgactgcctcggtccagtgcgcgtgcggcaggcccaccacgacgacctcgtcgatgcgcggctcagctccgtagagtgcacgctcgacctcgagggatgcgacgttctcgccgcccgtcttgatcacgtccttgcggcgatcctcgaaccacagcaccccgtcggcatcgaggtaacccacgtcgccggagtggaaccatcccccggcgaacgcctcgttcgtcgcctgctcgtcgtggagatagccctgcatcgcgtgaggaccgcgatagacgatctcgccacgcgtgtaagcgggcacgagctcgccggcgtcgttcacgatggcgacctgcacgttcggcaccgcgccccccacggcaccggcgtgggagagctgttgctccgggaggagcacggtggtgaggggattcatctcggtttggccgaagccgagggcgaggtcgcagccgagcacctccgtcacgcgcttgacgtcggtctcggccatgggcgccatggcgtagatcccgagtcggaggctcgagaggtcgcggcgggagacgtcggggtgatcgatgagcgcgcggtacatcatcggcaggaggaagatctgcgtgatccgttcgcgctcgatgctcgcgagcagagccgcagcgtcgaaggatcggtgcaggacgacggtgccgccgaggtagagcaggcccgtggtgaggccgttcagctgcgccgtgtggaacagtggcatcacgacggcactgcggtcggcgtcgctgtagtgcatcacgatcggaccggtgagcgactcgatgtagaccgcgacgtgactcgagaccacacccttgggcgccgacgtggtgccactcgtgtagaggtaggtcagcggatctcggtcgtcgacgaagcaggccggctcgctggttgcgttcgggtcgacgaaggcatcgagcgtgtgccaggtgccctgtggcgctggttcccactcggcccctgttccaggggcgacgatgacgtcgacgaggtcgtggtgctcggcgatcgccagcgcaccggagatgagggggacgaactgggcctcgaccaccgcgccgcgggctctggcgtggccgagcacgtaggccagctcgttgggcccccacgccagattgatgggcacgcagacggtgccggtcttggcgcaggcgtagtaggtgacgaggaactcgatgctgttgccgctgatgagcaggagtgcggtgcccctgccatagcccgcgtcgaggagggcatgggcgaatgcgttcacacggtcgttcagcgctcggtaggtcagtcgctcgtcgcccgcgatcaccgcctccttctcgccgagacgccacgcgctccgcgtgagcatgtcgccgacgttgacgcgctgaatcaggttgcgttcgagatcgtgcgatgtcatggttccccctgtcctcggggccggtcctcggggcctgtcctcgagcgtgtgctcggagctacgtgcgccagaccacctcgccccccgctcgttggcaagtatgccaggggctggtctcgctgtcgagggatcgaggaccgtctcggcgggcgggtgcgatcacccgtgagaaggtgcgatcagggagcgaggccgatggcgcgcgcccagatctcggtcatcgcatcgacggcggcctcgtcgtcgaaggggaggccgaggtcgtggctgcgctcgacgaagttctcgaccatcccgcacagcaacgccgccgtcacgtcggcgtcgagggtcgggtcggcgactccttgcgcttggagctggcggaggccacgagtggcccgctcgatgaacaccgagcgcgaggcgagtcggcgacgtcggacctcgtcgttgaaggacgcggcctggacgatcactccgtagaggttcccatggcgacggaacgcctcgacgaagcgcgcgttcgaggtgcggatgcgctggcgtgggtctggaccggcgacttccccgacgtgcgactgctcgtagagcgcggcgatgaacgcatcgacgagcgcgacgaagatcgcgtccttcgagtcgaagtaggtgtagaaggtcccgatcgcgacgttcgcgcgctcggcgatgtcgctcacccgggtctcgaggaagccacgctcctcgaagacggcacgagcggcctcgagcagccggtccctggtacgccgtccgcgttcggtgaccggggcggcgctcatcgcctcggctcgccggagcgctcgacgagtcgcacggtcggggtcgggagctggtcgaggctccggggatcattgcgtgcggtcacggtgacgggtacgctaccagatgaaagtgacgtcaggttcatgttctggcatcggcgtggccggcggccctcgcggtcgcctcgaatcgaggggggagcatgcgcttcaccgaggagcacgacgtctttcgacgcagcgtacgtggggtgctcgagcgcgaggtgctcccgcacctggaggagtgggaacgggctcacagcttcccgggccatacggtcttcaaggccctcggcgccgccggtctgctcggcctcgagtacgacccggcctacggcggccagggcgcggaccactcctacacggtcattttcggcgaggagctcggtcgcatgggcttcggggcgctcgccatggccatctcggtggtgaccgacatggcgaccccgtcgctggcccgttacggctcgcacgaactcaagctgcactatctcgtgccgaccctgcggggggactccatcgcatcggtcgcggtgtcggagccggacgcgggttctgacgtcgcggcgctccggactcgcgccgtgcgcgacggcgacgactgggtcatcaccggcaccaagctctacatcacgaatggcacccaggcagactggatctgcctgcttgcgcgcacgagcgatgagggcggctatcgggggatgtcccagatcgtcgtcccgaccgacgcgccggggtttcgggtcgcgcgcgccctcgacaagctcggcaaccacgcctccgacaccgccgagctggtgctcgaggagtgtcgcgtgcccgtgtcgaacaccatcgggaccatcgggcggggcttccagcagcagatggcacagttccagaacgagcgcatgatcgcgtcctactcggcggtcggcgcgatggaacgtgcgctcgagcgaaccgcggcctatgcacgcgagcggatggtcttcggggagccactccttgccaagcagtacgtgcagtttcgcttggcggagctcagcgccgaggtcgatctgcttcgtcactacaactacgcgtgcgccgaggcctatatggcaggcgaggacaccacgcgctttgccaccattgccaagctcaccgcgggccgcctgagccgcgccgtcgctgactggtgtctgcagctccacggtggggctggctacatggaggagacgtgggtgtcgcgctacttccgcgatgcgcggctcctctcgatcggaggcggtgccgacgaggtgatgctccagatcctgacgcgcctcgagggctacgagccatgagcggatccgggctcgatctcgtcgggctcatcgacgacctccaggccgagcaccgaaccctccgtgcgaccctccacgacgcagggtgggaggtgtgggagctcccgacgcgcgcagcgccgtggcggatccgagagcaggtggcccacctcaccttcttcgacgaggtggccatgtggtcgatcgaccaccctgagcgcctcgacacactgcgcgccgcgttcgacgcatccatcgatccgagcgagcgcgccgacgtggtctgggcacgcgagctcgctccccagaccctctgggagcgctggtgccgagcgaacgacactctcgttacccggctcgcccggctcgtcgacgaggatcccggacggcgcctcgactggatcgggccgtcgatggggcttgcgagcttcgtgagcgcgcggctcatggagacctgggcacacggggtcgacgtcgtcaacgcactcggccacgacgtggcggacacggtgagcgaccggcttcgccacgtgtgctttctcggttgggccgcgagacgcttcgcccttgcgacccacggcatcaccgacctcgacgatccactccgactcgaagcgatcgggccctcgggcgagctctgggcctgggggcccgaggatgccccgaatcgcgtgcgcggctcggcgctcgagatcgccctcgtcgtgacgcagcgacgccacgtgtcacgcacctcggtcgaggccacgggggcgcttgctcgtcgttggctcgaggtcgcccaggccttcgccggcccaccgacggtcgcctcgaaggagcgctgagccgtggcagcgccgatcctcgaacgccccgtcgacccgcgcgacccaggcttcgtcgcgaaccgggcggcgatggtcgagctcgtggaacagctcgagtcgctcctcgaccaagccgctctcgggggaggtgccgaggcccacgcgcgcagggccgcgcgaggcctgctcggggtgcgcgaacgtgtcggcctcctcgtcgatccggagagccccttcctcgagctgtcacccctggctggctatgggacggagtaccgactcggtggcgccatggtgcttggcatcggcgtcgtggaggggaccgagtgcgtcatcgtcgcgaacgacccatcggatctcggcggtgccctcacgcagatcagcgtgcgcaagctcctccgagggctcgagatcgctcgcgcgaatcggatgccgctcatccagctggtcgagtcggccgggggcgacctgcggggcttcgtaccaggcgacgatccggacgctgccctgcgtcgcaacctcgagcacttcgccacctccggccgcatgttccacgacatcaccaccctctctgccgagggcatcccgacgatcgccgtcgtgttcggctcgtcgaccgctggtggtgcgtaccaaccaggcctctccgactacaccatcctcgttcgcgaccgcgcgaaggtgttcctcggcggcccgccgctcgtgcgcatggcgaccggcgagctctccagcgacgaggagctcggcggcgccgagatgcacgcgacggtgagcggcctcgccgactatctcgcacgagacgagctcgacgccatccgcagcgcacgcagcgtcgtcgcccatctccagtggcgcaaggcgggtcccgggccggttcggcgcgatcctcgaccgccgcgctacgaccccgaggagctcctcgggctcatgcccatcgatctgcgcggcccggtcgacatgcgggcgatcatcgcgcgcatcgtcgacgacagccgtttcgaagagttcaagccctcctacggccccacgctcatcaccggatgggccgaggtgcacggctttgcggtcggcatcgtcgccaacgacggtgtgctcctctcggaggcgtctgccaagggggcgcagttcatccagctgtgcaaccagcgcgcgacgccgctcgtgttcttgcagcacatcaccggcttcatggtggggagcgactacgagcggtccgggatcatcaagcacggcagtcagctcatcaacgcggtctcgaactcgaccgtgcctcacgtgacgatcatcctcggtgcgagctacggtgcgggcaactacgccatgagcggtcaggcgttcgacacgcggttcgtgttcgcgtggccgacggcccggatcgcgatcatgggaccgacccagatggcgggtgtgatgtcgatcgtacggcacgagcaggcagctcggcgcggcgtcgagatcgacgaggaggccgaagcggtgcttcggtctcgggtcgaggcgttcgcgcacgcccagtcgttagcgctctacgcgacgggccgcgtcgccgacgacggcgtgatcgacccgcgcgacacccgcgacgtcgtgggcatggcgctctctgcgtgtcacagcgcgccggtcatcggggctcggggctacggagtgttccgcctatgatccgccgcctgctcatcgccaaccgtggcgagatcgtcgctcggatcgcgcgcacggcgcgcatgctcggtatctggaccgtgggggtgtacgcgccgcccgatcgctcagcgccgtggctggacgcgaccgatgacgtgatcgggttgatcggtgacggcgtccaggagacctacctgagtgtcgaggcgctcctgcgggcggcgcagcgtgtcggtgcggatgcgctccaccctggctacgggttcttgtcggaacatccgggctttgccgaagccgtgatcgccgccggcctcacgtggatcgggccgccaccggaggccatcgccctcatgggcgacaaggagcgcgccaaggcacacatggctcgcgcgggtgtgccgacgctaccgacgttcgcgcccgacgacccggacgtcgtgctgccggtcctcgtgaagcccactgccggcggcgggggcaagggcatggacgtcgtgcgcgagcgtgcggcgctcggcgcggccatcgacgctgctcgacgcacggctgcgggcgccttcggcgacgatcgggtcttcctcgagcgcttcgtcgaggtgggtcgacacgtcgagatccaggtggtcgccgacgggcacggggcagtggtgcactgcttcgagcgtgagtgctccatccagcgtcgtcaccagaaggtgctcgaggaggcgccctcgccggtcctcgatgcggaccttcgcgagcgcatgggggcagcggcgtgcgcggccgctcgcgcggtcggctaccgaggcgtggggacggtcgagttcctcctcgagcccgacgggtcgtactggttcctcgagatgaacacgcgcctccaggtcgagcacccggtgaccgaagccatcaccggcatcgacctcgtcgccgagcagctgcgcatcgccgagggccgaccgacgtcgctgcgccaggacggcctcggcatcgacggccacgcgatcgaggtccgcctctacgcggaggacccggcggccgggttcttgccccagaccggcacgctcgtcgagtgggcgcctgcggacgagcctgggatccggtgggattcggccgtggcgacgggcaccacggtcgcgatcgagtacgacccactgctcgccaaggtcatcgcgcacgctccgacgcgcgacgaggctgcccgtctgctcgctcgagccttgcgccgtagccggatccgtggcgtgacgacgaaccgggcgttcctcgtcgccctgctcgagcacccggagttcctcgccggtgcgacgaccaccgacttcatcgagcgcactggcatcgcccatctcgctgcggcgcatgcgcctctcgctgacgatgcgctcatcgcggcgtcgcttcgcgcacgtgccgacgaccgggctcgggtggagctcgcgacgacgctgcctgcgggtcggcgcctcgggcggctgccggcgacggcacgtacctggcgcgtcggcgacgaggtgcgcacggtcgcgctcacggaggatcgcgccgggcggttgtggatcggggatcgtcggctcgatcgggtgggggtcgaaggcggctgggtcgagtggttcgagcgggaggtgggctgcgagcttcgacgccggttccacgtgctgcgcgacggcgacaccttctacgtccagggcgacggggtggatgtgcgcatcgagcgcgtcgatccgtttgccgggcctgccacagagcccgcccttcggggcggcctcgaggcgccgatgcccggacgggtcctctcggtggaggtgggggtcggcgatcgggtacgcgccggggcgctgctcgcgatcctcgaggcgatgaagatggagcaccacgtcctcgcgccccacgacggcgtgatcggcgaggtgcgcgtggcggtcggggagcaggtcgatcgcggcgacgtgctggtggtcctcgaggaggggtagatggcgcgcccggttcgcatcgccaacgtgagtggcttctggggcgatcgcgtggccgccgcgcgcgagatggtcgacggcgggccggtagatgtgttgacgggggactggctcgccgagctcaccatggtcatcctcgcgcgccagcgggcccgagatccgctggccggctttgcgacctcctttctcacccaggtcgaggacgtgctcggcacctgtctcgatcgcgggatccgcttcgtcgccaacgcaggcggtctcgcacccgagcgttgcgcagcggcggtggaggcgatcgcagcccggctcggactcgcaccacgcgtggcgttcgtcgacggcgacgacctcgcaggttcgctcgaggcgatcgcagccggcgggacgccactcgtgcacgccgagacgggagaggccctcggtcagcggacggtcctcacggcgaacgcctacctcgggggctggggcatccgcaccgcgctcgacgacgacgccgacgtcgtcgtcactggacgcgtcgccgacgcatcgctcgtcgtaggggcggcagcgtggcaccacggttgggctcgcaccgatttcgaccgaatcgccggcgccatcgtggctgggcacgcgatcgagtgcggcacccaggtcaccgggggcaactacgccttcttcgacgagatcccgaacgccctccacctcggcttcccgatcgccgaggtcgcagacgacgggagtgccatcatcaccaagcaccccggtcacggtggtgcggtcaccgtcgggaccgtgaccgcacagctgctctacgagatcggggcgccgagctacgtcggaccggatgcgatcgcgcgcttcgacacgatcgtgctcgaggacctcggacacgatcgagtccgcattcacggcgtgcgcggggagccacctccccgaaccgccaaggttgggctcgccgtcgcagacggatggcgcctccgcctcggggttgcgatcaccggactcgacgtcgaggccaaggccgctctcttcgagcggcagctgcgcgcagccaccgagggtctcgggctgcgtcgactcgaggcgcacctcgtgcgcaccgacaagcgcgatccgcgctccaatgaggaggcgaccgccactctcgagatctccgccgacgccgacgacgaggcggtggtcgggcgagctctccgcgctcgcgtgaccgagctcgcactcgcgtccttcccgggcctctgggtgagaggggtcacggcccgcccagagcccttggtgcgcttctggccgaccttcgtcggctgggaatggattcacgaacgcgtcaccacgccatcggcgacgatcacgctggagccgccgccgtggagcgacggcgcgcatcgcgaggtcgcccaacccgagcccgccgtcgatgcgaccgtccagccgagcgatgcgttcggcccgtgccggatcgtgccgctcggtcggctcgtcggagcgcgctcgggcgacaaggggggctcggcgaacctcggggtgtgggccagaacggaggaagcctacgcctggctcgctggcttcttggacgtcgacgagctccgaaggctgctgccggaggttgcgccgctccaggtcgagcgctgtgcactccccaacctgcgagcgctcaacttcgtcatccatggactgctcggggagggcgcctcagcaccgcgacgggcggatgcgcaggccaagagtcttggcgaatggctgcgtgcccgactcgtccctattccgctacggttcctcgtgtgagcgagactgacgagatcctgctcctcgagcgtcgagacggcgtggtgaggatgaccctgaacgacgtcgcgcgacggaacgcgctctcgccagcgctcctcgatgcgctccatggtgccctgcgcgaggggagcagtgatgaggacgtgcgcgccatggtgatcacgaacgcgggatccgtcttttgcgcgggagccgatctcgccgcggcgggcacgagcgccggcgatcacgcgacgctcgccgacgtcctccttgccatcgaggagtccccgaagccggtcatcggccgcatcggcggacatgccttcggcggcgggctcgggctggctgcagcgtgcgacatctccatcgcttcgtcggaggcgcgcttcggcttcaccgaggtgcgcctcggtgtcgcacccgccatcatctcggtggtgtgcctcccgaagctgcgtcgcagcgacgcgctcgagctcttcttgaccgcagaacgcttcgaggcgactcgtgccgtcgcgagtgggctcatcacccgtgccgtcgagcccgctcgactcgacgccgaggtcgacgaggtgatcgctgccgtcctccgcggtgctccaggggcgctcgcggtcgcgaagcgcctcgccctcggtcacgatcgcgaggcctcgcgcgaggcctatgccgccatgaccgagctctcgcaggcgctgtttgcgggtgcggaggctgccgagggcatcgcggctttccgagagcgccgagctgccgcctgggttccactcgggctcgggggcgcacgcacctgagcccggtgcgagccgtggccgcgcgacagtgcagtcgcggcatctcgcgcgccgtcggtggatcgtgatcgcagatcccctcgcgcaagggtctcgtgccttgctcgaaccgcccggtcgtccgcggagacggtggggcgagcgcctggcggtgctggtgcgtgccggcccaggagacttcggctcgatggcgcacggcaagcgggcctcatcacgacgagcagggtccgagaggtccaacggtgggcctctccagcggccatcaccctgtgctgcggcgtcatcacggatcttctggacctcgccgcgggcggcggctaccatatcgtcaccattgcgagcgatgaagggggagatgagggtatgaccacagttccgtccggcgacggggataccgcgtcgggccatccgcggctcaggcacaacgcgctcggcgtcggtgacatcctcggggtgtcgttggccgatacggcgccggccatgagctttttcttttcgttcgccgcgatcgctgcggccgcaggcgtggcttcgccgatcgcgatcgtcgtcgccgcgatcgccgttctgctcaagctcaacagcctggtcgagttcaccaaggtgataccgagtgccgggtcgtacgtgtcctacatcgccaaggcgttcggcggtcgggtgggtgtggtcaccgcgtgggccctcgggttcggctacatcgtcgcggtcggctacgtgatggcggtgatgggtggcttcacctcccaggtgatccagcaatacctgcacgtccacgtgccctggcaaccgatcgcggtcgtcttcgtggtgctcgtgtcctacctcgtctatcgaggcgtcaccatcagtgcacgctgggcaagcgcctcgttcgcgttcgaactcgcgctgatcgtcgtagccatgattgccatcgttgtccactaccacaaccagctctcgctcgtgagcctcgatcccgccaagatctcgcggggcatctcgggtctcgggctcgccttcccgctggcggtgttcctcttcatcggcgtcgggaatccgggtgcgatggtggaggagacgcgtgatgcgcgccggagcgttccgcgagcgatctacacagcggtcatcgttgccaccatcatctacgtcctcatggcggtgacgacgtcgatcgcgttccacaacgatccgacgaccatcggcaaccttgccgcgcccttcgtgacggcggcgagccatgcactcgggccctttgcgatcctcgtctacctggccggcttgaccagcacgttctcgtcgctgctcggggcgacgacggcgcagacacggatcttgttcagcgcggggcgcgacggcatgttgccacgaggtctcgcgcgcctctcctcgcggcaccagaccccggtgagcgcgctcgcggtgtactggatcggggccggggtcatgaccttgatctgggccagcaccggcaacccgctggtgcttgccggtgacatcgccaccctcggaaccatcccgatcgcgctgacctacctcgcgctcaacatcgcactgccggtgtactacctgcgcttccaccgcgaggcgttcgccccgctgcgccatctcgtgatccctgtccttggcgttgcctcgctcatcttgccgctgtggggcctgatcaagcctggtcagccctacccgttcaacgtgttcccctacatcgcactcgcggtgatcgcgatcggtgtggtggtctcgctcgccacgggtcatcgtgtccggccgcttgccgaggcaccgttcgatccgctcgctgaggccaccgactgagatcgcccgagcccagctacgacactgccccggccagacgtggccggggcagtgtcgtgtgatgggtcacggcaggagaacggctcaggcggagcgagcggacccgcgagcctcggagaagagatcgtcgtcgggatcgaggaccccgagcgtgtccgcgatggcctcgacgaggcttgccgcggtctcggaggttgcgccctcaccgagcgtctccgcgatgaccgcacggcgcgcatcgtcgagtgcggcccgagcggttcgccccgcctcggtgagctcgatgacgtccgcgtcggtgcgcacgaggccagcgtcgcggagtcgagcgagcgcgtcggacagatcccagccggctcgcgtcgccatcgtgagcgtgctctgtggcagccgcccatcgcgcgcccggaagagcagccaggtcgccgccggagtcgtgccgagtccggcgtcttgtgcgagtcgtcgatacagccgctcgacaccgccgtcgcgtgagagccgttcgaggacgcggctgatggcgtccttggcgggatcggcttcgggcatggcgaatccctcaccgaggtccgcggccgcgacggagcggcgcaggcgcagctcgggcaggaagagcgtgagcacgaaggccaagaggccgatcggcgctgcgacgaggaagactcggtccagggagcttgcgaacgcgtgcaggagctggggcaggatctgggccgggatggcggtgagtgccttcgggctctcctcggcctgaaccgccaggttggccgggaggtggtagcgggtggcgacggcagcgagcttggagtcgagcgcattggtgaagatcgagccgaagatcgccacgccgaacgaggcgccgatggagcggaagaacgtcgccccagaggttgcgacgccgaggtcttcgtagcccaccgcgttctgcaccgcgatgacgagcacctgcatcacgccgccgatccccaccccgagcacgatcatgtcgaaggcgatgacgccgtaggacgtgtgcacgctgaggcggctcagcagccacagtccgaccgtcatgagggccgtgccgacgatcgggaagaccttgtagcgcccgaatcgactgatgagcaggcctgccccgatgctcatgacgagcaggccggccatgagcggcagcagctggatcccgctgaccgtgggggaggcaccgcgaacgatctgcaagaaggtggggaggaaggtgattgcgccgaacatcgcaaagccgaccacgaacccgatcgcactcgtcatcgagaaggtgcggttgcggaagaggcccatgcgcaagatgggctcggaggcgcgctgctcgacgaggacgaaggcgaccagggcgacggtggatgcgatcgtgagggtgatgatctgccacgaaccccatgggtacgtcaacccaccgagggtcgtgacgaggatgtagccggtcgcggcgagggccacgagcagcgtgccgaggtagtcgacgcgatgctggacgcgcgtggagagctggggcagggcgctcgagatcaccgcgatcgcgatgatgccgatgggcaggttgatgtagaacacccagcgccacgagagcgagtcgacgaagaagccaccgagcaacggtccgacgacgctcgcgaccccgaagatcgcgccgaagagcccctggtacttgccccgatcgcgcggtgacaccacgtcgccgatgatcgcttgcgcgcccacgatgaggccaccgccaccgagtccctggagaccgcggaacagaatcagctccagcatgttctgcgacaggccggagagcgccgaaccgacgaggaagatgaggatcgcgagctggaagaagcgcttgcgtccgtagaggtcgccgagcttgccccacagcggcgtcgaggcggtcgaggcgatgaggtatgccgtgaccacccagctcaggtggctgaagccatgcaggtcgttggcgatggtcgggagtgcggtggcgacgatggtctgatcgagggctgccaccagcatcccgagcaagaggccagtgagaatcagcccaaggcgagcgccgtgggcgcgtaccgtcgacgacggcgagagcgtggtgtcggtcatcgaatcctcctggtggtggtgtcggtcatggtgtggtcgaaggcactctggagatcggctccgaagcgccgaagtaggtgggcgagtgttgcaatgtcatcgtcgttccagtcggcgagcgcgtcgtcgaggaatcgtcgatgtccctcgcggatctgggcgaggtgtgctcgtcccttgtcggtaagggcgatgacctgcgccctgcggtcgttggcgtcactgcgacgcgtgacgtagccgagagcttcgaggctcgcgacgtgccgactggcgaccgagtgcgagaggccaaggtcgctggccacctcgccgaggcgcctgggtccgagcttcgcgagtacgccgaggatcgccagcgcgccaccttcgatctcgaggccgagggcgcgggcgagcggaccggtgtgttggcgcgcgatcctcgagagacgcgacagctcctcccagaccgcgctgacatcggctcgcgtcggagcgacgtcaccggaagcgcgcataatggtcgtcctctcattcatcggcgctcccgtctcctgggatcgtcgacggggcttgctcaataggtgtgtgacgaacacaacaatagacggtgcgtcgatgttcccgaccgcgtgccggcttgtggtccgatcggtgctcgagcgccatcagccagctctccgcgcggacaggcccttgcgtctgctgcagcggtcgcggatcgcggttcgtcaccagggggtcgataggctgccggctggggagcgagggagagccgacggtgtcgtatggagttgttggtccgctgctgcgcaatcgcagggccggaccttcgtcgttgttgtgggcgagcccggaggcacggggccctgagacgctcgtcgtcagctctccggcctttcgcgatggcgagccgctgccagatcgctaccgcggtcgcatggtcgggctgaacgtctcaccgccgcttcggtggtcgacgccacccgcgtcagccgtcgagctcgtcctcgtggtcgaggatccggacgcaccgcggcgccgggcaccggtgcacgcagtcgcacgaggcatcgagccggtgctcgagttcttgcccgaaggcgccctcgctcggccgagttcggtaccgggggtcgtgctcggcaagggactcctcggacagcaggcctgggtgggtccgatgccgctgcgcgcccacggtccgcaccactacacgttccagctcttcgcgctcgacgtccggctcgacctgccaagggtcttcacccgcgacgatgtacgcaccgcgatggacggccacgtcgttgcacggggtcagctggtggggacctacgaacgctgaacccctcggtcggcgcgagcgtggtgcgtcgtgttcggatcacgccgacggggactcgtcgaggcgagtcggtagctgggatcggtagatcgagtcgtcgacggccttgacgatcagccaggcgatcgcgaccgcgatcatcgctggtcccaacaaggcgatggtgccggtcatctccgcgaccatcagcatcaccgcgatcggtgcacgagagatgccgccgaacatcgccatcatgcccactacgacgaaggcggaggcgtcgtggccgatcgctgggacgagcggtgcgaggatgcgccagaccgcaaggccggtgaaggcaccgatgaccatgccgggcccgaacacgccaccggagcctccggtgccgatcgacagcgacgtcgcgacgatgcgagcgatgggcagcaccacgatcacgaggagcggggtgtggagcatctggtcgctgagacccttctggacccatccatagccggtcccgagcacctcggggagccagagggcgaggagaccgacgaggaggccgccgatcgccggacggaagtgtcgagggatcgggagccgtcgagcaaggcgcaccgtgccgtagaacgagcgcgcgtacagcaggccgatggccccggccacgaccccgacgatggcgaaccacacgagggtgagcggcgtcgtgagctcgaagtggccagcgacggcgaacagggggcggaacccgtagacagcgtcgaagatcgccgaggcgatgagcgaggcgagcagccctgggagcagtgcttcgtactcgaagtcgtcgcggtagacgatctcggccgcgagcacggcgccaccgagcggggcgccgaagatggcaccgatcccagacccgatcccgaccgagaccgcgacgcgcccgtcctcggtgccgaggtcgaggactcgagcaagcagcgagccgaagccggcgctgatctgggcggtgggtccctcgcgtccacccgagccacccgatccgatggtcagcgccgaggcgatgatcttgacgacgaccgcgcgcagacggataccccgggggtcgtggaggacggcatcgatggcggcgtccgtcccgtgcccctctgcttcgggtgcgagcgtgaacaccagcatgcccgcgccgatggcgcccagcaccacgctgagggggatcgcccatggccgcgcgtagtggagcgatcctggagcattgccctctccggctggcgtcgggacctgatagccggcgagcacggcgaggaactcatgggtggcgaacgtgagggccgcgtagaagatgacggcgccggccccggcgatgacgccgagcgcgatcgcgaggatcacccgtcgtagcagcgtgggctgccgacgaagccaccgtgacgtctgcgttcggatcgtcatcgccgagatcctcctgatcgacgagcaccgtctcgatgtgcgctcgagcgagggtgccaccgatcgggcgtcgcggctgggtcatcgagtcctctcgtcacgggtgctcctctggttctcgagactggccctgggccaggtgccggtcgcgggctccctcgatcaggaagttcaacgagatcgcgaactgctcgaccgtcgtgaagcgcgcgaggtccgcttccatcgggtcacgcggtacgtgctggttgcggaggcgctcggcgcgcaggacagcgaagccgatggtgtaggtgtggagggcggcgtagacctgatgggctgcctccggcgtgaacccgcccgccgcgagccgcgttgccatcgcgtccatacgggtacgagcgagctgcgtcgcgacgggccgacggaggtagagctcgagaagcggcgggtaggcgaggagcagctccagcagccgcgtggcggcgtcgacgatccagtcgcgccaggggagcgaagggtcaggctcccatcggttcgcgaagagcttgtcgaggagcgcttcgaggagatcgtcgcggtctcggacgtggccgtagatcgtcatcggcgccacgccgagcctgcgggcaagggtgcgcatggtgagcccgctcccgctcggatcggtcgcgagcgactcgagggctgcggcgacgacacgctcccgcgtgagcgcgactcgccgagacgtggtcggtttcgagccggcgccgccgactgctccagcatgcacgacgatcagcctagcgcgtctatccgtacgcgtacggcactggttcaccgagattacgcgccgcgagtggcgaggcgacgagtacggacacggcgcccgtggggcgacactcctgcagccgacgacgggcggtgagccctcgctgtgggtcgatcgtcggcgagactcagtcggatgccgcaggggtcgggttcgtctcgctgggcgatgccatgatgcgacgagatcgacgagcccgcggtcgtgtggaggccgtcgccgcctcggctgcgagagccgcctcccgcgagggtgcgaccatgtcggactcgagctcgtcgaaggagcggatgccgaggagtgccatggtgcgcgtgacgccgtcggcgaggatgcgccctgcgaccgcgacgccgcgctctcccccggccatgaggccatagaggtaggcccgcccgacgagcacgaactgtgctcccaggccgatcgcggccacgacatcggatccggcgcgtacgccgccgtcgacccatacctccacccggccatcgagacgctctcggacgatgggtaggagcgcgaggggcgcgagggttcgatcgagctggcgccccccgtggttggagaccacgatggcgtcgaccccgatcgcagcgaggcgctcggcgtcgtcgatacgctggacgcccttcacgacgatcttgcccgaccacagcgatcgaacccactcgatgtcgtcgaaggtgacggtgggatcgaacatgcggtcgatgaaggagccagcggtcccttcgaagcccgtctcgagcgatgcgaagcgaacgggcggcttggtgagaaaatctcgcgaccacgctggatgcagtgcaccctggaggaacgtccgaagcgagggtgtcggcggcagcgtgaggccgttgcgcacgtcacgcatgcgtgccccggccacggggacgtcgacggtcaggattaatgcctcgaaccccgcctctcgggctcgctcgacgaaggcccgggtcggaccccgatcgcgccagacgtagagctggaaccagcgacgcaggtgcggcagttcggccgcgagttcttccggcgtggtcgtaccgaccgtcgagaggccataggggataccaagagacgctgcgacacgaccgaccgcgagttcgccgtcggtgtgcatcatgcgtgtgaagcccgtcggggcaaagccgaaggggagcgcactcggactgccgaggacggtccaggtcgggtcaaccgagctgacgtcacgcaggacatggggtcggaagacgacgtcggcgaacgagccctcgttgcgaagcatggaccgctccgcttcggcggcgccgtcgacgtagtcgaagaccggccgaggggtacggagcttggcgagacgccgcaggtcgtcgatcgttgcggcccggtccagggtcggcaggagcgtgcgcaggccacctcgtggcttgatgaggtcccagcgctcgcgcagctcgtgcactcgtgtcacgtccacctcccatcgcgtcgcgtgaggatcggtggcgagggcgaccggctccacgaggccgccgatggagtacgccgcacggtgagtcagcgcctcgcctgcagcgcctcgacgatgaagcgccgttcctcgctcccttcgacgaagaactcggcgacgggatgataggtgtccgccgttcgcacgatgcgctcggcgacctcgcagcgtcggagcagttctccaatgccgagagtgtccaggatggcccgcggatcgctgacattggcgcagccatgagccgccagaagttcggcgagcgtcgcgctcagggtttcgaggccctcgtcgatggatggcgcgtgcgcgctgtcgtagtcagccatggacacctccgcctcgctggtgagtgtagctcggtcctctgctgggtgctggacggccaggtggacgcacacaatcccgcgaccggccgaagtctcggagtacttcgtcgtggctgcagggatcgatgatcgcgcgccgtgcaacctgcgcagtgtggctcgcgtcgatcaggtcggaagcgctcgcccgcgcgaacgggtccgtcgaggcgaccggggagcgaggagtcgttccgggtcgaacgtgcgcgcgagcaccgcgaggccgacgatctcgacgaggaggagcgcacctgcgagtgcaacgccgtcggccacgctcaggctgataactccttgcacgagtaagacgatcacgaggaggaccgggacggacgcaagcgccgagagctgctgtgccacgcgaacatcactcgcacgactggatgcgaacagtccaaccagcaccgcccaaccgctgagcagcacatcgaggccgagttgacgcacgacgaggggagcggtgatgagatgggcactgaccgatgcggcggctgcgaagtgaacgacgacgagggtgagcgcgtacaggccccacgatccgatgaacgtcggcgcgaggacggcgagcagcttggcgacgtagagttcggtcgcgctgaggggggagctgagcagcggctcgagcgtcccctgatcccgctcgccgacgatggcaaagcccgccagcacgcccgggagcacgagcggggggagcaggaactcgatgctgctcgccgtcgtcaccttgtcgaggagggacatgggggcagcttccggcagcgaggtcagggagagcaccggcgcgaccagcgaaatgaggggcagagcgaccatgctgtagagcacgtagcggttccgacgaaagtcggtgaactccttggcgatgaccgcccgtatccgccaccacgtcatcgatcgctctccttggtttcgcccccgacaagctcgaggtagacctcttccaagcgctctcgggggcttgcgagctcgaggaggcggtcaccggcgtggaccagcgcctccgcgacgactggtgccagctcgtccggctcagctccgtcgatgcgcaacgtgtgttcgtcggtgacgacgacatgggcggcctcgacgacgggtgcgagatgcgccttggcgtcctctgcggcacctccgacgcggacgacgagggaccgctgactcccgagtccgagttcccctggcttgccgacagcgaggagacgctgacgaaggatcgcgacgcgatcgcacacccgttccgcctcatcgagccgatgcgtcgtgatgagtacggtgcggccctgggctcgcagactggcaatgagttcgagaacatcgcgggctgcgaccgggtcgagaccggacgtgggttcgtcgaggaagatcagttccggctggccgaggagcgtacgagcgatggcgacgcgctgacggagacccttcgacagggcgcgacaggcatcgtcgcgtcgactcgagagatcgaccgcgtcgagggcctcacgaatggcgcggtcgacgtcgtggactccgtagagccgtgcgaacaggcgcaggttctcgacgacgctgaggttgccgtagaggcctggagcctccggcatcaccgcgatccggcgtcggatctcgggcccgttggaggcctcgaggtcgataccgagcacacgcgcgcgcccctcgctggggcgcaccagggtcgcacaggtccgtaccagcgtggtcttcccagcgccgttcggccccaagagtccgaagacctcgccgcgatcgactcgaagggtcacgctctcgaaggcgacgcgatcgccgaagcgcttcgtgagaccatcaagctcgagtgcagggtgagcgtgagagtctccagcactccagtcggcgctcgtcgccgagagagcgtggtcgggcatgacctcgaacactaccagctgtcgtgatcctcatcatgccccggacgcggtgagacgaggaacatcgcgacacgtgctgactgaacacgtccgcgaagaccgtcgtgccctactcggaaccaacaccggatgctgcgcgccagcgcgtcttcgttcacctgagtgtggggcatactgacgaggaccatgctcgaggatcgtgagcacgatgtccggctccgggtggtccgcctcgccgccgcgtcgttcgtgttcgcgggcgacatctggcaagttgtcgcgacgggacgcggctgacacctctggttgaggagcctcgtcgtcggctctctccttgtgggactgacggcaccctgcaacgatcccacccggtgtgtgacgatcccgatcagccagaccgcacgggagggagaccacctgatgggagcacgcgccacacaggcgaaggtcacgcttgtgctggcaccaaccacgccgaagccgtcgctgccgttgacaggaaggctgaggcggtagcgccgaggccagcaggttctggtggagggaggatcgtgagctcgcgatgcaaggcgcccgacggtgtgagcgcgacgatcctcgtgatcgaggggaggggcggcgaggccagggtgagagcgagcaagcagccgtcgtggttgcacgcgagggcggcgttgatcggcagtgccgaggctggtgccgcgaggcggagctggtgcaccgcgaagcctgatcccgtgacggtgccggtgtacacgagtgccgacaggcccgtgcgcggctggaggttacttgcgctgacgacgccgacgcacccggtgtcgtggcaggacagggcggtcgctgggtcatcggcgagggccctgggttcagggccgcgcacggtcatgagatgccagatgcggccgccgtcgcggctctccgcgatggcgggggcgatggaaccgtagccgagagcgaaatcgtgctcggcgatcgccacgcaggacaaccccgtcgggcatgcgatcgaaagcaccgagaggtcgttcggggcgttggtgatggtcgctcgctcgaaggtcgtcccggcgttgtcggtgacgagcaccgggaagccgtggtggtggcttatgcccgcgactgccaccacgcagtggcgtgcgcttgcgcacgcgagtccctgggccagcgtcccacgagggagggtatggtccgccacgacatggccgtgctcgagctcgacgaggaacgtcggaccattgatcgatccggtgagcaggtcgcagacggtcgtcgttgggcacgagagtgcgatgggcgagagcagtacggccgcgttggggagctgtagcacctctctcatgctcgggcgtgtcgcgagggagttgaagccgaggagctgcggaccacgtgctgcctcgagcacctcgaagcagatcgattgcacacaggaggtcaggctcgcaggtgatgggttcatcccgagctgctgaccgaggctgatcgaggaaccgacggcgagacggttgccgcgaggtgcgacgtggataatgacggccggtccggcgctgcccggggttgcggtcgcgatgcactcagtcgcaccctgcgtgcagaacaggctgagctcctcagcggccgggctcgatggcagcgtgagcgcgcgaggacgaggtccgagctggaacaccacggacgtggtcttcgtggcacccgagagctgggcgagacagaaggagctcgagcacgccagaccgcgcagcgcggaggtcgacgatggtgcggagatcgtcacggcggtcgcgtgtgctgcggtgagctcggttgcctggaccgctccgctcgaggtgaccgggttcgcgacgaaccagcagttcgctgggtcgcagctcgcttggagtccgaaggcgttcgggctcgggtgggcgagcaccgtcgcaaagcccttcgagagcgagccctcgtaggccccgctctcgaaggggccgttcgtgttggccgtgggagtcgccccttgcgggggagggagcgtcgagaccacgtcgacgcacaaggaggcgttggcgcaggcgatcgagttgcgctctgccggcgcgatgtcggggagctggagcggttcccagggtgcagcagaggtgaggcggacgtagccggcggtggtgccgtcacgcgtaccagtggtccagcagggtccggaagggatgcaacccagtgtggatggttcgtagccggctgcgaccgcgacgctctggagaccgacgctgtcggcagtatcggtctcgaagagctggcccgtgccggagttctcgagtgggggctcggcgaggacgtagcagacccggggactctggcaggcggtcgcgggaacgaaggcgtcggacgggagcgaaatgggggagaaggtgaggcttgcgttcgtgcttgcccagaggctgctcgccccctgcgcgttcgatgtggcgagaaggcaggtcgatccggcgcacgagtactgcctcgagagccctggagtactgacgctctgcccctcgccgaccgcgatcgggatggctcgcaggttcgtcggcagggaagcggcgccggccgggggagccgggcgcgacgacgtcgaggcgatgacgacagcgagcgttcctcccacgaggacgatgacgagggccgggacgacgagtgggccggtacgagcggagcgcgccatggtgggattctacatcacgttgtcgacacggaaagggctgtcgcccggcaacggtgcgagcgtgaacccgtaggaacagctggtgggcgcgatgtcgagcgacgacctcgttggggaccggtcgagtgcacggcgctcctcagggagctgtcgtgccgacactctctgaaccacccccaagtttcgtgcacacctcgtgacgtgtgaacggtctcggactcggccgccagatggccatcgtactcctgttcgacctcgacgggcggacgacgtcccagccggtgcgtgagcctgcgcgtgctggagcggtgcacccaggctgaggtcgtctcctcgaggtccgtgaggctcacgaggggcccgcgcgcgcagggtgagccaggccacacgcactcggttgtggagagaccgatcgtggtctcggcgagcgcgttgtcatagccatccccgacagagccgatcgagggcaccaggcccggcagcaggagcgatttgccaacgtgaagcgccgagtgggtttggcctgcatcttgcgtgatggatcgtgcgttcggttgcgggggtgcccctcgtgtgctcgtcggccctcggccatgcgcagggcacgctcgacgagtcgggtgtcgtggcaaagcacgagacccaccccctttgagatcgtgccggcgaaggcgtcgatcacgaaggccgtggtggcacgccacccgtgagccggacgcaggtgacgtccgccgcgcacagctcgttatggggccccctggtgggggacccggtgctcgcgacggccatcctggaccgcttgctccaccacgccacggtcctgaacatccgaggcgagagctaccgcctgaaggaccgcaccaagcaacggctccgcggtgggctgctgccccaggcagccgaggccatggcgaagggaggtgatgccgagcaccacgctctggggagctatcccctatagttgtgtcgcaggtgggtcacttctgaccggtgatctcgggtcaaaagaaggccggtgcctacaatcggcacccggcgagatcagcgagcggtagcgtgaggacgtcgggtctcacattgagggtggactcggttgtgggggccggtcacatggcatcgagctttctcgggcatctatcgaacaacgatcacctccaggtcatgcgccatcctgcgcagcagcacaacgtcaacgtcatcgagtcgctcatccgtcgtcttcgtcaatgccgcaccttcgaccagtacgacgacgttcagcgcgagctgttccagcacctacactgccgcgaacagcaccgttccgactgccgacgctgtgctgctcgacttcagcggggacgatctcttcccgcattactcccgcagctccctctcggtgtagacccactcgacccagagacctggcgcatcgaggacctcgtcttcgatcgcgtatgtcgccagctccgagcggtcggcgacgcactcgcgtggcgggcatcgggctacgaccgccggtacgtcatcgcgctgagcagcaacgcctccccgggggtcatggcgggaaagactggcctgcctgctgaacttggtgctgcgaccgagcttcgcaagagagggagcttcgctctcctccacgatctcacgaactgcctgcgcatcggggacatcacggagttcaagtcggatggttcgaagctcctctacgaaatcaagtcaagtcccacggcgaagaaaggaccacaacgcagacgcatggaggccgctgtcgaagccgttatgaccggcggcgagcttcccggacgaccgggacaacggatcgtgagcccgacccagcgctgcggaacgcacatccgtgcgttcgtaaccggcatcgacgaggccgtccgccgaggtatcgccggggccgccatttcggatgcccgtgcattgactgccttctcgtttcccacgctcgcgcagactcgatcgaacgattcggcacggcagcttctcgacgatttccatgctgagcgccagagcgcgatcgaacgtgcgggaatcgccaatgttttgcatcacgtaacggtcgcaagcgcaacgcgcaatcacgacttcgttccctctgtgatgcccttcgcgctctttcccctgccacccatccaggccgctctcctcatctgcgactacatcggcttcagcattaccgtcgcgccggagcgaatcgccgatcactttgagcgcctggggttcactgccgacattccgcttgtcacggccaacgacagccttgtcgccactgacacgatcatcaacgtgcgacggggctcccggggtatccggctgcacccaggtgccctctacgaactcctcatcgagtgcctcgacctcggatcgtgggctacggccattgctgaagttgtcgatgactcggacgctccgccccatcccgtgcttgctttcttgacgactcgtgtttggcgctgaggcccacgccagaggggtcgaccaaagcctttccccgacttgaccctcggtgactgtaagcagcgggctggccttcccccctccaggttgacacctgctataggaggaagggatgagccagacaccgaatccaccaccgggcgaggcccccgttcgtcgatgacgaggccgttacccgagccagttcctcaaaggacgccgcagcgttggtgctcgaccagtaccgcaccatcgctgacgtcgctcgcgaacttggcatcaacgagcagacccttgggaactgggtgcgtcaggaacgcatcgaccgaggtgagcgagaaggcctgacgagcgccgagcgcgaggagatgacccgcctgcgccgccaggtcaagcagctcaccatagaacgagacctggcgaaacgttgcctggcctttgcggatcctgcgagggcaaccagtgacccgctaccgctgggttgccaaccaggaggccgagggcgtcccagtagcggcggcgtgccgagtagcgatggtctcccgccaggcgtactacgcctggcgacgctggcgcgagcgcggccctgaccacgagcacctggtgctcacgagcgagcttcgcgccatctgggaggcgagcgacggcacctacggcagcccccgcatcacccacgagctgcgacgacgtggttactgcgtcaaccacaagcgggtggaacgcctgatgcgcgagctcgagatagccgcctgcccacgccggcgcttcgtagccacgacgaggcggggagaggacgcagcgctcctggacctcgtccgtcaggacttcgctcttggtgagccgaagcgcaggtatgtgagcgacatcaccgacgtccgaagcgacgaggggttctgctacctcgccacggtggcagatcttggctcgaggcgcatcgtgggctggtcgctccagcgtcacatgcccgatgacctggtggtcgaggcgatctgcggagctcttcggacccggggcagcctggcaggggcgctcttccacagcgatcgcggtagccagtacctctcccggaaggttcgccagctctgcgcaatgctcgggcttcgccagtcggtgggcagggtcgcgacctgctacgacaacgccgtggccgaggccttcttcgggagcctgaagcgcgagctggtggctcgctaccgcttcgcgaacctcgccccgaggctcgctctgccatcgctacctggatccaccgctacaacacggtccgcctgcactcgagcctcgggtacgtgccgcccgtcgagtacgagctctcctgggcctgccgggaggtggccgtggcctacattcagactgtcaagcaaatggggggaagcccatgacctctcctggctgacggctggagggaaatcgcggacgccgaattcgtggctgcgttcacgaacccttccgtccccatgaagctttgcacccagaccattgtcgaagagcgcaacctctgggtcgagaccagcgacatgctcgctctgggccggctgctcgcagagagcggccaggttgccatctcattgtcggggcatgctcgacgggcgcctcctgggcggatctccacggtggcaagcgctccgtcccacacgatggcaagctggccttggtgagcgtcggcatctcgggacagctcagtcagcctgagcacctcgccagcttgcgcttactcctggccgggtcgaggtcccacggttcgcagacacctcggtggtgccgacgatctcttacgatcccaccagcgcggcgtcgccagcgatcggggaggtgccggccagctccacgaacagacgctcggatcggcggccaatggtcgggaaggggcgcggccacgacaagcaccctcgttgggtggggctggccacgtcctcggtccacctcactccacgaagagtgcctcggcgttgagctcgcggaggatgccttcgaggtcgtcggcagtgggacggaaagggaagtcgcggaacggctcgctggctcggtaggacccgtagggccgggtgcacccaggggagccgtcctcgcctgggcagccgttggtcatgaaagccagcccctcgttggcgacgcgcaagagggtgtcgcgctgaaccgctcgcaccgcgacgaggctccctgcgtcgtcgaacgagaagtcctcgaccccgaaaccgtcgtgctcgatgaggtgtttggcgagctggatccgacgccaacgggtaatcgaggtcttcggcacggcccccatccgggagtcgggctcgggattgaagcagaagagatacggaaggatctgtcggtcgaggagccggacgaagagctcgatcagatcacggtctcgttccccgaggcctaccaccgtgtgacagttcactttccatggaccgaagagctctcgggcatcgtcgacgacctgccaatacttggcccaggacagtccagcgcctccagcggggacatcggttcgcagcgagcggaagagttgttcggtcacggcgtcgaggccgatgccgatcatgtccacccccagcctgcgaaagcgctcgagcttgcgacggttcagtgtcggtggggcaacgaggatggagaggggggtgcggacgcgcgctcggatgcgctcggtgatctcgcacgtgtcctcgaaggcgtagggagaggtcaccatggagatgcacagacgggtcaggcgtcgctcgagcatcgccatgcgctccacaaggtcgtctgtgcgcacgaggggccactccactctgatgaacgacttgtcctcgtagtcgccggggcgggtccgcgcgaggccgcagtagccgcagtcgctccggcagccgtccccgtaattgagcaagaggttgatcccgccgaaggcgaagtctctgctgaagcgaccggagcggaacccgagtgcgatcgccgaggcggccgagatccgcacccactccgggctctcgtgctcacccagcgtccgtcgtcggcgcagggcgaggggcgtcgaggtggtcatgaatgtctcctttctgggagtaggcaggatccgagtcggtggggggcggcgagcgggctgaggctcgcgtggaaggcttccgtgatgcgtcgaggcggagcgaggtggccaagcacgtcgcacgctcgatccgcgaggtagctcgggtcggcgggctcgaaacgcagcgcccgggtgagcgtgatcagccgggcatcaacttcgagaaagtccccggagacctgcacggagctcaccactccaccccgaacgtcgaggtgcagttcgacggtcccgatggccgttcgcagggtcacccgagtcgcgctcggctcgtgagccgagctaccgtggatccagtcccgatcggcgtaggtcgagatctcgaggtcacgtgccagcatgagctcctcggcgcgcggcgcgctctggacccatcgtgaccgaccaaggcccatcgcgaccgcgtcggccaccacggtgacgaggtccgcgccgcaccaggcctccccacggagctcgctgacggtgacgacggagcgtgcgagtagcttggcgcgcttgtcggcaagcttggcggcgggtgggcgtaggacctcgaggaggaggcgatggtcgaggtcggcgaggatcgaagcgtggcagagggtgcccccacgcgcaggtcgatacatccccagaccggcgatcttgcgcccatccacgagcaggtcgttcttgccctcgagggtcgcccgcaggccgatggtttcgagtgcgccgatgaggagccgggcgaacgccgtcagaacttcccgaggggtcgcacgccgctcgggcagggccaatgccacgccaagctgggcatctcccatgaggatggtgccaccgccagtaggtctgcgcccaaggtcgagccccaggcgctcgacggtgacgaggtcgacctcggccgcagcgcgctggtggcgaccgacgaggaccgtatggttacggtacgtgtagcagcgcaggaccggctcgtcgacggcgcactggacgagcgcatcgtcgagggcgagaccctcggcggcaccgacgccgtggtcgaggatgacgcgaagcgagctcacgacacgcgcaccgtggtgaggtcgtcgtcgacgcctgcccagctcatcgagcaacaccactcgtggagcaccggggtgagcccctgctcgcgggcgtaggcgatggtgccctcggcagggtacgcgatgcctgcgaagccgaggtcgacggccgctcggtcgagggcgaccttcgtggtgcccatgggtcgggcgcaccccaggttcgtgcgcagcgagggcaccagcgttcgtgcagcccggaagacctcgaccgtcgcctcgagggatggcggcgggaggtgtcccatcggcgttcccacgagcggtgtgagcaccacaaggatgagggtgtctacccggtgcctcgcgatgagctcaagggcgcgatactccccgaggatgcgaccgtagtgcaggccgatgaccacatgcgggatcactcggaggccggtgtcgtccaagagaccgagggctcgatcgaagtcgtcgacgctcagatcgaggtgatagacctcacgtatggtggcgtcggcgccgatgatgtcgagcatgacggcatccacccccgcgtcggcgagttgggcagcgaggggaggcgtgacgactccggtgtgcaccacgacccgcatgtcgagctcgtctcggatgcgtggcacccaggggaggtgacgcgcgagcggcacgaagccccgcttggtggagccacccgatacgaggatgccctgagatcccgcggccttgagcctacgtgccacatcgaagaggttcgagcccagaccgaccgacaccatcccgtcgaggaccttggacccgcagtgatcacaattgagcgcgcacgccgagccggtcacggacaccggcaggaaccgtctcgggttcgtcgggcgccactccttcgtgctccaatgcttgaggccaggagcgtagaactcgatggtgcgcggttccgacgctgcgtcgtctactgtgcccacggcaggatccactaccacgccagcaccccggccgcacgaaacgcctcgacgcgcttggtgaagtcctcaagcgcctcgtcgggggtgacgaggtgatcgagcgcgcccggctcggttgccatctcgacgagccacgcctcgtagcatcccgcgtagagctgcgtgacgtcgcgaacgaggtggtcattcgtcctcaagatcgttccggcgagaggtgccgcgagtgccccgacgtacttctcggcctcgagtgagccgatggggtcaccctccaccacccggcacgggggctcgaccagtgtcagctgcgccagggtgccgttcacctcgagtcccagcgcgtcgagaccgacgcgcacgatatcgtcgccgaccggcaacgcccagaggttcgtatcgtggtggtagaagcggtcgctacgaacctcaaagccgcggtaaacgtgtgacgtcatcaactcctcctcttcggtatgtccgatcgtcctcgtctccgaggctggcgccgacggaggcgaggagcatggcgagagaacggtcgcgctcgatccttcgccgcaggagcgctggatcggtcacggccgagccctcctcgtggcgcaggcgcgtgaggcgtccttcctccaccaggagcacgcaacgccgaccctcgtgttccaggtcgtggagccacacccccgctcgaatcttgacgctacgtcgtgccgagttgggggctccacggacccagccatcattgtcctcgtcgacgagcgatcgatagcgagcgatgaggtcttggtcgagttcgaggatcccgggccgggggtcaccgaggatctcggccagttcttgcaccagactggcaacgaaatcttcggggtcgaccacgagcgcccgagatggaccgacgtgacggcgcatcgccgcgacggcctcctcacgtgcaatcctcgacagggagaggatgccggcggctgcctctggatcgaaggcttcgagcaggtttccgacgacgaccagactcgcggcgatctcaccggacccatgaccacagaccttgcgaccctgacagctgatctctccgtggccatcgagcacggtctccagcccgagacgcctccaacttcgggcgactcgctcgaggatccacgcagcgaacttcgggcctcgaacggccgctacgacgtggtctcggggcaggatgacctggaaaaagcgttggcgctggtcgagccagaccgggcccccaccaacccggcggcgtacgacggggaccctgcgcgcctggatctcgccccagtcgagctcctctctatgccggtggtagccgagggagacgtacgcggagcgcggtcgtgcgacgagcagcgtcggccgttcacagcgatgggcgaaggcgtgccagatggcatgggagtccactggttcgaggtcgccgagatcgaggacgtcgaggcagcttcgacgcacgaacgctcgggtccgactcccgtcagcgacgggtctacgaaccccgtccgacacgttccccccttcggacgcgacgtcaccacccctcggtgacgaccatgtgagtcatcaagtgcgcatatgcgcatgcgactcccgtagcgtacttgaggcgccacagcgggtgcaaggattttcacgaatcaaggggggtgtaccggtgccaaatcgagccgttgaggatcgttgggcggtcgtgacgggtgcctcgtccgtcatcggattagaggtcgcacggtcattgagcgagatcgggtactcgctcatcctccagggtgcgcgccacgccaacgcgctcgagctccttgcagacgagctggggtcgcgcgggcgtaggcccgtcgtggtacgcgcgaacctcgccagcgagcggggcgtcgaccacctcatggccaccatccgagagcgcacctcgcacctcgacgcgctgtgctggctcgctgcggctggggtcatgcgaccggtgagcgcactcagtctgcaccacctggagtggacgttccgcgtgacggcggggtcgttcgcggtcgtaactgcgggcttgcggccgcgagtgagcatcgccgtctcgtcgctcggctcccagcgcatcgcccccgagtacgccgccatcggcgccgcgaagtcggccctggaaacgctagtcaggtatctcgccgtagaactcgcgccagcctccagtgtcttcgggctgagggttggcctcatcgacacgccggccgcacgacgtctcagccgctacgaggagctcgaggcgctcctgcgaaggcgcgcgcccatggggaggctcgtgacaccagaggacgttgcggctgcggtcgtgaccatggtcacggagatgtcgagcatggcaagcgggtcgttcctcaccgttgacggcggagtcgggcttgtgctgtaagctcgtccgcgtcgtggcctgacgaccacccggatatgactgcgccctgccactgagagtgctccgagcgacaggcccgcgacctaggtcgagaacgccgaaccgatggggttcggatgcgccggggcggtatcgcgctggcgtcagctcgttcattggtgaaccgcgctctgcgtcccggcgcgagccaacggagcccgcttgactcgtgtgtcggatccacccaccgtgaccgcgcgtaggggcgaacacaaagtcatcctgttcgcggcgacggcgcccggccaaccagtgggggccacgctgtggcccatggcagtccgcccaggcgtcgccacgctcggtcgccgtcgcgcactgttatagtccgaacctcgcgggcagccacgatgaaggtgcacactcgagcgctggcgccgagaagcggtattctgtcaagttctggcgaggactgagatgcccgacactccgtcgagggtactgctacgattccccgcgtgcggaggctgcgaacgtcggttgggatcgtgcttcgagggttgcgatggcgcctcgcaacgaccgtgatgctggtggtcacgggaaccttggcggtcgcgacggtgatactcgcaccgctctacataccttcggccaaggatgcgctcgtcgtcagcgtcgtgcgtgcgacctcgctccagcaagatggtctgcagctcaatggcttcggcctcagcgacgattcgcgggctgcgctcgaacgcctgttcgcccgggccccacggctcgaccatcgaccgctgttcggttcgccgcttgcgacggcgttcatgaccgtatcgctgccctcactcaagatcccgtcacgaacgccagggggtgtggcgcagtccgtggtgcagaccacggcgctactcgagaggaccgcaatctgctcgcacctgaggttcgtcgcgggtacctgtccgcgacgcggatctcagggcgtcgcggtctcgacgagggacgcggctgcactgcatctgcacgtcggatccaacgtcaccttcgctgctggtgccatcgcgcccggaacccccggagccctgccatcggtgaaggctccggtcgtgggcatctatgacccgccgaccaccctcagcgcctactggtggggcacgcagtatttcgatttcagctccacgccgaccggcaacgtctatgacccctttgtcgtcgcccctggttacttcgacgggattgcgattcccggtccaccggtcgtcctccgcggtcacggcacggcaacgagtccggcattcgtcgtcggctcgcagtatcgctacctggtcgcactctcgtcgagcgggtcgcccggaggggtcttcttcgcagcgaactcgttgctgggccgcaccttgcaggccccgctcgcagcaccgcagcgcatcacgaacacgaccgctccgggtctcttgcggtcgatatcgggctacctcgactcggtgaacaagcatgcagcgctgaacgtcgtgggttcccaaggcttcgggccattgcccgtcgccgcgtcgtcgctgccgggaaccctcaccaaggcgctcgctcaccagcacagcttctcgacgatctccatcgtcgtcgtggtcgagatgctggcgatcggcgaactggtgctcagcgctgtgatcgcacggtcgatcttggcgcgcgatcccgagctgcgtctcgcacagttgcggggcctcggaacgaggcgtatcgttcagagggcgatcgcagagccactcgtcgccatcgtcctcacgattccgctcggcacggcggttggggtcggcgtcatgcatctcgtcgcgagtcgcgtcttgcccagcggcgtcaccgtcactcttacgacgacagccgtgttgacggcggtcggcacggccgtcgtcggcctgctcaccacggcggtcatcatcatgattgcggttcgacgcggcgtcgtcgaggctccgcgtgccacacagcggcgccgcgtcgtgttccgagtggcgctcgacgtggcactgctcgcgatcgccgcgacgggaaccttcgaactcgtcacggcgatctccgcctccagcggcattgcacctctcgcggccggcgcccccgcgctcttggcgctcggactctctgtcatcgctgcatggctcctcaccatcacagctcggctggtcgctcgtctcacgcgctccctgaaacgcccctcggtctacgtcgccacgcgtcagttacgccagcgcgccagtgcgctgcaccgtgccctggtcgttgggcttgccatcggactcgtcacgttcggcatcggcctcgacgacgtgggaaactcgctggcgcgaaccggtgctgcggtcacgaacggcgctaccgaggtggccgaggtgaccctgccaccatccttgacgatcgccgaagccgtcgatcgcgccgatccttcgggccacgaggcgatggcggcgcagcgagtgtcaactcctgccggtacgacactggcgatccaagcgcggcgtgcgccggggatcttgacgtggtccccgacgctgggcctgcacccggcgctcgcgcaggtggtccagggacttgacccacggtccgctggcggctttcctgtccgcggtcgtcgcgtcgctgtgacggtggagatctccctcacgaaggcccaggcagcacagctggagcgatcctcagcaggcaccgtcacgcccgcaacgctcggcgtatccactgtcaccatggagatcaccacaccgacccccgcgggtctcatcgagtccgtcggtgtgctgtcgggggccgggaaggcggtgacggtgagcgcgaatgtcccgaccgcgtgccgcagcggaggttgtgacctcgtgggtatcagcttctccttggcccagacgttcaccaacttcgagatctccatccttggagtgagcgggattgcgccgtcgcctggcggtccggtactcgcagcgagttcctggcgcgcgagtggggcactccatcgcgcatcacgacctgcgagctggaccgttgccccgtcccaaggtgccctcgacctggtaccacgctcgctaccgccgaccatcccggccatcacgaccgacctaccaccgggacaagccacggctcagatcgtgggcctcgacagctcgaccatcaccgcgacgcccatcgcccaggagcatgccctgccggtcctcggcgcgagcggcgccatcgtcgacctgcggctcgccgagcagtacctccaggcaaccgaccatgcgcaatcgctcgtcttcctcggcccgcgggacccatccgcggtcctccgctcactcgcggccgaaggggcccacgtcgggccaatcacgacggtcgcccagatcgtcaccgccgcacgcaccagtccgacggcgctcgcccaagacctcgtcctcccggcgggcatcgcggcggcggtcctggtcgcagccggcctgctcttcgagaccgtgaccgacgggcgcgcccgaatcgccgagctcgcggcgcttcgggtactcggcatgcgccggagccagctcgtcaccgcgctcgtgctcgagggcatcgctgtcgttgtgctcggtgccgtggtcggcgtcgtcgcaggtgtcgtcggcgcgcacttcgtcttgccacatgtgctaccgccgccaaccacgctcgccgcatccttcgtcattccctactctcttccaacggccccccttgcacgagctgcgctgctcgtcgtgatcctggggggagcagccgtgctcgcaagcgccgtgcgcgtggtcgcccgggcctcgttcgaacagctgcgagctggtgagcgatgactgatcagcttggcggactccccctccggctcgagggcgtggtgcacctctaccccatccccggaggagacgtcgttgcactgcgcggcgtcgacctacgcatccaagcgggcgagatcgtcggactgctcggaccatctggcatgggcaagtcgacgctgcttcgcctccttgcggccctctaccctccttctgccggtcgcatctggattggtgataccgacatcgcccaactcggaccccgagggcgtcgcaagctgcgcggccggaccgtgtccctcgtcctgcagggtccggcggtcaacctcttgccctatgcgaccgttgagcagaacctcgctttcgcggcacgcgatcgcgcctctcgacaccgcgtcggtggcctgttggaactcttcgggcttggacccctccgtcatcgcgtcgtggccacgctctcaggaggccagcagcaacgtgccgccatcgcgacggcgctcgtgcccgggccgcgtgtgctgcttgccgacgagccaaccagccagctcgatcacgaggcgcgcgacgacgtcgtgcgagccctgttcgatgtgcaacgcaacctcggggcgacggtggtgatggtgacgcacgacccggtcgtcgcgagagagctgccgaggctgctcacgatacgcgatggccgtgtcggcgcagagggtcgctcaggcgaggagttcgctgtcctcggcgaggacggtacgatccagcttccccctcacgttcgcgcgatgattccgcctcactcgctcctgcgcgtccgcgtgatcgacgagggattcttgctcgagccggctgaccatgtgtccgaccaaggagatggcctgtgagcgagcccttcgagctcgtcctcgagccgatcgtggtgcgacgggggcgaggatccatcctcgagcttcccgaacttgcgctcgcatccggtgagctcacggcgatcatcggaccgtcggggtctgggaagaccacgctcctccacgtcctcgcacgcattctcgaacccgacgaggggcgcgtcctctggcgcgatgcacacggcgatcaccgactgcgccgccgccagagcgtcctcgtaccgcaagcattcggactggttgctgcgctcaccgtcgcagagaacatcgcgctggcgctcaagctccgcggtgaacgcgcctcggatcgttccccgctggtacgagacgcgctcgcctcggtcgggctcgacgggctggcgaaccgactggtcggtgagttgtcgggcggccagcagcagcgtgttgcggtcgcccgagcattggccgtcgacagccctatcctgatcgccgacgagccgaccagcgagctcgaccccgacaaccgtgcgctcgtgctcgatctccttctcgagcgagcgcgcagcggtccactcgtcgtcctggcttcccatgatccgctcgtcgccgagcgtgcccaccgaacactggaactcgccgagggtcgactcgtcgacgatcgctggacccccgagagccaacgcaacggaagccctgagcagccgtgatgtgtcaggccgctggcgtcgccggctcgacttcgggatcggctgctcggcggccccgcccacgcgacagtgacaacaacgcggcaatggcgatgaacaccatcgaggtgtagaaggcggcgtgcagaccgtgcgtgaagacgtctgccaagtgtccgctgagcttggtggtgccgacgaagatcgcgaatgcgagccctcgcgggatggaacgtgccgcagaaaggatggcgacggagaaggagaagaccatcccgatgttcgagaacgtccggagcatgcccgaggcgatgccgaacacttcggggggagcagctttcatgacggccgagttgttcgcggggaagaagctcgagccgccgatgccgttgatgatgctcgcgacgacgacgagcgccagcgtgacatcgttgctgagctgtgcgtagacgaacagcgcgatcacctgcacggcgaggccgacggtcgcagggatgactgggccgacacggtccgcgagtcgccccgcaaacggaccgacgacaccgcccaggagatagcccggtacgagcagcaaggaagcgtcgagagcgctcaggccccgcggtccttgcaggtacatgatcacgaggaagagaactgcgtagttcccgagggcctgaaacgtcgctgccaggagcgacggtgtcatcgtcgggatgcgaaagatgcgcaggttcaccatcggctcgggatggcgtagctcgatcaggacgaagacgccgaggatgacgagtccgccgacgaagaacgcgacgatgtgggagtcgagcggccgcgtcgcgagttgcgtcactgcccagagcagcccgaagatcccggcgccgagcgtgagcatgcccccgatgtcgaaacggtggtgccgtgaggtcgcttcgttgtggagcacacgcgtcgcgagggccacggcgacgatgccgatcgggacgttgatccagaagatccaccgccacgagacataggtgacgatgaccccgcccaacacgatcccgaggaccgcacccaggctccaccccactgcgttgaagccataggcccgaccccggcgatgaggcgggaagatgtcagcgatgacggcaccggagttggccgacacgagtgcgcccccgacaccctggagcactcggaatccgatgatcgctgcttcgttccaagacagcgcgcacaaggcggaaccgacgacgaagaccacgaaccctgcttcgtacatgcgcacacgtccgaagaggtcgccgagcttaccgacctgggtggcgagcagcgtgatcgtcaagaggtacccgatcacgacccaaatcaccgaactcagggccacgtgcagcgcacgctggatctccggcaaggcgagcaccacgatggtggtgtccaccgcagcgatgagcacgccggccatgatgaccgccaaggcgagctgcgggtgatcggtcacggacgagtggtaggacgcatcatcagtgcgagtagccatggctctccccggtcgaaggctcgtcgaagcttgctagttccaaccttatcgacgagtcgggtgttcccgtctcagaatctgcgatgcgtcgaggacgggggcgagcggtaggcttcgtagctgctgtggcgggtagttcaattggcagaacgcctgactttggatcaggaggctccaggttcgagccctggcccgccagccatcgccgttcctctcgacgcgctctgcgtggagctgtccggccttcgaacggcctttgggtcgccgacgttccccacgtgagactgagcgcctcgggccgaccgctgtggtagcaaggcgcacccgacgaatcatgagcatggctcgatcacccgctgccgcgacggcgaccgaacccgactccgccggcacgaacgcatcgggaacgtgagcagccgaatccatgtgaccacgcgccgccagaaccccgacgttgccatcgttgccgcttgacccagcgcttgcaggagtcgaccgttcttcctcgcattcgccaggtcgtgcagagcgtcccttcggctggaagatcatcgggaatcgccaacggcctgcgcaccgctgatcccgccacgaacacccgagccgtgcgtcaaccgagccgaggggccacggcatggtccatgtgtgaagccggggcgctccgtgtcgccagtcgtgacgaacgtgtgccgatcgctgctctcggccactcgcgagccgcggaacgcgacgcggcgaagcgcacgcgctgggttggagcaacgtcgaccgcaacgctcgcacagtggccgtcacaagggccgcctcacgaagatgcgcgtcgagcctcgcgacgccgtcaccgaggtccaagcgaggacagctcgcagcatgcctcgcgtgctcgcatccaaaccgctcgtctggttcctcgaggagcaccgggcacaccagcgccgggagatcgaacgccctcgccccctcagcggtcgagctggggcctgctcccggttcccctctgccttcggtcggccccttgcgcttggtgcgccgaaccagcacttcggatgcctgtctgtgacttctctggccatcatctcctcgagccaaggagccttacggcctcgcctcctcgtctcgcgcgtgtcgttcgcgcctctctgcggccgtcctccgctcgaaggcatcggcctcgggcagggcaagagcagttcgggtgatcaccgacactgcgtccgcagccccgaccacccagcgggacctaggctcgaccatcgtggtcgctggcgcacgtcatccggttcgttggttcctcgccgaacgcggcttgctggcggctgcggtgggcatgcttccggtcggcctgtccttctcgctcctcgacatctacgctcgcgcgagcgcgctcgggatcgtgctcgcactacagggcgtcggcctcgtcgtcagcttgatcgtcctcggtggcgtcggcgacctcatcgcacctcgtcgcctcctcgtcctcgccgatgcgctctacgcagcctcggctgcggcgttggccctgctcgcgcagacccacagccacgcactcgtcgcctatggggccgcctccatcgtcaccggtgcctccgcgggtctcgtcaactcggctctgcaggctctcctggctgcggtggtgtcgccacaggatcgacagcgcgtgaacggtctacggagtctgttgcgcaatctcgtccaggtcgcagctcctgcgttcgcaggactcgtgagcgcgatcgcatccccaaccgtcgtgctctggctcgccgcgatcgtcgccgccctcggcacgctcgctgctcgcgcgctccccgatacaggcgcgggagcacaccacgacgctggcctgctcgccgaactgcgcagcggttggcgagcgtactgggcctacgggtggctcgtcgctgtcgacggcgccttcgcactgtggcacctcgtcgtctacggaccgctcttcgtgctcggccctgtcgtcgcgcgtgcccatgatcacggtgcgctgggctggggcctcatgctggccggcgtcagcgttggtggcgtcctggggggcgcgctcgtcgtgcgcctgaggcctcgtcgcccactctccttcgccctcatcgcattctcggttacgtcggtgtggctcggtgcgctctggttcgaggcgcccctacccgtcctcgtcgtcgccgccgcgatcgccggggtcggcttcgagcttctcatggggctgtgggacaccgtcttccagggcacgatcccccggagtgtgctcggcaagctcgcagcctacgactacctcgcctccgtcggaaccctgccgctcggctacgccttggcagcgccgctggccgcgatcgtgggcgcacgcggtgtcttcggacttggtgtcgtgatcacggtcgcgatcacgctgggcaccctcgctgtgccgagcgttcgtcatctcccctcgccggcacttcccatcgacgagtgagcgccgacgactcctcggccgcgggttgagtccccgcgccgcatcgtcgcgggctccgctggcagctaccgtacaacgcacctgatccaaggagtgtcccatgaccgatagcgtcagccaactcgccgatgaccagcccacgacacgcctccagcgtgtgctgaatctcgtcccgcgagcgctgtcatcgagaccccacatcatcttcctcgcggtgctcggtgtctacctcgtgctcctccccctcgcccacgtgcacgtgtcggcgttcgcggaactcgtcggcgggaactacacgaacgttacgagcgatctcggggcctgcatcgccgccggcggtacgatccacatcatgcgctcgcaccggcagcaccgcagcgagctcgccgagctacgccgactggtcgaggacctgtcgcgcacgctcgggtcggggtccgagtaaatccgtcgccgctcgcaccacgatccgtcgacgctcgcggccggctgcgcggtgcctcgagacggcacgtcacaccagctcggacggccatccgtcctatcctggaggcgtggcacgcgcacagcccccgggcgcagctgagccacgtcgaccccgccgacgtggttggcaccgtcgcacctttgaaccggagcgcggatggggatcgctgggcgacgagggacgcgccgtcctgcgtgcggcgcagcggcgcatcgcacgcctcgtgtcctcggactcgctggccgagctgccaccagagcccgaggaggaggtggcctatcgcctcctcaccgccgcccttcgggcaggcgccgtcctcctcgcggctggggccgccacgctcgatgtcgagcagaccgtcctcacctttgccaacgccctcggcctcgcagggtgcgaggtcgacgtcacgttcacgtcactcaccggctcgtaccgtcgtggtgcaaccttgaagcccatcaccacgctcgtcgtggtgcgcgatcggacgctcaacttcgccaagttggccgcgatgacccagctgcgtgcggccgtcctcgcgggcgaggttcccccggtcgatgtcgagcagcgactcgaggcgatcgagcggctcaccgtgcgccgcggtcgcttcgtcgtggccggctgggcgggcatggcggctgcgttcacgatcctgctcggcggacagctcctcgccggtgcgcttggcttcgtggcgaccgccttgatctacgtcctcaaccgcggtctcgcccggcgcggcgtcccagacttcttcttgagcgccatcggggcgacgctcgcgaccaccacggctctgctcgcgatcgtggcgcacgcgccgaccgtgcctgccctcgtcgtcgctggcggcatcatggccctcgtgcccggcgtgaagctcgtctcgagcgtccaggacgccctaagcggtttcccgttgtcagggaccgcccgtggcgtcgaggtcctcgtcatcgccaccggcatcgtgaccggcgtcagcctcgtgatctacgtggcacgactcgcgggtctgcacctcgccatcggccccatcccgctcgcctccttgctctatgtgccggtccagatcgcggccgcggcggtcgcggcagccctctatggcatcgcgacatcggtgccgcgttcgttcctcccttgggcggcagtcaccggagcgctcggatgggggattgtcctcgtgctcgaacacaacggcgtctcgctcgtcgtgtcgacggcgctggccgcggtctgtgtcggcctcctcggccaggcgctcgcctccatccacaccacccatccctacctcttcgtcgtccccggcatcatgccgctcgtgcccgggctcaccgtcttcgagggcatgctcgcactcgtcgaggggcacggcggtgccgcgggtctgctcctgcagggcctcgccatcggcctcgcgatcgcggcgggggtcagtctcggttacctcatcttgcgctcgcctgtgagccgaccgactcggcttcgctaggcggtcgcgacctgtcggccgccgcggtgcacctccccggtgcggcctcgcgaacgtgggcggtctcgtgtcgtggtgccacgcccgccgtcatcatgcaggcgctgcatgacgagcccagcagaccggctagggttgaccggctcagctaccttgcgtcgttcctttggagctccgatgtctccgcgtcccgtccgtcgtcgtcacctcgctggggtcgtcctcgcaggcattcccttcaacgtggctcagggggccgcgttcccctactgggtgctgtatctccacagcgacctgcacttccccaccgccttggcgggtctcgtgatcggcaccgagggtctcgcctcgctcggaggcgcgctggtcggcggggccttccaggatcacttcgggcctcgacgaacggcgcaactgggcgcagtgatcgaagccgtggccgcagcgtcgcttgtcgttgctcgtagcccgcttgcggtcgcgggctgcttcgtcctcttcggtatgtcgaccttgcgctatccggcccgatcgagcgcgctcctcgccgcactgccggacgatctctcggcgaccaccttctttagctgggacttcatgggcgcgaacaccggcttcgggctcgggatcgtggtcggggcgctgctcatcggtgccggtgacgcgacggtgatgcggggcttgttcgccgccctcgcggtgacgagtgccctcctcgccgtgacctacgagctcatcccgaaccagagaatggctcgcgaacacctcgagcacgcgtcgtatcgcgcagccatgcgttcgtcgctgttctggtacgtcggcgcgtggggcctgctgctctcgctcgcgagctactcgtcgttcgacgctggcgtgccggccctgatcggcatcgagctccacgcgtcgccgcacctgatcgcgctcggctttctcacgaatcccgtgctcatcgtcgcgttccagcaacccgtgagacgcctggtccaccgactccggtggcgccgcgcaaccatggcgaccgcagcgatcttcggcgcgtcgtggttcatcttgttcggggccctgtggctgcggaccgagttcgagctcgccgtcctcgtcgtcagcttcgccgcgaccttctcgctcgccgagatgctgatggctccccttcgaacccagctcatcgccgcgctcgcacctgagcatctccgcggtcgcttctacgggatgagccacttcgcccgcggtgtcgccggtctcgtcgggccgagcgtcgcaggggccatgatcggtgcaggcctcggcttctggtggctgccgctcgtcgcgagctcgggtgccggtgccgcctgggtcagccgaaagatctttcggacagctcccgccgagctgtccgagcgcacctgacgcaaccggttcgacggctcagacggcgctcgcgtcgactcctgccccaaaggccggacagtgcggcgccagcggacaggagcgacactggtagccgggtacggcatcggcccagagaccgtcggggacggaatcacgacgcagtgtctcgcgaagctcgcggagacggcgagcccgtcggacgacggtcccgatcgcgcccacgccctcgtcgagcagcgcctcatcgacgaggcgacgccgagagcgaccggcttcgatgtcgacgaggcccacccagtcgagatcgacaccaccgatcgtcgcgaccaccgcctcgaacgcgagcgcggtgtcttcgtagccgtagggtcgatgatcgaggacgaagacgcccgcccgctcgcccttcgcatcgaggagctggaggtcgatgaggctccgcagctggacggcgccgaagcgcacggtgcgccgacgcggctcgagcgcaccggcgtgctcggcctcgagcacgccgatcgtctccgctgcgaaggtgatcacttcctgctgaacgaggagtcgctccccgcgtgtgatcgccttcgtcgcatggccgctcacccagtcccaggcccagtggtcgcggatcgaggagcggagcgcgcgatagagcgcgtgcggggtcggtgcctgctcacgctcgtcgtaccagcgcacgacgagctccatcgcgagggtacggcgcacgaccgcgacggacggctcgaacggggcatcgatcaccgaggagccgaggtcgcacgcttcgcggaggtctcggctcgtgaggcggaccggcgcgccgccgccacgcagctcacggacgatcgcctcgacacgtcgcccgaggtctgctcgctcccctcgtgtgcggctcacggcgccgccgcctctgcgtaggtggcacagtcctcgcggaacggacactgggtacagcgcggacctgcgcgctcgatcggcgcaccagcgaggccacgcgcggcggcccgaagcgcatcggcgaccaggcgtgcgccatcgcgcacgacgcgctcgctcatcacgagctgtcgcgcatcggcgaccgcttcgccagggccgaggaggatgatgctcgctggaggtggcccgtagcgcaggccagccagcagcgcgtagaagcggagctcgctctcgtgctcctcgctgagggcgagcgacgacttgatctcgacgaggtggtggggtctcccgctcgcggccccacccaccacgagatcgaagcgcccggtgagcagcacgtggtcggtgaggtccgcccgtgcgcgcacctcggttcgtggccaccacgcctcctcgatgccaagacgctcgacgagtcgcgcgcgccgggtgacgacgtctgccatctgctccgcatcgagctcgaccgtcccaccgtcggcagtgacggcttcgagccacagcgcgacgtcgtcgccggcatggtactcggcgccgtaggcgaaccacgagcgcaccccggcctcgaagaccgtgccgaggtccatggcgcggttgcgcggcgtggcgatctcacggcgcagctcggccgtcccgtagcgctcacaggccacgagtgaggccacgatgcgcttggtcaagcgccaggtctgctcggtggggagttggctggccagctcggcgagctcgtgacggacctcggcgatgacgtcacccgcgaccgggtcgcctgggcgccagagcgcctcgacgagcgctgcctcgctctcgagccagacgatgtccgtggcgctcacgaggccgactccgaactctccagcgaagccggcacgtcgaggggtttgagacgacccgcaagcaacgcgtcgcagaccgcgagcgtgccctcgacgaacgagcgaccgagcgctccggcgacctccgagtcgacacgcgaggcactccagccggtgagcgccagccgacgggcgaccacgagcggccacacacgtgccaaccaccgctcctcgatcctcgcccgacgaccgtagcccctgatccacgccgcagcacgctcctcgcagtgcggggcgtcctcgaggaagctcagcgctccggccagatctgccatcgggtgtgcgaagccagcgtcgtcgaagtcgatcggcaccaacgccgagctctgggtgcgcacgacgttggcggcgcgcagatccgagtggatgaggagcatctcgtccaccgcatcgagcatgctggcgacacgttcggcggctcggtccatgagacgccgctcggacgagctcgcgcaggcaagctggtagctcccccagtgggcatgcggccccaccagcgcgccagcatcccagcgccaccgacgaaaccacggtggcgggcgccaccgacgcgcgtggttctggagttgggcagcaacctcaccaaggcgctcgaaacttgccggatcgtcgctgtcgcctgctcccacttcgcccgccgtccagctcaccacgaccaccggtccgtctctggtgtcgacgagacccggggggccatggagctgggcgatgggccgcggggcggcgacacctgccgcatccagcgctgcgagccaggcgagttcgctcgccagttcggtgaccgtgcgatagccaggacgcgggacccggagcgcggccaccggaacaccgtcgcaagaggcctggaacaccacgttctcggagacggcgacgggcgtcaccgtcgccccgtcgagcagcggcaccacgcggcacgcggcttcggcagcctgaacggcccgctccaggagatcggccatgaccgaacgctacccgctcgctgagcgccctacactgcatcgtgccgatgcaggtcctccgtccgcagctcgccgtgctcgtggccgccgtcgccagcctcgctgcctgcggtagcgccgtcccctcgccgaaggctcaccgcctcctcccggcgacccatccgctcgcacctcggccggtcctcgtcgctccctctgccgtctcgaccgaccccggaccaggtgccctcccacagacacccgcgcttccgtctgcgacgacccagagcttcaagaccagtgtcgctgacctgtgggctgcgatcgtcaccgataatccggccctcgccatgcccgccttctttccgctcccggcctacctgcaggtcaagtcgctcaccgacgacgcgcacgactgggcggttcgcctcgtcgcgcacttcgtgctcgacatcgaggcagcgcacgcggtcgtgacgtctcatggcggcaccccgacgctggtgggcctcgaggtgcccacgacgaacgcgaactgggtgccgccgggcacctgctacaaccgactcggctactggcacgtacccggctcccgcctcgtctaccaggtcggcacgacgacctactcgatcggtgtgctctcgctgatctcctggcgcggcacgtggtacgtggtgcacctcggcgcgatcaaccgcccgagcgacgaaggtgccgtcgacgcgcccgccgtcggggtcggttccttcgggcccccgggcggttgctgagcggcggtcgagtaccgttccaagggctcggcaccggctccggtgccgaggcacccacgatcgacgggaggggaacgagcatgctcatggtggcgagtgcgaatggccgggccggcatcgatgccgtatttcctcggctcctcgaaggagcgctgaccccgttggacgccgtcgaagaggcggcctgggtcaccgaggacgatccggccgatcactcagtcggtaccgggggcctccccaacatcttcggtgccgtcgagctcgatgcgtccatcatggacgggaccaccctcaaggccggtgcggtcgcggcgttgcgaggctttcgtcaccccatcagcgtggcccgagccgtgatggaacgatccccccatgtcctgctcgttggtgagggtgccgcagcgttcgcacgcgcggtcggagccgaggccgccgtgctcgagaccgctgaggcgctcgcttcttggagaacggcgatcgcctccctgcacgccgaggagctcgcctcgacgctcgcgatggcacgagcactcacccgcgatcccgagcgggccgtcggtacggtcaactacctggcactcgacgaccgaggccgcatggccagtgccgtgtcgacgagcggatgggccttcaagtggccagggcgagccggtgacagccccgtcatcggcgccggcaactactgcgatgcccgtgtcggcgcggcggcatgcacaggctttggcgagctctcgctccggactcagctcgccagccgctgcgttggcttcctcgaggccggggccacctgcgaggaggctgctgtgcgtgcgatcgagctggtgaaccgcctgcaggtcgatcccgccgagcgcatcatgcacatcgtggtcctcgatcgagatgggaaccacgcggcggcgtcgacgcgagcgggaacgacgtatgcctggcgtgatgggtcacaaccacactgccagctctccccgagaacgcacgtcccccccgagggctcatccgtcgtaggctaagcagcacacgatccgacgggaggtagtcgtggctcctgaggaacgcaggacactgccgggctccgccatgcctcgtccggcgggcgcccaggtgctcggccagatccccgacgacgaacgtgtcgaggtgaccgtcgtactccaaccgcgcgcccccctccctgagccagggccgacccccatgtcgcgagcggagcttgccgatctgcgcagtccacccgagggagcgctcgaagcgatcgctcgctacgtcgccggtcagggcctcgaggtcatcgcagccgacgcacctcgacgccgcatcgtgctcgcgggaagcgcagcacggatcgcggctctctttggtatcagcttcgtgcgactccagctcgagggccgacggtatcggacctacgaaggggagatctcgcttccggccgagctcgcccccctcgtggtcgcggtcctcggtctcgacacccgccccttcgcgcgctcccatcggcgtccggcggtggcgccgaacgcacccacgaccgctccgaccgtcgcgcgcgcctacgacttcccgaccgcctacgacgggcgcggtacgacgatcgggttcatcgagctcggaggcggcttccaagagagcgacctcgtgcgctactgcgaggggctcggcctctcgacgccccaggtcagcgtcgtcggcgtcgacggcgcccgcaacgccccgaccggcgaccccaacgggcccgacgcggaggtgatgctcgatctcgaggtcgccaccggggtggccaacggcgccgacctcgtgctctacatggcggcgaacaccgacgcggcgttctacagcgcgatcgccaccgcgcttcgcgacgccacacacgctcccgtcgcgatctcgatctcctggggcgcaccggaggagtcctacccagccaccacgatcgcggccttcgagagcgtgctcgaggaggcggtccatgtcggcgtgacggtcctcgtcgcggccggcgaccaaggctccacggacggcgtcgacgacggacgcgcacacgtggactaccccgcggcgagcccctacgtgctcgcgtgcggtggtacgcgcctcgacctcgacggcaccacgatcgtcgccgagacggtctggaacgacctgccgaacggcggcgcgaccggcggagggatctctgcgctcttcccggtcccgtcgtggcaagcaggcatcgcaatgccaccgagcgccaatcccggtgccggaccaggacgcggcgtccccgacgtcgcgggcaacgccgatcccgacacgggctatcggatcgttgtcgatggggtcgcaaccgtcgtcgggggcacgagtgccgtcgcaccactctgggctggcctcgtggcacgctgtcaccaagccggcgctcgtggcggcttctggaacccgctcctctacgcagcccggggatcgtcggcgttccacgagatcaccgtggggtcgaacggagcctacgacgcagggcccatctggaatgcgtgttgcggcctcggctcaccgaacggcaccgccatcctccaaacgctcagagcgtgaccccgacgaacgcaaccctctgggccacgtccgatccgacgcagcccagggcgtgccgtgtgagtgtcccgcgtcgaggcgtacccggctcacaccaccgcaagttgacgcgtgatcgcgacgtcacgctcgagcgtcgcgtgcacggggcaacggcgatcgacctcgttggcgagctgctcgtagcgttctggcgtgctcgggccacgaagctcgacgtgaacgaccacgtcgctcacacagggccgagccgcaccgtcgagcgtcgcgggatccagcgatccctcgacacggaccgtgaccgaatcgagtggaacgttctgcgcctcggccacgtgctggtaggtcaacacctggcacgaggcgagcgcgccaaggaggaactccaccggacttgccagcgtgccatcggatgcgacctcgaagcggcgaccccgtgcgagctcgatctcggcacggccggcggcgctcgtcgtcgccgtcgctccaaagcgcacgacgggtcgtggaccggacgatgacggatttgatgctgaacgtgtcatacgcatagcttactatcccgatcggctttatcaggtataggtcgactggttatcaccgcaccggttacggaggttgcatgcagcaggtcatcaccgggtggacgaccgacgacgagggcgactgggtcgcactcctcgcgtgtggccatcgacgccatgtacgccatcgccctccactcttcccagcgccctgggtcctcgacgagatcggacgctccgaccacgtcggtcagccgatcgactgtggccgctgccgccaagggatcttgccgccgctcaccgacgagacggcaaccctgacctggatcgacgctcgggcgaccgacgtcgagtgggtcatggggggacggacgaatcactgggagctcgtcgtcgtagccgaggggcgagtgcacctggagctcaccttcgctgacggcgacacgacgacgtggtggctcgagggcggcatgcagcgggccctcccggtcggctgcgcgtaccgcctccgaacggcgacccacgcgtcggtccttctcgcacgcttcgaccagtcctgactcgaccgacgaccgcagtgacgctcgagcccgcgagcgcaccgctccctcgccgagacgcccgctcaccccagcaccggcgacggacccaccacgatcaagccgagcccgatgagcgtcacgaagaccaccccgagcacccgctgtagcacgcgcatcgcaacctccgaatccgggccagacacagtcccaacgcctcgacacagccccaacgcacgacgagccgggatcccgaaggatcccggctcgtcacgaaagcccggtcggcggcgccctactctcccagggggtctccccccaagtaccatcggcgctggtgggcttaacggccgtgttcggaatgggaacgggtgtttccccaccgccatggccaccgcccggacgatctgcggcgtcgagcgctccagagcgagcacgaggagctccaagtcctcggccgattagtaccggtcggctgaacacgttgccgtgcgtacacctccggcctatcaacgtggtcgtctaccacgggccttaccaggttgaccctgtgggaaacctcatcttgagacgagcttcgcgcttatatgctttcagcgcttatcccttccgtaggtcgctaaccagccgtgcccttggcaggacaactggcacacgagcgctacgtccgtcccggtcctctcgtactagggacagcctctctcaagtttcctacggctgcatcggatagggaccgaactgtctcacgacgttctaaacccagctcgcgtaccgctttaatgggcgaacagcccaacccttgggaccgacttcagccccaggatgcgacgagccgacatcgaggtgccaaaccttgccgtcgatatggactcttgggcaagatgagcctgttatccccggggtaccttttatccgttgagcgacggcgcttccacatgcgaccgccggatcactatgccctgctttcgcacctgctcgacatgtgggtctcgcagtcaagctcccttgtgccattgcactcgacgactgattgccaaccagtctgagggaacctttgggcgcctccgttactctttaggaggcgaccgccccagtcaaactgcccacctgacgcggtcccggacccggattcacgggtcgcggttagagctccagcaccgacagggtggtatttcaaggacgcctccagggaagctagcgctcccctttcgcaggctcccacctatcctacacagtcggaaccaaagctcaacatcaagctacagtaaaggtccacggggtctttccgtcctgatgcagctaacgagcatctttactcgtacttcaatttcgccgggtctgtggttgagacagtggggaagtcgttacgccattcgtgcgggtcggaacttacccgacaaggaatttcgctaccttagcaccgttatagttacggcggccgtttaccggggcttaggttcagagcttcgcccttgcgggctaacccctccccgtaaccttccggcaccgggcaggcgtcacagcgtatacatcgtcttggcgacttggcacgctgctgtgtttttagtaaacagtcgcttccccctggtttgtgacaccccctcgggctccgggcgcgaggcccttcaccctaccgaggtcttccttatcccgaagttacggaagtaatttgccgagttccttaaccacagttctcccgctcgccttggtattctctacctgcctacctgtgtcggtttggggtacgggcgcctcgatcactcgctagaagcttttctcggcagcatgggatcagtgacttcgcccgaagtgggctcggagtcgcgtctcaggcttcgtgaggtccggatttgcctggccctcgccctacacgctttccccaggaacgaccaacgcctgggatcacctaccctcctgcgtccctccatcgctcaaacgcgatcggggcggtaccggaatatgaaccggttgtgcatcgactacgccttgcggcctcgccttagctcccgactcaccctgggtggacgagccttgcccaggaaccctgaggcattcggcggaggggattctcacccctcgttcgctactcatgccagcattctcactcgagcgcgctccagctcggctcacgcctcaccttcacggcacgctcgacgctcccctaccgcccggtgacgtacgtcaccggacccgcagcttcggtgaccggcttagccccgttacattatccgcgcggaaccactcgaccagtgagctattacgcactctttgaagggtggctgcttctaagccaacctcctggctgtctgggcggttccacatcgttttccacttagccggtactttgggaccttagctggcggtctgggctgtttccctctcgaccacgaagctcatcccccgtggtctcactgccaggctctggagcatcggcattcggagtttggttgggatcagtaaggctgtgggcccccatagcccatccagtgctctacctccgatgctgaacacctgacgctgcacctcaatgcatttcggggagaaccagctatcaccgagtttgattggcctttcacccctatccacaggtcatcccccctgttttcaaccagggtgggttcggccctccacgggatcttacccccgcttcagcctgcccatggatagatcactcggcttcgggtctaccgcaggcaactctcgtcgccctgttcagactcgctttcgcttcggctcccccacgcatgggttaacctcgctacctacggtaactcgctggctcattcttcaaaaggcacgccatcgccctcacgggctctgactgcttgtagaccaacggtttcaggatctgtttcactcccctctcggggtgcttttcacctttccctcacggtactagttcgctatcggtcgcctgggagtacttagccttacgaggtggtcctcgcagattcacacgggctttcccggatcccgcgctacttgggtggcgacggggaggcagctcgcttcgcctacggggctgtcaccccctgtggcgcgacgttccagtcgcttcggctcacgcgctgcttggtaactccctggaggggctggcgcaccctcctcgtcgctcccgctacccccggacggcaacgccgccaggcttgacaccgcccgggtttgggctgatccccgttcgctcgccgctactaggggagtcgcggttgctttcctctcctgggggtactgagatgtttcaattccccccgttccctcctcctgccctatgtgttcaggcaggggtgacgtggcattccccacgccgggtttccccattcggacatccatggatcaacgcttggtcgacagctccccatggcttatcgcagtcgcccacgtccttcatcggctccaggcgccaaggcattcaccgttggcccttcgtaccttggagttgtgatactcgtgctcgctctggagttctcaagctgccgcgcagcaggtgcttcgcgaagagggagccagtgcttcgactgggtgcggccactcgttgtggccactccttagaaaggaggtgatccagccgcaccttccggtacggctaccttgttacgacttcaccccaatcgccgaccccaccttcgacggctccctcccttgcgggttgggccaccggcttcgggtgttgccgactttcgtggtgtgacgggcggtgtgtacaaggcccgggaacgtattcaccccggcgtgctgatccgggattactagcgactccgacttcacgcagtcgagttgcagactgcgatccgaactgagaccggttttttgggattggctccccctcgcgggttggcgaccctttgtaccggccattgtagcatgcgtgcagccctggacgtaaggggcatgatgacttgacgtcgtccccaccttcctccgaattaactccggcagtcccctacgagtccccggcatgacccgctggcaacatagggcaagggttgcgctcgttgcgggacttaacccaacatctcacgacacgagctgacgacagccatgcaccacctgtgaagggccccgaaggacaccgcatctctgcggcttttccctccatgtcaagcccaggtgaggttcttcgcgttgcatcgaattaagccgcatgctccgccgcttgtgcgggcccccgtcaattcctttgagttttagccttgcggccgtactccccaggcggggcacttaatgcgttagcgtcggcacggagcccgtcgaatgaggccccacacctagtgcccaacgtttagggcgtggactaccagggtatctaatcctgttcgctccccacgctttcgctcctcagcgtcagtaccggcccagatcgctgccttcgccattggtgttcctcctgatatctgcgcatttcaccgctacaccaggaattccacgatcctctaccggactcaagccatggcagtatcggatggcgacaccaggttgagcctggtgatttcacatccgacttgccaagccgcctacgagctctttacgcccagtaaatccggacaacgctcgccccctacgtcttaccgcggctgctggcacgtagttagccggggcttcttctgcaggtaccgtcagtttcgtccctgctgaaaggagtttacaacccgaaggccttcgtcctccacgcggcgttgctgcgtcaggctttcgcccattgcgcaatattccccactgctgcctcccgtaggagtctgggccgtgtctcagtcccagtgtggctgatcgtcctctcagaccagctacccgtcgtcgccttggtgggccgttaccccaccaacaagctgataggccgcgaggccgtcccgtcgcgcccgaaggctttgctccctcgaccatgcggtcaggggagcacatgcggtattagcaccggtttcccggtgttatcccccacgtcggggtgggttcctcacgtgttacgcacccgttcgccactcggtggcaagccaccgcgtacgacttgcatgtgttaggcacgccgccagcgttcgtcctgagccaggatcaaactctccattggagatcgttccgagggtggagtccaccctcgctcgcctcgccccgggacacgtgggtctcgggtgagggagagtcgatcatggttggtgggtttggtcccaccgtttgtgttgtcggggtgacaccgagcttgtgctcgggtcgcccgcactggcttgtcttccctcttcgcgatgtcaacctgcgcccctgtcggggctctgccacgagggcacccgaaggtgctcgttgtggatggtgggttgccccacccccagcggtgctcttggagcacgtgggattcatcagtgtagcggggtcggaacgggtcgtgcacggttgggggacatcttctgtcgagatgggacgtcccgcgtcaagtaccatcggcccatgcctgtctatcgactcggttcccgcagcccccgcatccatcccgacgcattcgttcatcccgatgcggtcgtgatcggcgacgtcgagatcgacgaggaggcatccatctggccgcacgccgtcctgcgcggcgactacggccacatccatatcggcgcccgcacgtcgatccaagacggcaccgtcgtgcacgccacggccgacctcgcgacacgcatcggggcggcctgcgtcgtcggacaccttgcccacctcgagggctgcaccgtcgaggatcacgtcctcatcgggtctgggtcggtggtcttgcaccgcgccgtcatccactcccacgcgctcgtcggcgcccatgcgacggtgaccaacgacaccgaggttccatcccacgccctcgcactcggaacacccgcggcgatccaccccgatcgcgtgcccgccggcaccttcgacgatgcggtgcagcgctacgtcgagaacgcgcgccgctaccgcacggatctcatccgcatcgagtagcggtcgattcgcgcgacgagccgaccgcccacctcggtcaccgtgacgggcatgccgaagaccgcggcgagcgcatcggcgtcctggaggatcgcacgagtaccaaagcgggtgatccccgctccgacgaggagcacgtggctcacctgggcggggagctcctcgacatggtgggtcacgatgaacgccgcgcgcggtcgtggcgaccgctcgagcagctcttcgagcgcccacagggcctcctcgcgaccgatgagatcgagatgcgaggttggctcatcgagcacgatgatctcagggcgccccgcaaaggctctggcgaggaggactcgctgacgctgaccagcagacagatcctcgatggctcgatcacccacgttcgccaggcccaccctcgccaacagccggtccgcttcgacgagttcctcgtcggagagctcgaaccacgcacgacgaaggccagcatgaggaccgagcgcgaccgcatcgcgggcgctcgtcgtcggcaccagctgagtcgtgagctcgtccgcgaagtacccgacccgtgcgcggaagctgcgcacgtcaccgtggcgcaggtcgcagtcgaggactcgaagctctcccgagcgcgggcgcaaccggcccgcgatggccgcggcgatggtcgacttgccggcaccgttcggacccacgaccgcgaccaccgcgccgtcggggacgtcgagcgtcagcccttcgagcaccgtcttcgtaccacgggcgatcgagagattcgtcgcgctgatcaccgtcgcgttcgccatggaacgccaccctacgcgacctagatggcgattagcagcacagcgaccatcgctagcaccatgccgacgatctggcgcgggctcgggctgacacgatcgatgacgagaccgagcacgagcgtcacgaccggatagacggcagtcacggccacgatgggtgctgccgttccaagcggcgcggctcgcagagcgagaaagtagagcaagtaaccggcgacacccgcgaccccggccgcgatcgcaagtggccccatgtagggccgcaagaacgcgatcgatggtaaggcaatgacggcctcgacgagcacgacaccgagccagagcgacagtgcggaagccgaatgacccgcccgagcggagaagtacccccacaccccccacgcaagcgcgctcccaaccgcaagcagcaccccgaggagaacggatcgcaccgctccagcctacgtctcgcgaactgccggcgattcctcaagttcgcgtcgaccgcacccgatacgatcgcagggagggtcatgggacacgactcgagttcgatcatcctgcgagggcgcgaccagatcacgcacgacgcgctcgcacaacagcttcggctcctcaggacccacgcgggcgcgatgggtgtcgccgtcgtgcgggtcggagacgatgggcgcgtcgtcatcgaggcgctcgacatggaccgagccctcctgcgtgagggtgaggagatcgtcgtcaccgacccaaaggtgctgcctgagcgcgcagacgcaccgagtctgcgaccggggcgcatcgaaagcgacctcttgacgttctcgccactgcatggtctcgtcctcgtccccttcgagagtccacaggaccagtcgctcgcactccttgtgttcgctgcgcgcccgctcctcgtgaccgacgacgcactggtgcttgcagcccgcaccatcgagaccttcctgatcgccgcgagccgctttaccgaggaactgcgctacctgaagggcaccctcacacagtcggagttctactccgaccgagaccccctcacccacgcgctcaatcgtcgtggtttcatcggcctgctgcatcgcctcgaagccgactggccgcaccggcgaatggcctacgcgatcatcgtggccgacctcgatcatctcaagcaagtgaacgaccaccaagggcatgccgccggtgacgcgctgatccagcgcttcgtcgagaccctccgctccaacctgcgtgagccggagaacgtcgggcgtctggggggagatgagtttgcggtcgtcgccaagctcaggacacccgccgagacgcagatcctcctgaaccgcttgcgcaccgcactcgacgccgcggggatcgctgcctccctcggagcggcgagccgcgacgtcccgatgccgctcgaggaactcctcgtcctcgccgaccgagcgatgtacgacgacaagttccgtcgccacgaagccatcgagggcatcgaggccacggcaccatcgctcttcgaaccaaccctctagcgatcgctgcctgtcgttcgccaccggtcccgatgccgatcggaacgcggggctcatacgcgcctcgctgacaccacagcaaagccacacatgagcaagggggcgcgctgcgcccccttgccttcgatcatgtccctagcccgggccctgacggatgcggccaagttgaccgctgcgggcaccgacgtgcaggcgctgatgagtgcgagacgccgcactcagcggagtggctcaggcgtccgcgctgtcgtcgtcgcccgtgccgtcaccggttccctcctcgccctgaggcgggccgatgtagttgccctcgtcgtcgtagtactcggcaaaggcctctcggtactcgggtgcgagctccccgccctcgagcgcctgacggatcgacaggctgatgcgccgacgaccggggtcgagatcgatgatcttgacccacagctcctcgccgaccgagaccacctgctccgggagatcgacgtggtggagggccatctccgagatgtgcacaagaccttcgatcccgggcgcaacttgcacgaagcacccgaacggcacgatcttggtgacccgtccgtagaccagctccccgatcttgtgagccgaagcgaactcctgccacgggtcccgctgcgtcgccttgagcgacagtgagatgcgctcgtgctcctggtcgacctcgagcaccaggacctgcacctcatcgccgaccgagacgaccgacgatgggtgatcgacatgattccacgagagttccgacacgtgcacgagcccgtccataccgccaaggtcgacgaagacgccgaagtgcacgatcgacgagacgacgcccttgcgcacctcgcccgggcgaatcgaggtcaagaagcgctcgcgctgatcgcgctgattctcctcaaggtaggcccgccgactcagcacgacgttgttgcggccccgatcgagttcgatgatcttggcctcgatgtcttggcccacgaacggtgcgagatcacgcacccgtcgcaggtccacatgggacgcgggcagaaagcctcgcagtccgatgtcgacgatgaggccacccttgacgacctcgatgacctcgccgcggaccacgccgtcgcgagccttgatcgcctcgatctccttccaggccttctcgaactgggcccgcttcttcgacaggaccaatcgcccctcgcggtcttccttctggaggaccaaggcgtcgatccggtcgccaacgctgaccacgtcggcggggctcacgtccttacggatcgagagctctcggagcgggatgaccccctccgacttgtagccaatgtccaggaggacctcatccttgtccaccttgacgaccagtccgctgacgatgtcaccctcgtcgaactcgacgaggctcttggcaatcgcctcctcgagtccctgctcgccaaggtcgtcgaggacgatcgcgtccgaggccgcgggagccccatgctcggatcccagctcgcgttcgctcgcggactccgacgccatctcttcagtcatgctcgatccgatatccttctgcttcttccaacgccaccagcgcggacgtgccacgccatggccgaggatagtcggccgaatgccggccgctgcggctcatgcgtcagctttggcacgaccccaacttcggccgacgccgctctgtactcgcagcggcacccgtagtgcaaaggcgtgctcgagcacgtcctcgacgagggcacggacgtcgtgcgcgcgctccgcgacagcctcgaccacgacttcgtcgtggacttggagcacgagtgcgccatcggtagggctcagcgcagcgtgcaagcgcaccagggcgatcttgaagatgtcggccgcaagaccctgtgtccccgcgttcatcgcctgccgctcggcgccttggcgaacggtgcgattgggtgagtcgaggtcggggagatagcggcgccgtccgagcagcgtcgtagtgaaaccctgcgctctcgccgcatcgacggaagcatcgcggtagtgccgcagccccggaaaggccgcgaagaaatctgccagtatcccctcggcctccgcgggagggacaccaagacgttgggcgaggccgtaggcctccatgccataggacagaccataggtcaccatcttggctaccgaccgctgctgcggcgtgacgcgctctgctggtacgccgaagacacgcgcagccacgagggtgtggacatcgccatcgcccgagaggatccgtaccagctcctcgtcgcccgacaggtgtgcgaggacccggagctcgatctgtgagtagtcggccgccacgagcacgtgaccctccgtcgccacgaaggcgtcgcggaaccgcttgccctcgtcggtacggaccgggatgttctggaggttcggtcgctcggaagagatccggcccgtgcgtgcgacggcctggttgaaggtggcgtggatgcggccgtcggcaccgatctcactgcgcagaccttcgtagaacgtcgacagcagcttgtcgagctcgcgaaagcgaaggatcgccgcgacgatgggatgagcgtcgcgcaagctctcgagcacacgggcgtccgtcgagtaccccgtcttcgtcttccggcctgccggcaacccaagccgctcgaacaggaccaccgcgagctggcgcggtgagttcgggttcagctcaccaccggcgtagtgccggacctccgcgagagcacgatcgcgctcggtggcgagctccgtaccgatcgccgccaggacgtcgcggtcgatcgctaccccatggatctccatgtccgtcaggactcgcgtgagcgggatctccacgtcggtcgcgagacgccacagatcgtcctccgtcaggcgccgctccaacgcttcgcgaatcggatggacgacctcgacccactgcctcgctccgagcggcgccgcttccgcttcgaggggcccccggtcgtcgaggtgtctcccgagccagcgccgcgccagttggtcgagaccgtgagcaacgtccgcagagtcgaccagccacccgagcacctcgagatcgacgagcgcgcgtggctcgagcggcaccgcatgctccatcacgagcgagcgcacgatctccttcgggcctgctcccacgaggacgcacgacccgagggcctcccacagatgcgtgggggcatcctccggagagcccgcccaaaccacgccctcgacgccgagcgcgagctcgaccacgcggctacgtccggggtctccagcgaacgtagccgccaccgccaccgtggcacctggtgcgagccgctcgacgacggcggcggcgctgacgtcggtgaggtgcgcaaccggcgactcgaccggcggtggttcgtcgccggcggtcggccgaccctcgaacgcccgcaccagggcctgaaacggacgccgcagctcgaaggtccccaccatgagcgtctcggcccgccgcgggtcccacggaccgagtcgcagcgcatcgagggaaggtagctccgcgacgtctcgacgcagctgcgtcagcaggcgtgcctcgaggagctgtgagcgcgcctgctccagcgcctcgcgttgccgcgccgagagggcatcgaggtgagccaagatcccttcgatcgactcgaaccgatcgagcagggcggcggcggtcttcggcccaatccctggcacgcccgggaggttgtcggagctatcccctcgcagggaggccagatcgccgtagcgggctggtggaaccccgtaggtctcgaggaccttggcctcatcgaaggcctcgagattggagacccccttgcgcgtgaggagcaccacaatgagcgggtcctcgaccagctgcaagaggtcccgatcgccggtcacgatgcgggtggcgatcccggcgtcgcgggcgcgcgtggcgagggttgcgatgacgtcatcggcttcgaacccgctcgcctcgacagcggggacgccgatcgcctcgagcaacccacgagccgcatcgagctgctgtcgcaggtcatctggggtcggtgccctcgtccccttgtagctctcgaggatggcgtcgcgaaaggtcgggccctccgcgtccaacgcgaccgcgaggtgcgtgggccgggtttgggcgacgacgttggcgagcatgctcgcgaacccgaacagggcgttggtcgcgaccccgctctccgtgcgcatcatcggctcccgcagggcgtagaaagcacgaaagaggagtgagtagccgtcgagcaggaggaggagctggcggtcagtcggttgtggagctgggactgagctcaccgttgatcacctgctcggcgatggaccgcacccgcgtgcgctggttcatcgcggtcttctgcaagaaccgaaatgcctgcgcctcggtgaagccatcacgctccatcagcaccgccttggcacggtcgaggagcacgcgcgtctcgagacgctccgcgatccgttcgtgctcgtcacgcaatctggccagctcagcctcgatgatctgtcgctcgtcgaaccgagccctggcgagctcgagcgcagcgacgagctctcctgcctggaagggcttgaccagatacgccatgaccccagcgtctcgcgcctcctcgacaagggcacgctgtgagaaggcggtcaagatgaccaccgcgaccgggacggagccttgcacgcgtcgcgccacatcgagcccgtcgagtcccggcatcttgatgtcgagcacggcgagatccggcttgagcgcaccgatcgcctcgagcgcctcgtcgccccgcccgaggtcggcgacgacctcgtagccctcgagctccaacatctcgcgcaggtcgcgccgaacgatcgcctcgtcctctgcgatgatcacgcgtgccgacatgcacccctcgctgctcgactcgcgcccacgctagccgcagcccggttccggtgctctcgccctagcctccagatcgtgatcaccgccctttccctctgggtcgccggcacgaacgcgtggatcgcgtctgccgacggccgagagtgcgtcatcgtcgatgcgcctccagagccatggcacatcgtcgagcggctcgacgcactcggcctccgcgtcagcgcgatcattgcaacgcatggtcatctcgaccacatcgggggcatgcacgatctccaacgcgcccgtaaggaagatgggctggtcgaggtgtggcgttccccagcggatgcgcactacttcgtggaccccctcgggaacgccccgctgctcgcagacgccgtcgacagatcccgtgtcaccgtcgccacgccagaaatgatccgcgatctcgacgacggcaccgtggtgcgtggggcaggtatcgagctgcgtgcaatctggacccccggacacacgccgggatcgacctgcctcctcgcgaccatcggcgacgaaggcaccgtgctcttcagcggcgatcacctcttcgcgggctcgatcggacgcacggatctccccggtggctcactcgagcacctgctcgcctcgatgcgcgatcgtatcctgccgctccccgacgacctggtagtcctgcctggccacggaccaacaaccacgatcggcagagagcgagcaacgaacccgtatctccaagacctgcgctgaccacaggcagcgcaatgaacgtctcggcggattggaacccggggctcgccgaggcgatggcgccgtgcccggggcgggactcgaacccgcacgcctgttggggcagaggcttttgaggcccccgtgtctaccattccaccacccgggcttggccgcagcctaccgtggctcccccaccgagccaagccgcgcgcacgtcacggtgaccggccccaagaccggatccaccctcacggtgggacccgacgtcctcacgctaccgctcgcaggtccccccgggcaccgatcatctcgagtgcggagaacgtccgactcctcgtcgaggtgcagaggatgtgccgctggctctcgacgtcgagcccccggacctcggcggggccgaggtagccggcggatccacaggcccacgttgtgttggtgcggtgcgagtcgtgcccgaggagcactccggcctccgacacagagccgaacagctccccatcgagcacctcctcgcggacctgggcgcacagtgactcgcacaccccgttaccgccacagcgagcccggatcggtgaaccacgaggtcactccgagttcgctcgcccagcttgccacggaacccgcgacgaactccggggcgttgtcgacccgaagaaagccttgggctcctcgctcggcgacgaggccatcgagggtggcgacacgtcttcggcgtcgatcgagtgccccaccacgcaaggccagctcctccctggtggaggcgtccaccacgcatcgcaccgtgagcgccctcccgtcgtcggtcgcgtcgaaccggctccagtgcccagatcgcgttcgcctggatgggcaggtgagacaccgtttgtcaaccccccacgcagccggcgactcctcgcatggcgcgggaggactcaggcggcagcccgaggcgatggtccgggggcacgtccaagggcacggttccggttcgccacgtgacgcccctcgtcgtagggcacgccctggcgagggttcgccagggcgaaggtacgcaagacctcggtgatggtcgcatccaggctggactcgggcttcgtcggcacccgacgctgggtggagcgaggctggcctgtcacccggcacgctcgtcgctcggagacctgagaaccgctggcggagccggcgcacggctccccgccggcggtccggggtcagacgtttccctcggccagctcctcagagctgtcgatgtcgagggagaactctgccaccaacttcttcaagcgccggttctcggctcagagctccttgagcctcttcacgtctggccccttcatgccgccggaggtctgcttccagccgctaccaggtggtcttggtgatgtgcaaaggcccgggcgacctcggcgaccgtggcgcccttggtgagcagctgtccctctcggccagcctccggaggatctgctccggcctgtggggcttcgggcccttcatgtggtctccctcccgcatgtccagtctggtcggggttctcacagagcgggtggtctcgttgcaggggggccagccaagttggggtacaggtcatcgatggcacccagttgcatatcaccaaatcctctcccactggcgtcaaatagatggactcgaggagacgagagcacgtgtgagagaggatgtcaaccgatcatcggtaagtcgggtggctggtagcatgtccctgtcgtggtcgcgtaggctgcagcccgttcagtcgccgccgtgtgtcggcgatccaagccgacccggcgcgaagatgccggccggatcgaacaggcgcttgatgcccgcgtcgatgcgcaactcggtcgcgctcgcgtgggtccggaactcctcaagcttggcgaccccgatgccgtgctcgcccgacaccgcccccccacggcgaacgccctcggcaaccacttcttccacgacacgccgtgcgctggccacatcgtcggcgaacaccgacaggtggacgttcccatcgccgacgtggcccgttgcggcgaggcgcaccccataggtggaggcgacggccgcgaccgcatcgaagtagtctccgagcctggctggcggaacgaccacgtcgacgatgtcgcgggcaccgagagccctcaccgtccacagggccgcttctcgggcgcgcagcacggcccggccttcggtcttgccgagaacccatacgccatcggcgccagccccctcgagtacggctcccgccagctcgaccgctcgtgcaacgtcgtccgcgtcgacacgctccaccgcaacgacgaggatcgcgccgtcggcgagcgcccagccgggtagcccgagggtcacgcccgcaaagtgagccatcgcctcgagcgcgctcggttcgaggtactcgatcacgcttggtggcggctcgatcgactgcagagcctgcaccgccccgagcgcaccacgcatggtcggggcatgagcaacgaacaccgcctcctcggcacgcggcgcgagccgcaatatcgctcgctccacgatgccgagcgtgccttcggatccgatgacgagctgcaggaggtcgtaacccgacgagcgcttgtagagggagcctccgagcgtcaagacgcgaccgccacccgtgaccactgtggcaccgagaacgttctgcctggtcgtaccgaagcgcaccgctcgcattccgccggcgttcgtcgcgaccgtcccgccgatcgaagcggcgttctcgccaggcgacacggtgtagcgcaagccgtgatcggcgagcacgtgatcgagttcggcgaggctcgtgccggcacggacgacggcgacgcgggacaccgtgtcgacgtcgtccaccccgctgagccgctcggtactgacacagacctcggttggccgacagaccgctccgccggccagccccgtccccgcccctcgcacgacgagcgggacctggcgacgctcggcccagcggacgagctcgacgagctcgtccgtgtccgctgggcgcacgagcgccatcggccggctcggcgcgaccgtcaaggactcgtcgtgccagtagcgctcctcgatcatctcgccgacggcgagatgatcgggtcccacgatcgaaccgagctcctcgaatgcacgctgcacggatcgaccttaggcagtggggctccggagggcaaggcttgccccggtttcgccatgcccgacacccacgcagcctcgagtctgtaacccaatccgacgcgagagcatctaactgatgaaggctggagaaggggcaggtacctacgcagtgacggagcggcgcagacgcacaccgagcagggcacctcacgcagggtagctcgtcagtgtcatcggctctggtggcgcgacacgaggcactcgccctagggcgtggctacgagggagaggtcgtgcgcacgggatggggcgtcaggcgccacgatggatcgaggtccgtcggacgcgcacgagcgcagcggcaggtagtcagcaggtagtacggagagagggaaagggagtacagccatggtggtgtttctgttccccggtcagggctcacagcagcccggtatgggggcagcctggcgcgaccatccctcgttcgaactcgtcgacgaggccagcgacgtgctcggtcgcgacatggcctggctgctcctcgaggcggatgccgagacgctccagatcacgcggaacacccaggtggcgacgctcctcatgagcgcgatcgcgctcgacgccatcgagcgcctcggcatcgcaccgcagctcgctgcaggccactccctcggtgagtatgccgccctcgtggccgcgggcgggatctcacttgaggcagggctgctcctcgttcaagagcgcggcgacgcgatggcccaagccgccgaggcatccccgggcgcgatgatcgccctcctcggcgcgacgcttgaccaggcgcttcagctcgtcgatgcgatcggaccggatctgtggctcgccaaccacaactccgacacccagatcgtgctctccggcacgaccgacgcggtcgcgagtgcggaggagcttgcacgcgagtacgggatccggcgggtcacgcggctcaaggtcggtggcgccttccattcgccctacatgctcgaggccaaggatcgcctgcgcaaggccatcgcccagacgaagttctacgacctcgaggttccggtgatcgctaacgtcgatgcgcgcgagcacgtccttgcgagcgaatggcccacgctcctcgccgagcagctcaccagcccggtgcgttgggccgagacgatgagcgccatcgccgccgctcggccggccctcatcgtcgaggtcggccccggcggagtgctcgccaacctcgccaagcgcgccatcgccgacattccaacgatcgcggtggccaccccagatgacctcgaaaccctggtggaacggctcgccggcgacggaccggtcgccgaatgggcgacctcccaccagggcgagcgcctctacggctctgagcgccttatcgtcgcgccggtcacgggcgtgttccagccagcccggccggctccggagcccggcgcgcccgtccgagtcggtaccgaagtagggacgatcggcgacactccggttcgatcggccttcgccggtacgctaaaggagatgctggccgtcccgggcgagcgcgtcaccgctggccagccggtcgcctggctgtcggagacgagcgcttccgaccacgcaccggccgccatcgcaacccccctccacgaaagcaggtaagtcacactatgggagcacggatcatcggggtcggccaggccgtcccggatcgggtcgtcaccaacgccgatttcgaggcctatctcgacacctctgacacctggatcaccgaacgcaccggcatccgcgagcgccgcttcggcggcaccacctcgagcctggccatcgaggcggggcgacgcgcgatcgccgacgccgggttgacccccggcgacatcgacttcctcgtcctgtcgacgacgacgcccgatcagacggtcccggccacatctgccgaggtatcccaccagctcggaacccgcggtggcgccatggacctcaatgctgcctgcgcgggctacgtctatgccctcgtggtcgcacgtggcatgatcgcctctggggcacaccgggtgctcgtcatcggatccgacaccctctcgcgcatcaccgaccagaacgaccgctcgacggccgtcctcttcgcagacggtgctggtgcggtcgtcatggagcgtgccgacgaggacgacctcctcggctgggacctcggtgtcgacggggcggcgcgccccatcttgtactgcgaccacggcggctacatgtacatggagggacgcgaggtgttcaagcgcgccgttcgcgtcatggttgagtcgtcggagaccgcgatgaagcaagctggcgtgaacgccgacgacatcgcgctgctcgtaccccaccaggcaaacctgcgcatcatccaagccgccaacgaacgcctcggcatctcgctcgaccgtacggccgtcgtgctcgatcgctacggcaacacctcgtccggctcgatcccgctggccttggccgacgccgtcgcccaagggcgcctccatcccggtgatcacgtcctcttcacgggctttggtgccggcatgacctgggcaagtgcggtctggcggtgggccagatgacccacgtcctcgtcaccggcgccgcaagcggcatcggcctcgcgaccgtacgcaccctccaagcgagtgggtttaccatctcggccggcgtccaccaccgccccatgcccgacgacgtgctcgcagcgggcaacgtgacccccgtcgagctcgacgtcacgaactccgagagcgtcctcaaggcggtggcagcggccgaggcggccaacgggaccatcgaggcactcatcgccaacgccggcctcaccgacgatcagctcctgcttcgcatggatgaggcgtcgtgggccgcgacgatcgacctcaacctcacgtccgcattccgactcgccaaggccgtcgtcccgcgcatgctcaaagcccgtcgcggacgcatcgtcttcgtctcgtccgttgttgccctgctcggttcgccaggccagacgagctacgcagcagcgaaggccgggctcgtcggcttcgcgcgttcactcgcgcgcgaagtcggatctcgcggcatcaccgtcaacgtggtgatgccgggcatgatcgacaccgatctgctgcgcgcgaccggagagcaacgactcgcgtccatcctctcccaggtgccgctcggtcgcaccggtcggccggaggaagcggcgtcggttctcgcctttttggtctcggacgccgcgagctacgtgaccggatccgtcatccccgtcgacgggggtctcggaatgggcatctagcgcactcgcgcagcgcgagcggagagcctgtcggccgctcacgcgcccgtcgtgacaggcagtacggccgcaaggccatggaccagtaccacacaggaggaaccacaatggaccgcaccgaggcattcgagaagttcaaggtcaccacggtcaaggtgctcggcgtcgagccggaccaggtcgtgatggacgccagcttcgcgaacgatctcgacgccgactcgctggatctcgtcgagctgatcatggcgctcgaagacgagttctccgtctccgtgcccgagtccgagctcgagggcgtcgataccgtgggcaaggcgttcgagctggtctacgggaagctctcgtgagagttgaggcatccgagcccgaacggttcgcgtctcggcgcgtcgccgtcacgggcatcggcgtcgtgagcgctgtgggcatcggcaaggaggccttctgggagggcctccttgcaccagcacgcacgggtgtgcggcgcatcgaaggatgggatccgtctgcctggctcgggccgaaggagatccgccgccacgatcgctacaaccagttcggcgtcgccgcagcgcagatggcatgggacgacgccggagcgccatcggtcgatccggcgcgcgccggtgtgatcatggggaccggcgtcggcgggctcgagagcctcgagaaccagatcgtcatggcggagaagcgcggctacgaccgcatcacgccgttcctcgtcccgctcttcatggccaactccaacgccgcgtcgatctcgatgcgcttcggtctcaacggtccttgcgagaccatctcgacggcgtgcgcggccgggaaccacgccatcgccaacgctgcgcacctggtcgcgatggggcgcctcgacgtggccctcgcgggcggtgccgaggcagcgatcacgccctcggcgacagctggcttcaccaacatgaccgcactgtcgaaggaggggatctctcgaccgttcgatcgtgaccgagacgggttcgtgatggccgaaggtgccgcggtgctcgtgctcgaggatgccgagcatgctcgagcacgtggcgcgcacatctacgcctacatcgaggggacggcctcgaccgccgacgcccaccacatcaccgcacccgcccctggcggcgtcggtgcgcgcagcgccatcgagctcgccctcgccgatgccggcatcacccctcgtgacgttggccacgtcaacgcccatggcacctcaacaccgctcaacgaccttgccgaggctggtgcgcttcgtgccgtctttggtgacgccgtaccgccggtgaccagcatgaagggggcgctcggccacgcgctcggcgccgccgccgcgctggaggcggtcggggtcatgctcaccttcgagcaccagctgatccccccgacgcaggggacggtcgccctcgatccggagatcgacatcgacgtggtcctcaaagatcctcgcccgctgccgccggggcgcatcatctcgaatgcgttcggcttcggcggtcacaatgcggtgatcgtcttcggcccgccttcgacggactgaacctcgcgctcgccgcgcagcacacgcagcgagacaacacgaagggtcgcccgaaacgcctcgggcgaccctttgctgtgccacctggctgtagtccggctgcgcgcttgacgcatggtcgcccgatcggtcatcgtcatagcaacgaaccacggggccgagccccgacccttagcgagggtcgcaagcatccgccaaccctcacgtccgctctccgctcccggcgccccggcgttcgcccctgtagcggacgctcggggatgcgagactcagcgctcgcgagaggcgtgttcgccgaggatgatctcggcgccacgctcggcgatcgcgatggtcggtgcgttggtgtggccgcgaacgatctctggcatcaccgatgcatcgacgacgcggagcgccccgacgcccctcacccgcagcatcgggtcgaccaccgagcgctcgtcacgtcccatacgtgcggtggaggtcgggtgatagatggtgtgggccacgctctcgagcgcgagtaccgctcgttcgtgggggtcgagccgctccccatggtccggcatcaaaagacgtccggtcgtgtgcgcccggagcgccctcgaggtccgcagcacctcgagccgctccagccctgcgatcatgcggttcctgtcgtgtccgtcggggtcggacagataggcggggtcgatacgtgggcccacgagcggatcggggctcgccagcgtgacgctgccgcggctctcgggcgtgagtaggatcaccccgagcgtcagtccatcgaccgtgatgggcacgagaccctcgccgagataggcgaccggcgcgaagaggacctcgagatcgggtgccgcaaggcccggatcggatcgccagaacccgtaggcctcggcgatgttcgaggtcagcatgcccctccggcccacgaagtagcgcaccacttcggcagcgctggtcgctgagcgcagcgtcggttcggtcgtctcgaggaccataccggccacgaggtgatcgcggaggttccggcccacctcgggggcgtggtacaccacccgaatcccaagccgtcgcagtgcaccctcgtcaccgatgcccgagagcatgaggagctggggcgtgttgaccgctccggcagcgaggatgacctcggcgcgcgcgcccagcgcacgccgctcacggccgacgagatactccacgccaacggcgcgccccccctccacgatcacccgcgtcacacgagcctgcgtgcgcacgacgaggttggggcgatggcgcaccggccgcaggtacgcatcggcaacgctcgcacggcgtcccgacgcctgcgtgaccaccgtctcggtgaagccttccgggctcgggaggttcggggcctcgacgaccccgccggtctcgcggatcgcgtcgaggaacgcgcgcgtcacgggccgtggatcgcgctgagcctcgacgggaacgaccgcacgccgcatcgccgccatcatcgggtcgaagccccacgcaggaccggcgagctcggcccagcggtcgtagtcggctcgcatcccgacgacccacatcatcgcgttgatcgacgaggagcccccgaggcccttgccacgcggccagtagatggagcgtccttggaggttcggttgcgcaacggtgcgataggcccagtcgtagcgcgatcgaaacagtcgcgcgaacccggcggggatatggatgagtggcgatcgatcgcgcggacccgcctcgagcaccacgacgcgatgccgaccatcggcactcaagcggttggcgagcaccgcaccggccgatcccgccccgacgatcacgtagtcggcgtgctcgtccaccaccgccccttacgactcgctggccccgctgcgactgcgtcgaccgggtcggcgaccacgctcgtgggcctccatccgccgccgaatgagctcgcgccgttctcgcagctcgcgataggtcagctgctccgtcgtctcgtcgacgccgaggctcgccttcacgcccgacagatcgatcagctccggcgagaccgccacgccgatctcggacgtgatgcgcgcaccgtacttcgtcatgaagtaggcagccagacgagcgatctcggcgaagaggtcgatgtcgggggcgagcgtggcgagcgacgcgtccacgaagagcatgttcttcacgaagagcatcagctccttgggcatgcgagcacccgagccgagcagcgccttcgtgatctcctggagctcagcgacgagctgctcgggctcgagttccgtgggatcgacagccggctggtccagcccgagatcgtcgatcacctgctcgggatcggtcccaggcgggagcgcaccgagatcgatcagcgcctgcacctgcgtcgtgagatcgttcatcgagcccgccatcaacagccgcaagaaagcgaggcgcttcggctcgctcaggcggccggtgatcccgaagtcgagcagcgccaccgtgccgtctggctgcacgaacaagttgccaccgtgcaggtcgccatggaacacgccgtggagcatcgcgccctcgaggaagctgacgagcgccgcacgcaccacctcggtcgtgtcgatccccgcgtcgtgcatcccgcgggcgtcgtcccaccggtagccgtcgaggcgctccatcacgagcacccgccgcgtcacgaactccgggtggggcctcgggacgacgatggcgcgctgctcggtcgcggcgagcacggcagcgatgtcgagcatgttggcggcctcgatgcgaaagtcgagctcctcgacgatcgtctcggcaaacagctcgacgagtgccggcgggttggccagtgccgccaccgggatcctgccgacgaggtgcggcgtgatccacgccatcgcggcgaggtcccggcgcaccagctcggcgacgcgcgatcgctggaccttgaccgccaccggcgtgccatcgcggagggtcgcgtagtagacctgggcaatcgacgccgcagccaccggagatggatcgaaggatgcgaacagctcttcgagcggcgcatcgagctcctcctcgatggtcgagcggacgacggcgaagggctcggccggcacgcgatcgcgcagctgcttgaactcctcgaccagctccaccgggaagatcccctcccccgatgagatgatctggccgagcttgatgtaggtggggccgagcgtctcgaaggctcgtcggagccgcctcgagaggccccggcgcgacgcggcacgaccccgagggcgatcgaacaaccgccatgccccgagggcgacgccaagggacaggcccgtcccaaggacacggcgcgccggcggcacccgccgcggcgccgtcaacctggggatctgcgcctgtgccctcgcccgcagcgcgggcacaccctcggcccacaggagccgacctgcctccacgcgccatggaccatgttcggtgaaggaccactgctgttcgtcagaggccacgatggcgagcctaccgggccctctcgcgcaccgaccggttctaggggcggcgctcctcatggcctccgaactcccggcgcagcgccgagagcacccgattggcgaacgcgtcctcgccccgagaggcgtagcgcgcaaagagcgcggatgcgatcaccggcgcgggcaccgtctcgtcgatggcggcgagcacggtccagcgaccctcgcccgaatcggcgacacgaccctcgagctgttcaaggtgggggtcgtccgccaaggcccgcgcggcgagatcgagaagccaggatccgaccacgctccctcgacgccagagctctgcgatcttggccacgtcgagttcgtagcggtaggcgtcgggctcacgcatgggggccgtctcggcgtccgcggcgagcgcgaccgaacccgcgttggcatgctcgaggatggagaagccctcggcgaacgccgccatgaggccgtactcgatgccgttgtgcaccatcttgacgaagtgtccagcaccgtgcgggccgcagaggagatagccctgctcctcaggacccaccgcgacgtcggctcgcgtgcgcggcgccgcgtccacaccgggcgcgagggccgcgaacgccggctccaggcgtgcgaacacgtcggggtcaccaccgatcatcaagcagtagccacgctcgcggccccatacaccccctgacgtgccgacgtcgagatgatggatgccccgagcagccagggtcgctgcatgggtcacgtcgtcgcgatagaacccgttgcccccgtcgacgacgacgtcgtccggggcgaggagggagccgagctcgtcgacgagctggctcgtcagcgcggcgggcaccatgagccacaccacgcgcggtgcctcgagtgcatgcacgagttcgtcgagggagccatgcacgctgaccccgagggcgctcgcggaggcgcgtgcggcctcggcggggtcgaatccgtgcacctcgatgcccccgcgctcacggagccgagccgccatgttggcacccattcgacccaagcccaccatgccgatctgcatctcacggcctcctctcgcctcgcctacgctactggttgacgtcctcgatgctccatcgcacgatcccccgcttcgtgcaacgcacgcacgaactcgccgagctccgccggtggtgccccctcgagcaccctgcgcacgatcgccgaacccaccaccgcgccgtcggcaccggcctcgacgaccgcagccgcgtgctccgggctcgagaccccgatcccgacgagcaccgccaactcagcacgcccggcgagccgcccggcgatctcggtcgccgtctcggcgagctggtcgcgctcaccggtgacgcccatcaacccgaccgcgtagacgaagccctccgcagcgcgcacgatgcgctccatgcgcgccgggggcgtcgatggcgcgacgagctgcacggtctcgagaccgacctcgcgcgccgcccgccaccacggctccgcctcctcgatcgacagatccgggatgatgacgcccgcaacgccggcctcggccaggcgtccagcggcacgttcgagcccctggtgatagagcaggttgtagtaggtcatgaccacgagcggcacgccaacgaccaggttccggagcgcagcgatcgtaccggcgaccgtcgtgcctcgctggagcgcgacctcgctggctcgctggatggtcggcccgtccatggaggggtcggagaacggtatgccgatctcgatcgcgtccgcaccaccctctgcgagcgcgacgacgtcgtcttcccagccgtcgcgcgcgccagcgcacacgtacgggacgatcacggaccgtccacgctcgaccctggagcgaaggtgggcaccgaggccgctcaccgccgacccccgaggtacgcagcgaccgtctccgcgtccttgtcgccccgtcctgacagagtcaccacgatgcggtcaccgggctgtgtgcgcgccgatccctcacgcagcacccacgcgagagcgtgggccgattcgagggccggaacgatgccctccgtccgcgacaacgccaccagcgcatcgacgacctcgtcgtcgccgaccggttcgtaactcacgcggcccgtgctcgcccagtaggcgtgttccggaccgaccccggggtagtcgagaccggccgagatggactcggcctcgcgcacctgaccgtcctcgtcctggaggagcatggagtgcatgccgtgcaccacccctggccccccgcgtccgatggcggcaccaccggccggctcgaccccgacgagccgtgccgacgtctcgacgaagcccgtgaaggtcccggccgcgttggaaccaccgccgacgcaggcgacgacgagctcggggacgccaccggcctgggcagcgaactgctcgcgcgcctcgtcgccgatgacacgctggaactcgcgcaccatccaagggtacggatgcggacccatgaccgaaccgatgcagtagtgcgtgtccccgagttcggcaacccaggcgcgcatcgcctcgttcaccgcgtccttgagcgtgcgacttcccgccgtgacctccacgacctccgcaccgagcagtcgcatccgaaagacgttgagcgcctggcgctcggcgtcgaccgctcccatgtacaccctcgcctcgagcccgaggaacgccgctgccgtcgccgtcgcgacaccgtgctggccggctcccgtctcggcgatgagtcgccgcttgcccaaccgccgcgccagcagcgcctgaccgagcacgttgttgatcttgtgcgagccggtgtgggcgaggtcctcccgcttcagccagacctcgcgcccgacgagctccgagaagcgctctgcccgatagagcagggtgggccggccggcatacgtcgccaacagacgcgcgtattcgtcccggaatgcgacgtcggcccacgcagctcgaaatccgctctcgagctcgagcaccgccggcatcaacgactccgggacgaagcggcctccgaagtcgccgaagcgaccagtcgcgtccggcgcgttcgtccccttaggctcgatcatggtcatcggtctctccttccaatgctgcagcggcccctcgcgcagcctcgatgaactgtcgcaggcggatcgggtccttgtggccaggtcgagcctcgacaccgctcgagacgtcgacgccgaacggcatcaccgtctcgatggcctgcctgacgttgtcgggtcgcagcccgccggcgaggatgagtcgccgcatcggcgagatcccgtcgacgagcgaccagtcgaacaccgtgcccgagccggggctcgcggcgtcgacgagcagcgcccacgccggttgctcgatcgcgcgatcgaactccggcgatccggccgcaacggcgcggatcacccacggcgtgcgctctgcgagccaggcgagcccgtcgttcgagatctgaccgtggacctggacgccaccgagtccggtctcggcgaggacctgcgccatgcgctcgggcagttcgtcgcgaaacacgccgaaggtccgtacgccagaaggcaactgcgggaggatctgggcgatccgcacgggcgacacctgcctcgggctcggcgcgagcacgaagccgagcgcgtcggcaccgagggcaacggccagcagggcgtcagactgattcgtgatgccgcagatcttgatgaacactcgcacctcgctcgacgagcgcccggacggtcgcgtaggggtcccgagcacgcatgcaggcctcaccgatcaggacaccgtcgaagcccacgagccccgcgagatcatcgggaccacgcacgcccgactcagcgagcctggccgcgcccggcgggagcgccgcgagcacgcgacgcgcccgatcggtgtccacgcgaaaactcgtcaggtcgcgttgattgacgccgacgacgtccgcggcggcaagctcagcaagctcgagctcgctgagctcgtggatctcgaggagcacctcgagcccgacgtcgtgggcgacaccagcgagagatgcgacctcctccggctggagcgccgccgcgatcagcaagaccgcgctcgctcccgcgcgacgggcccggagaagctccctcgcgtcgacgatgaagtccttgcgcacgatgggaagctcgacgtgctgcgcagctcgctcgaggtcagcgagggtgcccccgaagtgcggtgtgtccgtgagcacgctgaccgcgaccgccccagctcgctcgtaggccgagactcgcgtcgcaacgtcggtctctggctcgacgaaccagcccttcgacgggctgcggcgcttgaactcagcgacgacaccgaggccagccgatgccaggagcgccgagcgaaggctcgggcggggctcgatggcgtcgagtccggcgagcagactcgtgaacgactcgtcgtccaaggcggcacgccgacgatggtaggcgacgatgtcggtcaggtagtcggccatgggcccagcctaggtgccctgcggcccggctcgaggcaggccgcctcgcagctcagggcaccgtgtgataccggtccgttttgcttgcacaatgcaacagaaggtctcgacttcgctagaatgtggccagagcgcaccgcagtacgcgccagctacggaggtcgatcagcgtgacgaagtccaggggatccatcagggaacggagcttccgcctcaccgaacacccgcactacaagtggatcgccctctccaacacgacgctcggcatcttgatggccacgatcaactcgtccatcgtgctcatctccctcccggagatcttcaacgggatccatctcaacccgctcgcaccgtcgaacacgtcgtacttcctgtgggtcctcatgggctatctcctcgtcacggcggtgctggtcgtgagcttcggacgcctcggagacatgtacggccgcgcacggatgtacaacctcggctttgcgatcttcaccctgttctcgatcgcgctctcagcgacctatctccacgggaccgccggtgcgtggtggctcatcgtcatgcgcatcggccagggcatcggtggtgccctcctctttgcgaactcggctgccatcttgaccgacgccttccctccgaaccaacgtggcctcgccctcgggatcaacaacgtcgccggtatcgcgggctcgttcatcggcctcatcctcggtgggctcctcgccccggtctcctggcgtgccgtcttcctcgtctcggtcccggtcggcctcatcgggaccgtgtgggcctacctcatgctgcacgacctcggtcagcgggtgcgagcccacatcgactggctgggtaacgccgtgttcgcggtcggcctcatctcgatcctcgtcgggatcacctatggcctcgaaccctacggcggaagcgacatgggctggggcaacccgggcgtcatcgcggccatcctcggcggtcttgcaaccctcggcgtcttcgtctggatcgaacagcacgttccccaacccatgatcaacgtgcggctgttcaagatccgggcctacctcgccggcaacctggcgagcctgctcgcctcgctcggccgtggtgggatgatgttcatcctcatcatctggctccaggggatctggctccccgagcatggctactcctactcgcagacaccgctctgggccggcatctacctcgttcccctcaccatcggcttcctggtcgcaggaccggtctctggattcctgtcggatcacttcggcgcccgtccgttcgcgaccggcggcatgatcgtcgccgcgatctccttcatcgccctgctcaccttgcccgtcaacttctcgtatctcaccttcgccggtctcttgctgctcaacggactcgcaatgggcctgttcgcctcacccaaccgcgccggaatcatgaacagcctgccggtcaacgagcgcggcgtcggggcggggatggcagcgacgttccagaacgcggcgatggtgctgtccatcgggatcttcttcaccctcatgatcttcgggctcaaggcgagcctgcctcgccatctctacgacgggctcacccaacagcacgtgcccgcctccatcgcccacgcactcgccaccctgccacctgtcggcgtcctcttcgccgccttcttgggctacaacccgatggccaagctcctcgggcccaaggtcatcagtgccctcccgcactcgaacgcggcgtatctgaccggccggtccttcttcccgaacctcatcgcctcgccattcggtcacggcttgacggaggccttcaccttcgcagccatcgcgtgtgtggtggcggcggtcgcctcgtggctgcgcggtggcaagtacaccgcggccgacgtcgagccatcggactcggccgatccctccgtcgccgacgccgtctccgagccggtcgctgggggcgacgcctgagcgaagcgcctgctcgcctgcccctgctaggttgaccgccgtgggacgccatgtcctcgtcgtcgaagacgatccggcgatcgccgatctcctctgcgtgtactttgccaaggaggagggcgaggtccgtgtcgtctccaacggcgaggacgcgctcagcgcgttcgatgcctcggtgaccctggtgatcctcgacctcaacttgccggggcgcctcgatggcctcgaggtcgcgcgggcgattcgccaccgctcgaccgtcccgatcatcgtgctctctgcgcgcgacaacgaactcgatcgagtcaccggactcgaactcggtgcggacgactacgtcacaaaacccttctcaccgcgcgagctcctcgcgcgggtccgggcgatcgagcgtcgtgtcgaggcgaatccctcgtccgcagcggcgctctcgttcaacggcgtcgactgggacccacgggcgcgtcaggtcctccgtgacggggtgccggttgcgctcacgaaccgggagttcgacctcctcgggtacttctttgcccacccggcgacggcactcacccgccgtgagctgctcgacggggtgtgggggccggagtggtacggggacgaccgaaccgtcgacgtccacgtcctgcagctgcgcaagaagctcggcggcgccatcgccatctcgaccgtctggggtgtcggctaccggttcgaccccgaggagcactagcgtgcgacgacgccgtcgcccgacgatccgaacgacgctccgcgccgggctcgcgaccaccgccgtgacgaccgccctggcagccggcgtcggcacgctgctcatcttccgctccatcgctctgcacgagaacgagagcttcctcgcgcgccaagcgagcgtggcggccaacgtcgcaagccgcgccgagcacttcttcctcggtccccacggcgcccataccttcggcgcgcgcaggttggtgcgcctcgatccgtccggccatctcggcggccccgtcccggccgagctgcacggcgtcgtcctccatccgccacagctcgttcccggtcacgtctccttcgtggtgcgaggtgacaccgtctgggccctcgaccccgtcatcctcgtcgaccgccacgcccaacgcacctacgcggtcgtcctccatcgctcgctcccgtccgagctggtcccagccctcttcgtcgtggcgctgaccttgctggcggcgctcgtggccatcttgctcgccgacgcctacacccgccgcgtctcgtcggtggtggcggacctcgcggcgctcgccgaacgagtcagccgtggcgaccttgcccaggcaccgccgtccgagccgatcgcccagcgagaactcgacgatctgcgacaggcccttgcggagatgatcgcctcgctgcgcagtgcgagcgagcgtcagacatccttcctcctcgccatctcccacgacctgcgcacgccgctcacgagcatccggggcttcgccgaggccatcgaggacggcgaggtggttcagccggcccatgccgcaagcgtcatccaacgcgaggcgcagcgcatcgagcgcctcctggccgacctgatgagcctcgcacgcctcgaggccgatggcttccgcgtcaccgtgacccccctcgatctcggcgatctcgtcgagcaccttgccgagaccgctcgtctgcgcggccgcacccaagggctcgaggtgcacgcgtcgctcgcaccggatgcgcgctccgtgctcggcgacccggagcggctctcgcaggcgctcgccaacatcctcgacaacgccgtcaagttcgcgcgcagctcgatcgacgtgatcgtcacccggcgcttggagagcgtccgcatcgagatcaccgacgacggacccggcatcccgccgtccgtgcgcgaccagctcttcagccgccaggtcgcgccacgcccaggtcgcaacaacgagatcggctctgggctcggcctcttgatcgccgcacgcctcgtccaggccatgcatggtcgcctcggcgcgagctccccgatccgatccgacggcggaacacgcatcgtgctcgaactaccggccgccgtccacgaccgcgtaccctcgcaggtcggctgagccagaggccgacgcttcactcgcaatcgcggccaccagtgcatcggtgagcgttgtaggcgagcctgcgtcgccgcgaccgtggacgaccagatggagcgcggcaagtgcgcccgtgagcgctggcgtgatcggacaggcctcgactgcgcactcgtggccgcctcgatggcgccagtgccacgcgagcgcgcccggcagcgtcgtgtaggccgccccgacggcctcggcggcgacgccaggatcgacccaggcagcatcggcgcgtgccagttccgggcgaccgaggaagtagccctgtccgagctcgatgccgagcgcgcgcgccacctcgaactgggcacgtgtctcgatgccctcgagcacgaccgagcacccctggccctcgccaaggcgcgccacggcatcgagggtcacgatggcctgcaggggattctcaccgagggcagcgaccacgtcgctcgcgaccttcacgagatccaccgacaagctcgcgagccggacgatcccctgaccgctgctcccgacgtcgtcgagtgcccgacgcacgccaagcgctcccagcgcaacgagcgtggcctcgagcgatgagggtgctccggtcgagtcctccaggacctcgatcgtgagccgccacggcgcgaccgcgtagcgctcgaggacccggcggatggtgtcgaccgaactcgggttggcgagcaccgcggtcggtgcgttgaccccgatcgcgaggtcggggcgcaggcagttcgccgccaggccgactgcgtcatcgaggacccgctcgaagagctcgccgagctcggcagcggagagaaagggcaggaactccgccggcgaccagagtcgacctcggccatcgtcgagccgtgcgagcgcttcgagcccgatgacactcgcgtcgccgaggcgaacaatcggctggagtgcgagccgtacgcctccaccacgcagacgcgtgaggatctcacgccggccaagcgtcgagtgatacccacgacggagcaacgcgatacggtcgcagatcgcctcgacgagccgaccgagcaagggttctgtcgcatcgggtgcgacctcgaccgcgaccacgagcccccagacgctcgagtcctcgcgtcggcacacgatcgccccgtcgccgacgacctgctcgtccacgccgatgacgcgccgcgccagcggtcccgacggctcctccagcgcggcgacgagcgcggctcgctcgcgcccagcgcttcctcgaacgcgcaaccgacccgccccggtgacctcgacgagcgccgcgccatggactccggcgagcccgcccgcgacgtcgacctcctcgaggaccgacccgagcggtcgaccgtcgaggccgtcgagcgcctcggaccagcgggccctcagcacccgacggcgagcaccggcgacgttgagaccggtctcgagtcgcgccatggcgatgcgggtcgacggcggtacgtcagcgagctcggccacggcgccgccaccccatctcgccaccgccctcgctgccgccgccggaccgtcgacgagcgcgtcgagcacctcgtcggggagcgcgcctccgagcgcgacccgccacgaagggtcctccgcgagctccgccgtggcttcggggccccacggatccacgatggcactgcgggcgtcgctcgctcctgcacctcggacactccgggcgcgcttcgcctcgtacatcgtggcatcggccacgcggagcagccccgcgagatcgccggcgtcccgcggccaccaggaccatccgacgctcgccccgatcgtcaccgcaaggccggcctcgagctccacgggtcgccggagggcacggccgatgcgctgtgcgagatcgcgtgccgccgcctcgtccatcgcaagcgctgcgaggatgacgaactcgtcgccaccgaagcgtgccaccagtgccgacggcagccggcgcgcgacctcaccggccacacgcctcgccgcctcgatgaggacctgatcgccgacgacgtgaccaaaggagtcgttcacctccttgaagtcatccaggtcgatgagcatgcacacgaccgcacccacactcgcatcgctcgtcaggcgaacgagccgctcggtgagcgccatccggttcgcgaggccggtgagtggatcccgcctggcgatcgacctcgcctcggcttcggcacggcgcagtcgatccacgagtgcgaactctgcgacctcgcggtcgatggcgccacggatgcgaggctcgaacggcgcgagccaagcgcgacggcgtggatcgtcggcgacgacctcgagaccgtcgccgtcccttccctgcagcacccgcacgcccggcacgcggccgaggatgcccgccgccgcttccaggaaggctccgacgctctgggcaccctcggcggcaccagcgagctccgcgagcgcgcgctcgagcgcctcccgccaggcgagttcggcctggtagcgctcggagtctcgcacgaagcgctgcgtgacgagcgccgacgcacccaccagcacgacgatggcagccacgagtgcgctcatgggtccgctcgcggcgtcgaggacgctcgttcgggcagtgaactccacctcgaccggcccgagcgcactcgcaacctgtacgtgcatcgtggccgcagtggcacgatcgaacacgcgcacgcccccgatcgcaaggctcaccgccctgacgccggtctgtgccggggctgcgacctgcaacgttcccggcgcgacaagggcctcgacgaggtagtcgacctgcgcacttcggcgtgcatggatcgcaacggcgatctcgaacccgttggacacacgaaccaacctcgtccccgacgcgccgacggcgacaggatcgaccgcacgcccggcccgccaccagatggatcctccgtgcggggccacgaccgcgatcccctcgatggctgattgacgggcgacgaaggcctcgagcaccggcaccatggtcgccggcaacgacgcgagcgtcggacgaggcccgatgagcaccgtcccgacggtgtcgagatcggcgacgacgaggtcggctcgcaccgcgacgcgccgagcccacgcccgtgcaacggcgttcgcaagcgctcgctccgacgacacactggacgcgtccacacgccgcaaccacgaggccccgacggtgagcgcgaggaggagcggcatccagatggcggcgaggacgacgagacgccaccgtccccgcagccgccatgtcataccgagagtgatcgaccaaccaggtcgcagagttgaggcgcctagcctgggagcatggacgccacgacggtcgccacagcctcggggccgagcgacgcctcggggcccagcgacgcgttcaccgcacccttcgttcgggtccaggtcaccggtcgggatgcggctcgctacctccagggtcagctgtcccaggacgtctcgaccctgaaggcggacggccagggggcgatcagcgtgctcctcggcgtcgatggccacctcgtgacctggctcagggtacgtcgcctcgccgacgatgccttctggctcgtcgtcgccgaggcgcatggcgaacgcgtccgccaacgcctcgagcacttccgcatccgcacccaggccaccatcgagctcctccctggccacctccacgttcggcctccagagggcctcgagcctctctggcccctcgaccaggacgcaccgttcgtcgacgcgcccgccgacctcgcccgcttccacgccgaacgcctcgtggccggcgccttcgatcctgcgagcgatctcgtcgacggtctgctcgcccacggagtacccacactcgtcgagcgtgcagtgagcttcaccaagggctgctacaccggtcaagagctcgtcgcacgcacgtcctcgcgaggagcgccggccccgatcggcctcgtcgcactcgagctggccgagccgatcgccgtcgctcccggtacggcgctcgtcgtcggcggtgtcgacgccggagcgatcacgagtgccgcggtggtcggcgaccgtggctacgccgtcgcctaccggcgccggcgcgcgcgcgagcacacgcacttcgacgtcggcggcgtcggtgcgacggtgcgatcgtccgcaccctagcgaggctcacacgaaccgctcagagccgcagacctctgcccgtgacgctgcctcgcacagtggcgagggtcgatcgcgcgctcaccgctgaccacagctcgccccaggggacctcgtgtgacgacggcgttcagacctcgatgaggcgatcggcgacggcgactgcccgggccaccgccgctgccttcgccacgcactcggtcgcctcccgttccgggtccgagcctgcgacgatgccggccccagcctgcaggagcacccgaccgttctcgagccagacggcggtacgaatcgcgatcgcgaagtccatcaccgcgctctcggggtcggtgccatcgcgaccgacgtagccgacgacgccgccgtagaccacgcgtcgcttggactcgagctcgtcgatcagctgcatcgcgcgcaccttcggggcacctgacagcgtgcccgccgggagggtcgccgcgagcgcgtcgatcgggccgacgccgtcggtcagctgaccatggacgctcgaggtgagatggatcacgcgcgcgaagcgctcgggcaccatgaactcatcgaccacgacgctcccgaagcgtgccacacggccgacgtcattgcgggcgagatcgaccagcatcaggtgttcggccctttccttcgggtcggcgagcagctcctcgatgagagcctcgtcgctcgccccacccgaaccccgcggccgggaaccggcgatcggtcgcgtccagacgacgccgtcgcgcaccgtcgcgagggcctcgggcgaggagccaacgatcgcacccccggcgtccgtgatgagatacatgtacggcgacgggttggtgaggcgcagcgctcgatagagcgcgagagggttcgcccgggtcgtgagctcgaagcgatgcgacagcaccacctggaacacctcgccctcgtcgatcgcctgcttcgcgagccggacggcgtgcgcgaacggctcccgaaacccttgatcgagcagcgccaccccctcgctgggatcgtcaccaagtggccaggcacgcaccggtcgcccgacggccgactcgaggtcggcctcgagacgactgagcgccgccctcgccgctgccgcggccccgacgggatcgtcctccacgagcagcgccgacgagagcgtgagcgactgcgcccagtgatcgatcacggcgaggtcacccgcgaggaggagccgcgcctccggcaggccgacgtcgtccgggtgcgaactcggcacgctcggctcgcgctctcggaccgcctcgtagccgacgtggccgacgaacgctgccgagaacggtccggccatcgggcacccgtcgtcgacggcgtcgacctcgagcccctccgaccaccgacgcagcccatcgagaatgcccggtgcctcgtcgaggaccgagccgtcggcagcctcgagtcgggcgtggccgacctcgccgatgacgcgcgccaagggccgacgcccgacgaccgagtaacgcgaccagcgaccctgctggtcgaccgactcgaggatgaagcccgcctcgccgggcgccaccaaccgctcgaacacctcgatgggtgtgagtgcgtcggcgacgtagcgggcccggacctgaacgagacgcagcctcacgactgccccagcaccggatgcatgaagcaactccacgcgcccgtgtggcacgcaccgaccccacgctgacgcacgcgcacgaggagcgcgtcaccgtcgcagtcggtggtgacggagcgaacctcttgcacggcgcccgaggtctccccctttgcccagtaggtccgccgtgatcgcgagtagaaccacgtccgtccgtcacgaagggttcgtcggagcgcctccgcgtccatgtaggcgagcatcaggacctggtcgtcctcgtcgacgacgaccgccgggacgagtccatcgggaccgaaggcgacgacgtccacggagaccgcctcgcctggggcaaccccctcgatatcgctcacaggtacaaccccgtctcgtcgtcgagccgatcggaggccaccgcgtggagatcccgctcgcgcaagatcacgtaggtctccgagccgatctccacctcgtaacgatcctcgggcgcgaacagcacgagatcacccggacgcaccgagcgcaccgccggaccgaccgcgctcacctctgaccacacgagacgtttggcgatctgcgcggtcgcggggatcacgatgcccgagcgcgcgtggcgctccccctccgacggagggacgctgaccaggacacggtcggccaacatcgtgatcgcagccttcttgggctccaccgccacctcccgttgcaccacgctagccgccgatggggcgcacgacgagacccgccgcgtcgagcgcggccttgacctgagcgacgctgagttcgccgtagtggaacacgctggcggccagcaggcccgtgacgccggtccgcgcgccgtcgacgaagtgttcgacgatcccgacgccacccgacgcgatgacgggcaagctcgtgcacgacagcaccagctcgtagaggtcggtgtcgtagcccgcacgcgtgccgtcgcgatccatggaggtcacgaggagctcgccggcgccggcatccgaaacccgccggacccacgtctcgacgtcgagaccggtggggcgacgcccgccgtgggtacgcacttcccagtcgcccgcgcccgtacgagcagcgtcgatggccaccacggcacattgggacccgtagcgaccggcgaccgcctcgacgaggccgagatcggcgaccgccgccgaattcatcgacaccttatcggctccagcctcgagcaacgcggccacgtcgccgagcacacggacaccgccgcccacggtgaaagggatgaagactcgtgacgcgacacgctcgacgagatcaacgagcgtcgagcgctcctcgatcgaggcggtgatgtcaaggaacaccagctcgtcggcgccctcggcgacgtagcgctcggcgagctcgacaggatctcccgcgtcacgcagctcgacgaaactgacgcccttgacgaccctaccctcggcgacgtcgagacaggggatcaccctcacgctctgcatgcgctgagtgcctcgtcgaacccgagcgagccatcgaggagcgcagtcccgacgacggccccccacacggcccctcgtgcccctcggatcgccgcgagctttgccaggtcgtcagcggaggcgaccccgcctgaggcgatcacctcgaccggcacgacctcgcacagcccctgataggtaccgagatccggtccgctcgccatgccgtcgcgtccgacgtcggtcaggagctgggtccgtacgccgcgtgcgaacagtcgagcggacgcctcgaggagccgccgaccaccagagcgttcccatgcgctcacgacgacctcgagcgccccttcgtcgccacgccgatagtcgagcgccgcgaccagatgctccggatcgagctcgtcgagcgtctcctcgacgagtgccgtcccgagcaccacgcgcgacgcgcccgtctccagcagttcggcgatgtccctggccgtacgcacgccgccaccgacctcgaccgacccgccggcctcgcgcacgagcgcgatcaggtcgccgaccatgtcggcgttacgacggtcgccgggcgtgcgggcacgatcgaggtccaccacgtggaaccaccgcgcgcctgcgtcgagggcgccctcgacgtagcggcgaggatcgccgaaacgccgcggcgcatcgaaccggccctgccgcagccggacagcctctccgtcgagcagatcgacggcgaccacgagttccacgcctaacactcctcctggacccatcgccacagcgcatcgaggaagcgcagacccttcgcccccgagcgctcggggtggaactgcacaccgagcagcgcatcgcgaccggcggcggcgacccaggtgccaccgaactcctcgaaggcaagcgccgcaggcgtcgtcgcgacggcgtaactgtggacgaagtacacccacgcaccctcgaggaccgccagtggccccgaggccccctccgccactcgcaaccggttccactgcatctccggcagacggggcgcagggctcatgcgctcgacccagccgggcaagagaccaagtcccacacgatcgggcgcctcgtcgccgccgtcgaagagcgcctgcatgcccacgcagacgcccaaggtcgccatgccgcgctcgcgacggcgcaccatcgcctcgtcgagaccggtcgccgcgagagcgtcgagcacgctgccgaggtgaccgacgccgggcacgacgagcagccgcgcctcgtcgaaatcggctcggtcgctcccccgcctgaccggatggccgagtgcccgccacgcccccacggcagccccgatgttgccgataccgatgtcggcaacaacgatggcagcgctcacaaggagcccttggtggagggaatctcgccgcccccgctgacggccgtcgcctgggcgagtgcccggccgagcgccttggccatcgcctcgatctggtggtgggtgttcgcgccccgaatcgaccggacgtgcagcgtcaagcggccgcctcgagccagaccccacaggaactcctcgacgtgctcgagcgcgacccccgggctgcccaggaggagcccacgctcgccctcgagggcgacccatgcgccgggcctcccggacaggtcgacgacgacctcgacgagcgtctcgtcgagcgggatggtggcagccccgaagcgctcgatgccgcgtcgctcaccgagtgccccatcgagcgcctgaccgagcgcgatgccgaggtcctcggtgaggtggtgggcgtccacctcgacgtcgccgcgtgctgcgacctcgaggccaatcctcccgtggcgcgcgatctgggtcaggacgtggtcgaagaagggcagccccgtcgacacgtcctcgcgtgggcccccgtcgagctcgagccgtacccggatgagcgtctcgcgagtctcgcgatcgatgatccccacacgcccactcacgcgagcacctccccgagtgcagcgaggaacgcatcgttctcgtccgcggtgccgatcgtgacccgaagcgtgttggagagcccgggccagcgcgacgcatcgcggatgaggatccctttcgccacgagtccctcccatacctcggtcgcaggccgacccggatcgaacaagatgaagttggtcgcactcggccacacgcgcgcagcgagcgtgccgagggcctggccgactcgctcgcgttctcgaacgacgagggctgcgcgtcgtgcgatctcgtccacatcggccagcgcagcgacggcgaccgcctgcgtcaccgcgttcacgtgatacggcaggcacgccgaccagagcacgtcggcgacctcgggcgcacagacggcataacccagccggagtcccgcaagcccggcggccttcgagagcgtacggatccgcaccacgtgatccccaagcagggtcgcagggccgagatcggcgaagtcggcgtaggcctcgtccacgagcaccagccgatcgtcgcaggccaggacgcggtccatcacctcgggcggctcgagcatccccgtcgggttgttcggctggcacacgatcacgagctccgagtcggcctccagactcgacggatcaatcgacccgtcggatcggcgcgcaccggcgaccaccgtggtgcgcgtcacacgggcgatctggcggtacatgccataggtcggctccgcgagccacaggcgtcgaccgggcccaccccaggccgcgagcacggtctcgagcacctcgttcgacccgttcgcgacgaagatcgaggtcggcgcgacaccgtggagcctgccgagcgcagcgcgcagcgcctcggcgcgccgatcgggatagcgcgccagatcgagcgcgaccgcctcctcgagcgccctcgcgacggcgggcggcggaccatacggcgactcgttggtgttgaggcgaaccctggcgggaacctgggccgagtggtagctcgcccccagcgcatcctcgagcgacggagccggcctcaccatccggcctcccgacggatgcggatcgagtccgcgtgcgcgacgagcccctctgcgtcggcgagcgcctcgacggcccagcccagccgactgagcgcctcgtcgtggacctcgacgacgtggaggcgacgctggaagtcttcgaggccgagcacgctcgcaaaacgcgccgtcccagccgtcggcaggacgtgtgaggggccggccacgtagtccccgaacgcggcactggctgctcgtccgacgaagaccacaccggcgtggcggacccgatcagcgtcccgaaccgcctggtcgtagagcagctcgaggtgctcaggcgcgatcgcgtcggccaccaggcgagcttgatcccggtcgcgcacgagcgcgagatagccgtgcgcctcgagcgtgctctcgagctgggcgcgcctgggactcgcctccacgtaggccgcgagctcttcgagcacctgctcggcccagcgggcgtcccaggtcacgagccaggccaggccatgggggccgtgctcggcctggaccgcgacgtcgatcgccgcgacgcgcggctcaagggagccgtccgcgaccacgaccacctccgaggggccggcgaaggcacccggcacaccgacgtcggccgcgacctcttgcttggccagcgagacgaagaggttgcccggacccacgatgacgtcgacacgctcgagcgactccgtgccataggcgagcgccgcgaccgcctgcgcgccaccggcgagcagcacggtgtcgaccccggccagatgacaggcggcgagcgtcgcgtcgtcgaggccaccgtcgggcaacggcggtgtggcgacgacgacatcgcgtacgcccgcaacccgagccaccgtcgcggtgtgcacgacgcttgagggatagcgagcctgtcccccgggcacgtagcagccggctcgctccaccgggacgatcctgcggcgcacctcgatgccgtcggccaccagcgacgacgccgccgggcgctcggcctcgtaggcctcgcgcacgcgatcgcgagcgacccgcaacgcctcggccagccgccgatcgaggcgctcgtaggcggcggccatcgcctcgcgaccgaggacgagcgctcgcggccgcacgccgtcgaagcgctccgtcagatccgccagggccccgtccccacccgtgcgcacactctggacgatctcacgcacgagtgcccgtggcccttccaccggcaacgccaccccgggaagatcgtcgcgccgcagggcgccagtcgtctcgcgaagatcgacaagggtcagcgatgccatgggactcctcggacagcagggcagctcagcggcgctagtctaccggcggcgaccgcgacgaggaacgtggcgaccgtaacggaggaacgctgtggccgaggctcacgagctcgcctcgatcgcgagcacctacgaggagctcgctcgacgcatcgaggccatcgagcgctcgctgctcgccgaccatcgagacgggccggcccagtcgctgcgggccgcgtgggcactgaaccgagccctcctgcgcgaactcgatgaggcgcgtcgccgtctcgagagctgatgcgggtcccagccctcgctacgttcgcggcaaccttcgcgtaacgtacccctggtagtcttcgctccatgacccacctcatcgaaacgtggggcgtgctcgcggtcttcgcgctctcggtcgcacagtcgctcggcgtacccacctcctctgagctcaccttcggcctcgtcggcctcctctgggccctcggacggatgaaccccgtggcgggcatcgccgccggtgtcatcggcgaactcatcggagcgatcgtcgcctggtggcttgccgccgctgcggtcgagtctcactggtgggcgcgcttcgaggcgcacccgctcgtggccgcctttcgtggtgtgctcacctccctccttcgccgccgcttcggcgtgctgatctcgcgcctcatccccctcgagcgcaacgtcgcagcctgggcggctggcgtcgccgaggtctcgctcggtgcgctcgccctccagagtgtcgtcggatcggcgatcttcgccaccgcgtttgccctggccggctacgaggccaaggacgcgatcaccaccatcgcgcaccgagccggccagatcggcgaggtcgtcgcggtcattctcgtcgtcggcgtcgtgctcgccatccgtcagatggcccatcgtcaactcgggcgcagccgcgcagctcgctccggccacgcggccacccaacccgacgccaccgcacccgacaccaccgccaccgaggatcgactcgtcctccagctgctgccgtcggagccactctcgtcggccgcctacctcgacgcgctcggccggatccatcagaccgaaccgccatctccggacgtctccgccgacgagggccgccgcgccccacggcgcgatctcccgacctcaggtagccgctagcgagcgcctccccgccccagacccacgccggacggctctcggtgccgaccggcacccacacgccaacggaccgacttgcgccacgtgcgggcgcgtcatcggcgctgcaggcacccgaggagtcgagcacgcccatcggtgagcgccatgtcccaggaccgtgcgtagcgacccgtggcaccgcggacctcccgttccgcacggcccctcgctgcagcagcgcccctagacgccctcggccggcgcgaagaacccgtcgcccaccgcctggagcttgatcaggttcgtcgttccacgcacaccgaacgggatgcccgccacgatgacgacgagttcgccgacctcggcgagacctcgctcgacagccgccgcgagcgcctcgtgcaccatcagctcggtcgacggcgtcctcgccacgacgtgcgggatgacaccccagctcagtgtcagcgaccgcgcagcgcgcggatcgggggtcgcgccgaggatcgccaccgctggacggaagcgcgccagcacccgagcactgtgtcccgactcggtgagggccaccaccgcacgcaccgggacggatcgagtcatccgcgtggcggcctctccgatcgcatcggcgacggagtgggccacaggcgagggcctcgtgagcagcgtgagcgcctggttgtccacctcgcgctcggtcgcacgcgcgatgcgatccatggtggcgatggcctcgaccggaaaggccccaacggccgtctcggccgacagcatcagtgcgtccgagccatcgagaatcgcgttggcgacgtcggatgcctcggccctcgtcggcgaccccgcctcgatcatcgactcgagcatctgggtcgcagtgatcaccggcttgccggcttcgttggccaggtggatgatctgcttctgcaggagtgggatccgctcgacgggcatctcgactccgagatcgccgcgggcgaccatcacggcgtccgaggcagcgacgatctcgccgatgcgctggatcgcctccttgcgctcgatcttcgcaacgagcatcacgcggctcgccgcgcccgcgcggtcgatctggcgtcgagcaacctcgaggtccgaggccgagcccacgaacgacagcgcgatgaagtcgacgcccgcctccagcccaaaggcgatgtcggcgaagtcgtcttcggtgagtgcgggcagctccagatacgaatccgggaagttcacgcccttgcggaccgacagtggccccccctggacgaccgtggcctccacccagccgtcctccgagcggtcgaccacgaggcggaccgcgccgtcagcgaaggcgatcgtcgcccctgggggcacggtatggaggatgccgagccgactgatgtgaatcgcggcgtggcgggcgctcccctcctcggcgatctggacgacctcgccgggctggagctgtgtcgcgtcgtcggccagcgactcgatccgaagcttcggtccggcgagatcgagcagcacgccgaccgtcttgccggtccgagcagcggcttgacgaacgagctcgatcgagcgggcatggtctgcggtgctgccgtgtgagcagttgatccgcgcgacatccatgccagcctcgatcatcgccgtcaaggtcccgaggttcgatgaagccggaccaatactcgcaacgatcttcgtgcgccggtgctcgcgcatgcgcctcctctctcgtcgaggtcaggctacgtgccggcgctgccgagctcgacgagtccgcgcgcgacgtgctcgagaaagcgccgaatcgtcgcgtcggcgacccgatagaggagcgtctggtcgatgagcagaccggtccgtccgagcggcggtcgatagctcccctcgagccagagctgacagagctcggggccaaccttcgaaaccccgagcaggccgtcgagccgcggaaagagccacggagcttgcgcgccctcccacgtcatcggaagctggagttcgtcgtcaccgaggcgccgtgggctcgcgatccgaaacgccaccggcgtgcgcaagagtccagcccgaagaccgagcaccgcgcgcagaccggcgtcatcggccgtcacctcgctcgcgagatcaccgagccactcggcactctggcgcgacagcagcggggcagcgacctcgaacggcaacggcagctcgacgaagtcgcggacgaagcgcaccgggaccgacccgtcgtgctctcgctcctcggcctccacgctgtcctccacgaactccatgccctccgtgcgtgaaccgcccgaggggctcacccacctctcgtctctaggctacgcgcgccacgcatctaggccaaggagtacgcctcacggtgtgacactggtccctagccggtggggtcggacgaccgtgctgcggccggcggaacggatgccaggaccatcgcagcgagcgcgagaagtccaccgaccaccaccggtaggcccagggatgcatacccgaaggccagcgacgcgagcgcggcgaacagcggttcggccgcatagatcacggagatctgcacgctgtcggcgtgagcgagcgcccaggcttggaccacgaaggcgagtgcgctcgcgagcaccccatcgtagacgatggccgtcaccgcgatcggcgtgaggtgcgtcggcacgagacccgcacccacgagcggtgccgcgaccacggtcgcggccgcgatcgtcgtcatctgcagtgccgctgtcaccatcgcatcaccgggagacccgagctcctcgagcacgacgatctgagccccgaagaagccggcgcacgcgagttcgaggccgatcccgacgaacgacgcatgccctcgtggggccgagagcaccacgagggcgagggccgcgaggacgataccgacgagctgacgagcgctcggacgtcgaccgagcgccatcacgaagatcggcacaaccaccaccgacaagcccgtcagaaaccccgcgatggtcggtgacacgtagcgttgaccctcgatctgagtgaggtagccgccaaagagcgcgaggccgctcgccaggccggcaacgacgctccgtcgatcgatgcgatggccccgtgcgagcgccagcacccacagcacgagcgccgcgacgctgaagcgtccgaaggtgagctcgaccgggccgagactcccgagtgcgcgctcgttcagcggaaaggtgactccccagatcgccgtgacccccacgacggcccacgaggcacggccccttgccggactcctcacatcgtctccggtagcatggcggcccaatggccctcgagcagcacagtcctcgcctcacccgaccactcgtcctcgccgagtcggtcgcctacctcctgatcggcctcgtcctcgtcgtcatgagcgccgagacgctgtggcaactcgcgcgcgccgtgttcgtcgacgtctcgctcaacggcgacgtcaccgcccagctcgtcggcgccctgaacgacgcgctcttcgtcatcattctgctcgagctgctctcgagtgtgatcagccaccttcgcaagggaggtctgcagcttcgccccttcctcgtgatcggcatcgtgtcatccgtacggcgtatcttggtcctcggcgcgcagctctcgatctcccgaacccatggcgcgcagacccgctcgagcctcgaggagcttgccctcgacgcaggggtcgtcttgatcctgaccgcggctctgtggctcagtcgagttcgtccgcagcgccgacgggctcgacgagtacgggcttcctggcagcgcccacctcgtcgagacgcctgaccggcgtcgtccggggcgcctcggcgagctcggccggcgtcgtccgcgcgatctcgacgagccgctcgaacgcctgcgcgagcgcctcgagcgtctccggagactcggtttcggtcggctcgatcatgagcgcctcgtcgacgatgagcggaaagtagacggtcggggcgtggaacccgaactcgagcagacccttggcgatgtcggaggcacgcacgccggcctcgctgcgaaactccttggcgctcgccacgaactcgtgcatgcacggctcgtcgaaagccgcgggcaacacgggctgaaggcgctgctggagccacctggcgttcaagacggcgacttcactcatgcgacggaggccatccgggccgtggtagcgcatgaaggcccaggcacgagcgagcaccagtgcgttgccgtggaacgcgtgcacgttgccgatggacgacggtggcgtccaccactcgagctgccccgttgcgccagggcgaggcagcggaccaggcaggaacgcctcgagggcgctcgtcaccgcgacgggacccgccccaggaccaccgccgccgtgcggggtggcgaaggtcttgtggaggttggagtgcacgatgtcgaaacccatgtctccgggtcgcgcgacaccgacgatcgcgttcagattggcgccgtcgtagtaggcgagcgcgccgacctcgtgcacgagccgcaagatctcggcgacgtcacgctcgaacagccccagcgtgttcgggttggtcaacatgatgccggcgacggagtcgtcgagcacgcgtcgcaggtcgtcgagcgagaccaagcctcgcgcatcggagcgaaccgtcacggcctcgtagccggccaaggtcaccgaggccggattcgtcccgtgcgccgagtcggggatgatgatccgtcgggggtctcgccccgaagcccggtggtaggcgcccatgatcagcagaccagtgagctcaccggcggcacccgccggtggctgcagggtcgccgccgccatgccggtgatctcgcaaatcgcagcctcgagctcggcgagcagttccaaccaaccctggacggcacgctcgggtgtgtcagggtgcaccccggcgagccctgggagggccgcgacctcgtcggcgaacttcgggttgtacttcatcgtgcacgaccccaacggataggcccccaggtcgaccgagtagttgcgagaggccagtctcgtgtagtgggcgacgaggtcacgctccgatacctcagggagcgcggccggctcgcgacggagccacggaccgagctcctcgagcgacgcctccgggatcgcactgtgacgcagcgtgtcggctcggcggccccggaccgacaactcgaacgccgtcggctcggcatcacgtccgacgagcggggcggacgctgcacgaccgcctgggcgcgcacctcgggtcgacacctagcggacctcctttgcgatccgatcgacgaacgcgtcgatctcctctcgagtccgtgcctccgtcgcggtgagcacgagccaggtcggctcctcggggaccaggacaccggccagccaaccatcctcgaggagccgctcgcggaccggccgcgcctccacctcgagatcgacgacgaactcacgaacgaacggccggccgagcaccgagagtcccgcggcctcgagtcggtcagcgaggtagtgcgcggcgttgtagcacgagcgggcgagctcgaccatgccttgcttgccgcgccacgccaggtagacgcccgcccagatcgcgagcagcgtctggttcgtgcacacgttggacgtcgccctctcacgccggatatcctgctcgcgggtgcgcaacgtggtcacgaagccgcgccgaccctcgacgtcgaccgtctgaccgacgaggcggcccggcacgagccgcaccagctcgctccgggtggcaaacagcccgaggtagggcccgccgaacgagagcgggatgccgaggctctgtccctcggcgaccacgacgtcggcgccgaagctgcccggcggctcgagcaaggcgcacgcgacggggtcggcaacgaccaccaggagtgcctccatggcgtcggcgacccgacgcgcctcccgcaggtcctccacccgcccgagcgcgttcggatagccgatgacgagcgccgaagcctcggcgtcgaccgctgcgaggtcggtcgccagatcgtcacggagacccacgctgacgagctcgagtcctcgcccgcggcccaaggtggccagtgcgccccgatagcggggatgaatgccctgcgacacgacgatacggttccgcttggtggccccgaccgcgaggttgacggcctcgaccaccgcagcggcgccatcgtagagcgaggcgttggcgaggtccatgccgaagaggcgcgcaatcgaggtctggaactcgaacagcgcttggagcactccctgagagacctccggctggtacggggtgtaggccgtcacgaaggcactctggagcgcgagcgctcgcacggcactcggcacgtcgtggtcgtaggccccgccgccggcgaacaccacgaggtcgcgtcgagcgccagcgttccggcgcgagcgccgttccgcctcctcgagcacctcgacctcggccagggccgggggtagttccagcggtcgccccaagcggagcgacgcggggatcgatgcgtagagctcctcgagcgacgccaaccccacctcggccagcatgcgctcgatctgcgcctcggtgtgcggtacgaaactccccacgaccacctcctcaatgatcacgaacgcaggtcgacgaacgggacggctgcacgctcgaggtccaacgacccgcgagcacgaaccgcccggaacggccctgccgcggcctccgggtcgacgtaggcgaggccgatgccgacgcccgcgagcggcgagtacccacccgacgaaatcgagccgacggccgtcgaggcggcatcgacgaggacgtcgtgggcgcgtggaggctgtctcgtcagcgagcgaacgccgatcagaatcgggttgacacccgcggcctgctgggcgagcaacgcctcacgaccagggaagggccccttctcaaacgcgacgacccagccgaggcccgcgttcagcggcgtgaggccaggtccgagctcgttgccgtgcagcggcaggccagcctcgagccgcagcgagtcgcgcgcacccaacccgcaggcgacggcccctcgctcgagcagccgttccatcaacgccaccgcatcgtcaggggcgacctcgagctccacgcctgggccacctgtgtagcccgtgcccgcgacccgcacctcgatgtcgccgatgcggcctgtcacgatgcgattgcgcgccggcggctctgctccctcgaggagagggccgagcagggccgcagcaccaggcccctggagcgcgaggatgcatcgcgagcgagtgatgtcacgaccgccgagtgcggcggtcacgttctccgtattggccgcgttcggcatcacgtggaatcgctcgcgatcgacccaccacacgatgatgtcgtcgagcaccgatccatcgacgtcgagcaggtgcgtgtactgcgctcgctgcggaccgatcttgcgcagatcgttcgtcagcgtcgcttgaagccggtcgaacgcgtcgggtccctcgacgacgaccgtaccgagatgggagacgtcgaacactccgacgccggtgcgcaccgcgaggtgttcggcgatcgtcccgctggggtaggaaactggcatctcccaaccaccaaagagcgtgaatcgagccccaaggtcgcggtggaggtcatagagcgcggtgcgttcgggcaccccgccatgctaccgctgagcgcggacgtggcgctcagacgcccggccgagccgagacgatcggcagctcgatccgttcggcgtcttcggtcctcgagagccgcagtcgctcgcccatcgggtcgatctcgagccccacgtgggcatgatcggcgcaccacgcctggagcacctcgagcacgctcgtccccggatcctgcgcgacgatcgttgcgctcatcccgggcgtggcgaccggctcgtaggcgatcaacacggacccacccatgaccaacacgctgagcagcatcgcctcgggcacctcggcgaaggcgagccacgcctggtgcgccatgtactgctgggcccgccgacgtcggatgccctccatgaaccgccgatgccgccgccacccgatgaggaacgccgtgatcccgagcccgagcacgagcgacgggaacaccaccaacgccagcgtcgacccctgaggcacacttctagtgtacgacctcaccacgcgccgagcacgagcggccaggctcgatagcatgagcccatgcctcgctcgctgcggcgcgccgttcccactctgatcacgctcgcacgagcggcgttgttgatcccgttctggcgtctcgccgtcgacgagcaccgcacgggagccgccgccgtcgtcgccgtcaccatcggggcgaccgacttcctcgacggctacagcgctcgtcacctcgacgccgtcaccaccgtcggcaaggtgctcgatcccacgctcgaccgagtcgcactgctggtgagctggctcgtcgcactcgaggagcacctcttgccgacctggttgctgtggttgatcctgcttcgggaggtcgccgtcagcgccgtcacgctcacgtcgctcgtgcgcacgcatcgacgccaagacgtcgtcttcgtcggcaaggcgggtaccttcggcctcctcgctgccttcccgctggcgctgattgcgcgcgccacacgcctcgacatcttggccaagggagccaccctcatcgccaccgtcgccctcgcactcctcaccgttgccctgatgcgctacgccacccagctccgagacgacctcgataggctgtcgcgcgaagcaccacctgcttcgtaacgaggcacccccaccagagcgaacccgggaggcgcaccgtgcaggctgtcatcatcgccggaggcgagggaacccgccttcggcccctcacctcgaccactccgaagccgctgctcccggtcgcgaaccggcccatgatcgcccgcgtcgtcgacctcctcgtcgccaatggcattgacgacatcatcgtcaccgtggcctacctgggctcggccattcgcacctatctcggcgacggcaccgactggggagcgcgtatccgctacctccaggaggagtcgccgctcgggaccgcaggcgcggtccgcaacgccagacacctcctcgaggacaccttcatcgtgctctctggcgacgtcgtgacgaccgtggatctcgaggccgcgcgacgcttccaccacgaacggggcgccagtgcgaccatggtcctcaccaccgtccccgatcccaccgagttcggcgtcgtcgcgaccgaagacagcggagcggtcaccaggctcatcgagaagccgtcgtggggcgaggtcttcacggacacggtgaacaccggcgtctacatcctcgaaccgtccgtcctcgatcgcatccccgccaaccgtgcggtggacttctccgaggaggtgttcccgcagatcctcgacgaccgcggagcgctgtttggctacgtggccgacggctattgggccgacgtcggcaccttctcgggatttcaccagacccaccacgacgtgctcgacgggcgtgccggcatcgctccctcgggcttcgaactggctcccggcgtctacgtcggtgaccgctcgacgatcgacccctcggcactcttggaggcgccgtgcatcgtcggcaacgacgttcgcatcggccccgggtcgaggctcggcccctacaccgtggttggccacggcgtgcgggtggggtccgacgtccatcttgacggcaccatcgtcttcgaccacgcatggatcgccgacggggcacgtctcggccgcgcgatcgtcggccgcggcgtcgacatccgccgccgggtcaacgtacacgatggcgcagtgctcgccgacggcgtcctcgtcggacgcgacgcggtggtgcgagccgacattcgggtgtatccgggcaaaacggtcgatccgctcgccacggtcgccaactccatcgtctgggagagtggcgcgagtcggacggtgttcgggccgctcggcatctccggcctcgccaacgtcgacatcaacccagagatggcgacacggatcgcgatggcgctcgcatcgcagctcccccccaacggcgcagtcctcgcggcacgcgacacctcacgggccgcacgcatcatcaagcgcgcgatgatggtcgggttcaacgccgtcgggctcgacgtctgggacctcgaggcaacgaccaccccggtcctccgtcacgccgtggccgccaccgatgcggtcgccggggtacgagtcgccctcgacgccgacgatccccaagccctgaccatcgagctcctcggggccgaaggcgccgacctcgtcgcgaccgagcgacgcaaggtggagcgcgcgctcgagcgcgaggagtttcgcagggtctccgcgagcgagatcggcgatctcgtcatggtctcccacgcgaccgaccgatggaaggcagcggtgaccgccctgctcgacatcgagcggattcgggagcgcgccttcaagctggtcctcgactactcgtacggcgtcgtggcgtcgagccttccgcaagcgatcgcgtcgttccacgcggacgttctcgccacccacgcctacccctcgaccgcacgcctcatacgacttcgactggaggagcagatcgccgaactcggccgtctggttcgaggcgccaaggccgacctcggtgcgatcgtgaacgccggcggcgaacggctgctgctcaccgatgcgcgcggtcgcgtcgtcccgatcgccggtatcgccaccatcctcgccgagcacctggtcgcgaccgggaaggtccggcggctcgtggcgagcgcggccgtcgcgagttcggtcgccgacaccgctcgcgccctcggcatcgagttcgcatggtgcgggctctcgcgagctgatctcgccgccgccgtcgccgatgcaccaggaacgctcgccatcggccacagcggcctcgtgttctactccggatgcgcgagctcgtcggacgcagccgtcaccctcggactcatcttggaggccctcgccaccaccggaaccgatctcgcccatgtcatcgaccgcacgcccgccgagacgacggtggccgaggcggtacccgtcccgtacgcggtcctcggtgcgacgatgcgggggctgcgcaccttcgccgaggagcaggggccggtcgagctcgtcgcgaccgatggccttcgagcgcagttccaggaccgattctggctcctctcgcccgacccccaagaaccggtcgtgaccgtcatcgtgggtgcggccgaccccgaggtggccaaggacgatctcgcggtcctgcgcaccgctgtcgcggcgcgtcgcgacgaagcaacgcaaggtcgcaagggctcgaattccaacggcagcctgcccccctcgacctccgcgcgcgggtaacctaaggcgtcatggagttccctgacgacctgcgctacaccgcagaccacgaatggcttcgcacgatggacgacgagaccacccaggtcggcgtgaccgactacgcccaagacgcgctcggcgacgtcgtctacgtcggcctgcccgaggtcggacgatccgtgcgcgcaggagaaccgatcgcggaggtcgagtccacgaagtcggtctcggacgtcttcagcccgctcagtggcgacgtcgtcgcggtgaacgaggcgctgcgcgaggcgcctgagctcatcaaccgtgacccctacggcgaaggctggatcgtgacgatccgtcccacggggtcgacggacgagaccgctggcctcatggacgcagcgagctatcgcgacctcgtgcacaaggcgtgagcgaaggggatgtggtgagcgaggggggtgcctcctgtcccgtgtgtggcgcgccactaccggcagggtcacacttctgtccacgatgtggtgccgccatcaccgatgacgatcgaggtgacgtcaccgggacactggcgatcgacgcgatcgagcatctcgccgaggaggcgccgtcgggtccgaccacgacgacgcccgtgctgctgcttcgatcgggcccgcaggccggttcgtggttcgcactcgacagggacgtcgtgacggtgggacgccatcccgattccgatgtgttcctcaacgacgtcaccgtctctcgacgccacgccgaaattcgtcgcgagggtgacgcctacgtcctctacgacgccggatccctgaacgggacctacgtcaatcacgaacggcacgagcgtgcgccactgcatcatggtgccgaaattcagatcggtcgctttcgcttcaccttcttcgtaccggagaccgcgtgaactcctctcaacacctccgcatcgttcccgaacccgaatactcgatcaaggacgtcctcgcgctcttgcaagaggagttcccagaggtcacgatctccaagatccggttcctcgagagccagggcctcatcagtccggaacgcacgccatcgggctaccgacgcttctacgatcacgacatcgcccggctgcgccatgtcctgcggctccagaagtccacctacatgccgctgaagaagatcaaggagcacctcgacgccggcacccaaccgtccgacctcttctccgaggacgccgtcgccggccaaggcaacgccgagacgagcgccgtcacgccgaacgagtcggagcccgaggccggttcgagcgcagaggcatcacgatccgacgcccctggcctcctcgacgagcacgacgccctcgctcgtgcgggtgcgaacgcctcgacgcttcgcgcggccctggatcatgggatgatcgtcggcatcacgaagggccgtgagcgctacctcacgctcgaagaggtcgagatccttgcactgctcgccagcctcgagcgccatgggctcgaaccccgtcacctccgcttcgttcgctcgttcgccgaacgcgaagtcggcctcatcgagcaggtgctcgcaccggtgctctcgatgagccatcgtcaccccgagcgcgcgcgcaccgcgatcgccgagctcgccgagctcctcggtgccctgaccaccgcgctcacgacccgcgacctcgagcggctcgatccgcatgcgcggcgaacactctgagtccagctcgagaccttggcgagcgtccgcgcggcgctgagttcggcgctcgggcccccgcctgaagcacgcgctcactgctcccgacgctcgcctccgtccgcgttcgggtcacgcgccgcgccgtactcctcaccatcgacgacgtcaccgcctcccctccacgcgcggaaggccagggccagcgccgatccgaagacgatctcgccgatgcccacggcgaccccgaaggcgacacggacgagaccggcaagccctgcgaccacgacgccaaccgcgaccatgatgccgattcgacgcatcgcactactcctaccgttaccgttgctactcgcgccgatcagggtcgcgacgtgcggcccttgccacacggtgtcctctgcctccccgatcgcctcagtccgaaaagtcctccggccgtaggtgttcgatgaagtcgcggaactctccgaggagttcgtcctcgtcccccgaggacgtaggctcggcatcgtccaacactgcaccctcggcgtccatcaccgcctcatccacgaagatcgggctcgacgttcggagcgccagtgcgaccgcgtccgacggacgcgccgagatctcgcgctcgatcccgccttgggcgagcaccacggaggcgtagtaggttcccgcccgcagctcggtcacctcggcccggacgacctcagcgtcgagctcttcgatgacgagacgcagcagatcgtgcgtgagcggccgcggcgggtccacctgcgacagggcaaggtgaatcgcgttcgcctcgggaacaccgatgaagatcggcacgacccgatgcgggtcgcgtcgctcctggaggagcaggactggtgcgttggaccgaaggtcgactcgaacgccagcgacttcgacttccaccattgattccatgctaccaagcggccagcatggtcgccgaggcgcggccagcgcgaggcggcaggattacccgagacggttcagcgcggacagaccgaccgcactggccgccgactcgaggtgctgcgtgatccaggcgaagtcgttggccaccatcactacgccgaacacggcgaggacgcccgccgccaccagcgtcacggtccgcaggtgcttgcgcagcgcccgtgtcgcggtcaccgcgcgcgagaacgcgagtccgaacaggagaaacggcacgcccagcccgagcgagtaggccccgagcaacagcgctccctgcaggagctggccctgggtcgccgccacggcgaacaccgacgcaaggatggggccgatgcacggtgtccaaccgaacgcgaacgccatcccggcgaccggcgccgcaaagcgaccgaatcgctcgagcctcggatgccaacgcttctcggcgaacaggatcgggaatcgcccgaggaccgagagcacgaggagtacggccatggcgaggagcacgacgccgctcgcccgctcgagcaacgcatgatgacggacgagggtctgtccgagcgcggaagcggtcaagcccatggcgatgaagaccacggcgaacccgaggacgaactgggcggtgcgccccgccacccgccgggcgaccgccacccctcccgcttcgagctcgcgcgtcggtgccccggagacgaccgagagataggcgggcaccaacggcaggacgcacggtgaggcgaacgacagcacgccaccgccgaacgcgaccacgtagccgactccgagtgccacgtcatgcagtctaccgatcgccggctcgtggtggcggatcgcatatactttgctaaacacaactattttccgggaatcaccgatagcccggtgaggttgtcaacatgcaccgacaatgtgctcgtagccatcatctgaccaaggagcttgatctcagcatgacgcaaggttcgcaccgacaccgctcaggacttgcgatcgccgtcatcgccggcgcacagctcatgatcgtgctcgatctcacgatcgtcaacgtggcgttgccgacgatccaacacgctctccacttctcgccgactggcctctcgtggatcgtgaacgcctatacgttggtcttcggcgggctcctgctcctcggcgggcgctccggcgacctcttcggccgacgtcgcatgttcatggtgggggttgccctcttcgcgatcgcgagcgtgttctccggactggcgacctcgcaggcctggctgatcaccggccgtgccctgcagggcatcggcgccgcgatcgcctcaccgaccgccctcgccctgatctctgcgaccttcaccgaggcacgtgagcgcggacgggccttcgcgatctattccgcggtgtcggcgggtggagcagcgatcgggctgctcgctggcggtctgcttacccaatacgcatcatggcagtgggtcttctacgtcaacgctccgatcgccgcgctcttgctcgttgccgcgccgcgggtgctcgcagagaccgaacgtcaccacggcagcgtggacgtgcctggagccctgacgggtaccggcggcctcgcgctcgtggtctacggcctcatccatgcctccaccacctcttggtccaatgtgacgacgattgcggtcctcgctggcggggtcgttgcgctcggcgcgttcatcgtcatcgaacgtgtccgacgtgagccactcatcgacttccagatcctcgccaagcgtgaacggggcggcgctgtcgcgatgatcctgttcgtcgcggcctcgatgttctccgtcttcttcttcgtgtcccagttcatgcaagacgtcgtcggctactcgccggtgcgaaccggtctcgcgttcttgccgatgacgctcggcatcatgatcacggcccagctcgtgtcccgcaacctgcaccgcgtcggcccgaagccgttcatggtcggtgggagcgtgctcatcgccgtcgccatgggcctgctgtcccagatgcgagcctcgtggggctatctcgacctcctcggcccgctcgtcatcctcgccatcggcgccgggagctccttcgtctctctcttccccaccgcgacccacggcgtcgaaccgcgtcgcgtcggcatggcctcggccctcgtgaccgtcggacagcaggtcggtggcacgctcggcttgtccatcctcgtcaccgtcaccgtggccgcggccaagcggcatgcggcagccctcgctccgcgcctcgccagcggccacctcacaccccaggcactcacgatcctcgccgaggtgcatggctgggcggccggcttcgcggtcgcgacaggattcggcgtgatcgggctgctcatcggtttgatcgtggtcccgcaccttggaccaactgcgaccgaaggagcggcggaagggtcggcggtcgccgcgtaggccggacgcaggcgaacacgccagcgctcttggcacagtcgcatcgcaccctctacgctggagggtgcgatgcctaccgttccagcgttctcgcccatcgggctgctgaccgagtggtcgctcggaccattcgcgatcgtcgtcgtgatcgccgccggcgctctgttcgcgtggtacgtcgatgcggcgatccgcgttcgcgccaagggtcgtagctggccaggtcaccgcatcgtcacgttcggtctcggcctcctctccatcgtctacgcgctggcaggaccgatctccgtgtgggtcatgcgctacttcccggcgcacatcgtccagcacctcgtcctgatgatcgtcgccccgtcgctgctcgcgatggccgcaccggtcacgctggcgctccagacggcacgtggcaccgcccgtcgactcgtcaccggcttcatccactcccgcttcctccacgtcatcacgttccctctcgtcgtcgtcatcgcgtactacatcgtcatgtggtggttctttacgacgagcgcgatcgggttcgccatgacgcacatgtgggtgatggacctgctcaacctactgttcttcgccggaggcgtgctcttttggtggccgctcgtcggcaaggaccccatcgtgcactggcgaatgggctggggtgcgaagctcgtgtcgctcgccttcggcatccccttcgagacgttcctcggcctcaccatcgccggttcacggacctcgctcgctcccatgtacagcctgaccgactggacgaccggcggcgacgtgctgtggggcttgagcgagatgctcacgaccctcgcgatcggcgtcatcatctggaactgggtcgcctccgaggagcgccagacgcgccgtatgtccaggtcccgcgaggcggtgccactctcgagccgccaagacggcctgccgaaggagtactactgggcgcgccaggtcatcgagcgcatgcctgcaggctcacccatgtacgaagaggcgcgctccgtgctcgagcggatcgaccgcgaacgccccccggagacggctcgctgacgactcgcagcggtgtgtgcgctgagcacgccctcgtcgcatcgccggggtctcgccagtctgagccgcagcggccgcgtgatcaggtcggtgcggaaaacgtgaggaacgccgagatccaccagtgttcgaagggcgagaacacgagctgcaagacactcggaaacaggaccgcaacgagcaccacgacggcgagcagccccattcggaagcggagaaagccataccaggctgatgccggcagcacacgctcgaggatggagccaccatcgaggggcgggagtgggatgagattgaacacgccgagcagcagattgacgaggccagcctcgacgaggagctggtcgacgaggctcgatccgatcgaggacgcctgcgcggcggacgccgtctgaatgtcgtgggcgatcactgcatgcgccacgatcccgagcgcgaccgccagcacgaggttggtggcggggccgacgaggccgacgatgagggcgccgttacgaggatggcgcaagcggcgaacgtcgatcggcacaggcttcgcccacccgatcggcggtaagccggcgatgatcaagatcacgggcacgagcacggaaccgaccggatcgaggtggcgcagagggttccagctgagacgaccgctgcgcttggcagtatcgtccccgagggcaagcgccgcccagccgtgcgagagttcgtgcagcacgacggaggggatcagcaccgcgagatagagcagcgatgtcagattgatgacgccacgccacagggcgagccccaccaaggctgcgccgaccacggcgagtagccatcgctcacgagtcatcagcggctcccggcccgagcacgcggatgcgcgcgttggtagacggcatccacgtgaccctccgacaccttggtgtagagctccgtggtggcgagggatgcgtgaccaaggatctcctggaccacgcgcaggtcggccccggcctcgaccatgtggaccgcgagcgaatggcgcaggacgtggggcgagacccgatcgccgagaccgacccgcgacgcacgttgcttcagcaccagccagaccccctggcgcgtgatgggtgcgccccggaggttgacgaagagcatccgatgcttgggagcgagctgcggtcgccatcgaaccacccactgctcgagcgcatcgcgcgcaggggccgagatcgggacgaggcgttcgcgtcctcgcttgcccactacaggtacccatcgaccctgggcgatggtgtcgagcgtgaagccacagagctcgctcacccgaacgcccgatccatagagcacctcgaggatcgcacggtcacgagcgccggcgacatctgcggtcccgacggactcgatgagccgctcgacctcgtcgcgagcgagcgcacgtggcagcgcgaccgccgttccaggcgcatggatcccctccatcggatcgtccgctctcgcaccgacgcgttgggcgtaacggaacagtccccgtagcgcactcgcggcgcgctgaacgccgcgcggggagcgctcccggccggcggcgtccacccaggagcgcaacagagccgggctcgcatcgaggaggcgcgaccctctcgcctccagccaggtcgcgaccgcttcgagatcgctgcgatacgcgatggcggtcaactcggaccgatcggccgcaacgacgaggagggtgaggtactcgtcgacgaccgcctcactcgccgggtccaacgatctcgaactcctccatggccacggtcgcctccctcgcgacctgccgaccgagtccatgggccctcgccatgagcagcgccacgatgctcttcgcatcctcgaggacgcctgaggccaccagtgcgtcgaggtcgtcgagacggagcgccaccagctccatcgcgcgctcctcgaccgattgaggagcccgctcgccccgagagaggcccgtcgctccgaccacccaggttcgctcatcggtgaacccgggcgagttgtagaagctcccgagggcctccaccctcgccgcgaggagcccgcactcctccgcgagctcgcgccgagcggtgtcgagcaccgactcgcccgcgacgtcgcgcttgcctgcggggagctcgagcacatcgcggccgagggccgcacggaactggcgctgcgcgacgacacggccgttcccgccgagtgcgacgacgacgaccgcgcccgggtggcgcacgacggtacgacgctcgctggcgccgccgtccgcctggagccggagctcggtgacctcgaagaagccataggtcgcgcgaaggtcctcgccgacgatctcgatcgtcacgcccgatccttctggtggcggagcgcggcctcgacgagacccgcaaagagtgggtgcggacggttcggccgcgagaggaactccgggtgcgcctgcgtcccgatccagaaaggatggtcggggaactcgacgaactccaccagcctcccgtcggggctccgcccgctcacgaccagaccggcctcttcgagccgatggacgtagcgctggttgacctcgaagcgatggcgatggcgttcgtagaccacctcggccccgtagaggtccgcgacccgcgtcccgggcgtgaggcgcgccgcgtaggtaccgagtcgcatcgtcccgccgaggtcgatcacctcccgctggtcgtccatgagatcgatcactggatagggcgtctccgggtcgaactcgcgcgagtgcgccccgggcaagcccgcgagggagcgggccacatccaccaccatcacctgcagaccgaggcagatcccgagacagggcatccctcgttgcctcgtccaggcagcggtcgcgatcttgccttccacaccccgaggcccaaatccgcccggaatcacgacgccatcgacgtcctcgaggagttcgtcggccatcatcggcgtgacctcctcggcggagacccaccgcacgatcacgcgtgcgtccgaggcaagacccccgtgacgcagcgcctccaccaccgagaggtaggcatccgggtgatcgacgtacttgccgatcacggcgatggcgacgtcgcgcgacggcgcagcggcacgacgcaccaaggctcgccactcgtcgaggtcgggctcaccggccttgaggtgcaagatctccgtcaggtattggtcgaggccctcttcctgcaagagcagcggcacctcatagaggttgtcggtatcgagcgccgcgaccacgccgcgagccggcacgtcgcagaacatcgagatcttctggcgcacgctctcggagagcaccctgtccgagcgggcgacgatcacgtcgggctggatgccacgcgagcgcagctcggtgaccgagtgctgcgtgggcttcgtcttctcttcgccgttgggcccgagatgcgggaccaacgtgacgtgcacgaaggcgacgtcttctcgagggacctcgttgcgcagctgccggagcgcctcgagaaagggcaggatctcgatgtcaccgaccgtgccaccgatctccgtgatcacgacgtccacgtcgtcgccctcgagcgcgcgaatccgcgcacggatctcgtccgtgatgtgcgggatgacctggaccgtcttgcccaagtagtcaccgcgacgttcgcggtcgatgacggtccggtagatcgacccggtcgtcacggacgaggcccgtcgcagcgagacatcgacgaagcgctcgtagtgaccgaggtcgaggtcggtctcggcgccgtcggcggtgacgaacacctcgccatgctcgaacgggttcatcgtgcccgggtcgacgttgatgtagggatcgagcttctgcaacgtgacggcgagcccccgcgccttgagtagacgccccagtgaggcggcggtgatgcctttcccgagcgagctcgctacgccacccgtcacgaacacgtgcttggtcaccctgcctcctcgcgcggccgcctgcggggatcgcccttgagcagtctagagcatcactcccccgtcggcaggagccgacggtcccgactcgctcgatgcagattggagcagtgcccgtgcgtgctcgagggcgacgtcagcgtcggggtggcccgacagcagccgcgcgatctcgcgcacgcgcgcatcgtcgcggaccggttcgacccgcgtcctcgtgcggtcgtcgacgagctccttgtgcaccacgaagtgagtggttgcggctgcggcgatggaggcggtgtgcgtcaccacgatgacttgacgccgcgtcgcgagtcgttggaggcgcgccgccactccgagcgccgcacggccgccgagtccggtgtcgatctcgtcgagcacgatcgattctcgaccctccccgagcagttccgccatcgccagcacgatgcgcgagagctcgccacccgacgctccgcggcccagcggcgtcggctcgaggtcgggtgaggccgcgaaccagaaggccggtaccccttctgccccttcgaggcggatctcgaagcgagctcgctcgagccccagcgctccgagggcctccgtgacgtggcgacgcaggacctctgcggctgcgtctcgttcggcgcgcagcgcgctcgcggcctgctcgaggtggcgctctgcctcgaggcgttctgcctcgagctcttccatcagggcctcgctgccctcgatcagcgcgagcgctcggcgtcgctcctcacgcgcctcgatcacggcctcgagggtgggtccatagcggcgcttgaggtgggacagctgggcaagccgtgcctgggcggcctcgagcgcagccggatcggactcgagacgctcgaactgatcgcgcacctcctcagccacgtcggtcgcctcggcgaggaggctctccaggcgctccgccaaggccgggaacgcacgttgcaccgcgcgtgccgactgaccgaggcgatcggtgatgctgttcgtcccgaccaggtcgcgatggagggagaagagctctgcccgcagcgcatcggcgtctccgagccgatcgacgagctcggtgagctcgttgtcctcttcggggttggcgagctcggcgctctcgagttcggccagctcgaagccgaggcgctcgcgctcacgctcggcgtggtcatgatcgtcacgcgcgcgtcggagtgcggccgtcgcgtcggcgaggcgctccctcgcgcgatgccacgcgcggtcgtcgatgcccccgatgcgatcgaggatcgcacgctgttggtcgggttgggtcacgaacaccgcttggtgctgaccgacgacctggacggctcgcgcgacgaacgaagcgagctcgccaacggcgacgagctcgccatcaatgcgcgcacgggagcggccctcccgggtgacctcgcgctcgacgaccgcttcgtgaccgtcgacgtcgacgatggcgcggacgcgcgcccgctcgtcgctcgcacccacaaggtcgctgcgtgcccgctcgccgaggagaaggccgatcgcacccacgatgagggtcttgcccgcccctgtctctcccgtgagggcgacgagcccgccgggcagctcgagcgaggccgcctccacgacccccaagttgcgcacctcgagcaggctcagcatggcaggtcgagcacctcaaggccgaacttcgccttgagtacctcgtggaagggcggggccccgatctgggcgaggcgcacccgacgcgtcgccgcgtggacctcgaccgcttccccgggcacgagggacgaccacggaacaccatcgaccatgaccgaagccgtcgggccatcgagcagtcggatctcgacgggttcgtcgagtccgaggaccaaggaccgatcgaagagctgatgcggagcgatcggtgtgagcacgagcgcgtcgacgcgtggcgagagcacgggtcctcgcgcggagaacgcataggccgtcgagccggtgggcgtcgcgacgatgatcccatcggcggcgtagcgcagaaaggggcgacgatcgatagcgacgctcgcgcggatgaggtggcccgacgcctgacgctcgacgacgacttcgttgaagccgacggttcgctcgctcctcgaaccgacgcccgcctcgagcacgacccgctcctcgacgacgatcgacccatccacgagggctcggagcgcgggttcgagcgccgacggttcgacctcggcgagatagcccagttgaccgaggttcaccccgagcaccggcacgtcctctcgccacgccgccgccatcgcacgcagcatggtgccgtcacctcccatgctgacgaccgcatcgatcgccccacacgcgtgcgtcgggtcctcgagtatgcaggcactcccaccgagctcgctgagcaacgcccgagcctggcggaagagttcctgcgcacgcggctcctgcgggtggagcacgaacccaacgttcatccggctcagcctaaccaccaccgcttcgttcactcggggcacgcaaccacacgaactcctcgacgttgccctcggctccgggaaccgaactcggacaactcccgaggacaacgagccccatcgaacccatcgcgtcgcggactcgtccgagcgcctcgtcgcgctccggaccgagcgggatcacaccgcggtatcgactcgcgatctggcgccccacctcgaactggggtttgacgagcaccaccgcctctccgcccggcgcgagcagcgacgcaacctggtcgaggacgccgagcaccgagatgaacgacacgtccacgaccgccagcgtcggtgcttcggggaggggccacacgaacgcacggatgtcggtccgctcgtagacctcgacgcgcgggtcatgccggagcgactcggcgagctgtcctcgtccgacgtcgacacacacgacgcactcggcaccgcgctcgagcagcaccatcgtgaacccacctgtcgaggcacccacgtcgaggcagatccgccctgacgggtcgatgtcgaaggtgtcgagcgcaccctcgagcttggccgcgccgcgcggacgccacctcgaggccacgaccgagagcacgtcgctgggcgcaacgaggcgagccgccgacagagccggggcccgattgacgagcacacgcccctctgcgatcagacgcgccgcgtgcgaacgggagcgagcgagcccgccagcgacgagcgctcgatccaatcggacacgcctcaccgctccgagagcctatcgctgaggttctagcatcctcatcgtggcagccatcgatgcgctcgagacgcgcctgctcgagtatctgagcgcgccggctcgctcgtcacccgccctcgcacgggcactacggatctgtgaagatggcgctccgatcgcctacgccgcaaccttcgcctgggtcgcgtggcgcagcgcggatgatccgcccgttcgcagcgccctggtgcggaccacgcttgcgggctcggtcgcggtgctcggcgcaggggtcgtcgcacgcgcgcttccgcgctcacggcccagcctcaccctctgggcatcgcgcaggtcggcgagcgatagtcactcgttcccatccgaccatgccgcgggggcgagcgcgttcgcccttgcctcctctgggctccctcggggtgcgcgacgcgcactcgtcgccctctcggcaacgacgatcgtgagccgggtcctcctcgctcgccattggccgagcgacgtgctcgcggcactcgcgatcggcgccgccgcgtccaccgtcgccggggccctgccctcgccgatggtgaataccctcggcgagatcaccgtccggtggctcggcctgtccgctcgagcacgacggacgcccacagcatcccgaggcaggcgacaagagcaccgaccgcgtcgatgacccacgcgccgtggaagccgaccgcaccgacgagcgccccgaacccgagcggtccgacgacgctgccggcaaacgcgctggcttggacaatggccgtcgcctgtccgggatgttcaggccaccgttcgctcaccgcgaagttcaccagcccgttccagccccaaccgccggcgtagccgagcaggagccctccgagcaacagcgcacgcacaccggtcgcgagcgcggcatagcccaccacgccgacagcgagcaagacggcgaccgcccggatcggccgctgcagacgtcggtcggcgagtgcgcccatgcccaccctcgtggcgaggccggcagcgctgccggctgctgccgcataccccgcgatggcagcctggacgtggtcgtgaacgagcgatgccacgccgaacgcaccgagtgcattcgccgtccctgcaccgagcgccatcgcggcggcgacgatcagtagcgaccgcggggtgacgaagcgcgtccgcgcctcagccccctgagatccgtcgtaggaggcaaaacccttggctccgagcgcgatcgcaacagccaggatgctcgtcgcggcaaaggccgtgcgccagctcgaccggagcgccaccagcggcagtgccagtccagcgagcaaggttgcggtaggaatggccgcctgcttgatcccgaatgcccagccacgcctcccggggcgcacgacgcgcgcgagtacctcgttcacaccgggttgcaagatcccgttcgcggcccctgcgaccacgagtgcggctgcgagcaggatcggaccacgcaccgcgaaggcgatcacggcacttgccaccgcggatgcgccagcgcctgctcgcaccagccggaaggccgccgctcgatgcaagatccgcgccgccagggccgcccccacaatcccggcaacgaagaagctcgcgacgacggctccttcaaggctcggggtgaggtcgatggcgtggcgcagcaccggttcgagaccaccgatgaggaacactggcagcgtcgtcgccgtcgtggccgcgatcgagaacggcaagacgaggcccgttcggggcacaccagaactcatgagacgttcaggatttcctgagtgccccgtgagactcgaaagcatacctatgcacaccgccaccttacccgcaggccacctgcatacctatacctcgacttgcacacgacatccgaccgtgacgtgcgcgtcacgcagacgacgatgattgcgttccatacacgagaggaatagcctacgatacgcaatggccaaagagcagatcgctcctggcctgcctggccgacgccaccgaggctcgccagcatgacacgagtgtgggaggaagtggggaacccatgaagaagatcacagcacgccaccgcctcatcgcgggacttggcaccaccgctgccgcagccatgctgctcgcggcgtgtggctcctcgtcgagctcgacctcgtcctcaagcacgaccaaggtctcgggcggtacggcctacttcgccgaggccgccggcgcaaacccgaactacatcttccccttgaccgggggcccgtacttcagcgtcgacaacctcgcccagttccagatcctgatgtaccgaccgctctacttcttcggggtcggctcgacgccagagatcaactaccagctctccatcggcaacgcgcccgtctactccaacaacgacaccaccgtcacgatcaccctgaagcactacatgtggtcagacggcgagccggtgacctcgcgcgacgtcatcttctggatgaacctgctcaaggcgaacaaggccaactgggccgcctacgtgcctggcgccttccctgacaacgtcgcgtcgtactcggctccgaatgcatcgaccgtcgtcttccacctcaccggcaaggtcaacccgacgtggttcacctacaacgaactgagccagatcacgccgctccccatcgcctgggaccgcacctcgctcagccagccggcacccagcccgtcggccgccaacttgcccgatacgacgacctcgggggccaaggcggtctacaccttcttgaactctcaggccacgaacgccaacgcctgggcctcgagcccgatctggtcggtggtggacggcccgtggaagctgaagagctcgtcgacgaccgggcgcatggtgttcgtgccgaacccgtcctacaccgggccggtcaagccgtcgctgtcggagttcgtggagctgcccttcacctcagacaccgctgagttcaacacgctgcgcgccggcaacggggcgatcacctatggttacgtgccgacggtggacctcagccaggtgccttacctgaagagcatcggctatcgcatcgagccctggatcgacttcggcttcaactacttcgtcgagaacttcaacaacccgacctacggaccgctgttcaagcagacgtacttccgtcaggccttccagcacctcgtcgaccagccgcagtggatctcgaccttcctgaagggctacggcgtaccgagctactcgccggtgccgctcgcgccggcgaatcccttcgcggacgccacctcgaagaccaacccgttcccctactcgatctcggcagcgaagtcgctcctcaccagccacggctggaagatggtgaacggcgtcatgacgtgcgagagcccgggcacggccgccaccgactgcggtgcaggcatcgcgaagggcttcacgctcacgctgaacctgcagtacgcctcgggtaccacgttcatcacccaggagatggacgcgctccagtcggcagcagcgagcgcgggcatcaagatcaacctctcgcaggcacccttcaacacggtcatccacaacgccactcagtgctccggttcgagctgcacctggcagatggagaactggggtggcggctgggagtactccccggacaactacccgaccggcggtgagatcttcggcaccggtgctgggtcgaacttcggcaactggaacgatccgaccaccaactcgctgatcgccgagacccacacctcgtcgaatgcgcaggcggcgctcgatgcctaccaggactacatggccaaggtcctgccggtggtctatcagcccgccgccgattacgccatctccgcgatctcgaacaagctccagggggtcactcaaaacccgtacctgaacttgacgcccgagacgtggtacttcgtcaagtagcgatcctcagggctccgagccccgcttagcgggggctcggagcccattcgcctgacggaccacgcacgatgggggctccgcaatcgaggccgagcaggcccggcgcccccgcgaacgatccgacatggcccgctcctacgatcgatcgccagtactagttccacgaggagtccatgaccggctacatcatccgcaggctcgtccagtctgtcatcgtcgccatcggcgttttgctcatcatgttcatcctgcagagcctcctgcctgatcccgcgcgagccatcctcggggtcaaggcgacgccggtacagatcgcggccttcaacagggccaacgacctcaacaagcccttctacgtgcagttcgcgcactacctcgtcgatgtcgtgtggcatcacaacctcggcaccgcctatcagctcaacgagtccgtcggctccatcatcgctcgcgacgccccgaagtcactcgtgctcgtcggcgttgccctcgccatcgccgtgatcatcgcggtaccgatcggcgtctaccaggcggtccgtcgcaacacggtcggcgaccaggcggtcaccgcggtgtccttcctcctctactcccttcccaccttcttcctcggccagctgctcattctcttcctcgccgaagacttccacctcttccctgccgaggcgccccaaggggtcacgctgggccagatcctgtccgacccgattgcactcgtcctcccgatcgccaacctcgtgctcgtgaactacgccggctactcccgcttcatgcgttcctccgcgatcgaagccctcgcccaggacttcatccgcacagcgcgagccaagggtcttcccgagcgggtcgtcctcttccgccacatgctccgcaacgccctcatcccggtcgtgacgctgatcggcctttcgatcccggcgatcttcacggccggcctcatcaccgaggctctcttcaacttcccagggatcggatcggactacgtccaagcactcgtgagtcaggactatccgctcgcgctcggcatcacgttgctcgtcgcggtgctcaccgtgctcggtaacctggttgccgacattctctatgccgtcctcgatccacgagtccgttatcgctgagcacggacctaggaacggagcccaactcatgtccatcaccgacgacctcaaccccgatctcgaggctgacctcctcgctcccctccccaccgggctcgctggcgcgtcccccgaaggccccgaaggcggtgacgtctcgggtgcaggttccgcgtggcgcctcacgctccgagctttcttcgacaaccgcctttcctatgccggtcttgccatcctcatcgtgctggtactgttctccttcgtcggacccctcgtctatcactccgacctctacacagccacctacaacatcaaccttccgcccggtcccggtcaccccctcggaaccgattcgagcggacgcgacgtcctcgggcgcctcatggtcggtggccaagcctcgctcatcatcggcgtactctcggccgtcatctcgaccgtcatcggggtgatctggggtgcagtctcaggcttcttcggtggcctcatcgacaccttcttgatgcgcattgtcgacgtccttctcgccgtcccgacgatcttcatccttctgtacctcgccagtatcttccggcccacggtcctgctgctgtccatcaccatcgcgatcttgtcctggctcggcgctgccaggctcgtgcgaggggagaccttgagcctgcgctcgcgcgagttcgtgcgcgcggtccaggtcatgggcggctcacgctggcgcatcattcgccgccacatcatcccgaacaccatcagcgtcgtcgtcgtccaagccaccttccaagtcgccaacgccatcctcctgatggccaccctcggcttcttgggtttcgggctcgagcctccggcagccgactgggggtccatgctctcccaaggcgtcaactacatctacgacggttactggtggctgatctggccggccggcatccttattgtgctcgccgtcctctcgttcaacttcatcggcgatgcgctccgagacgccgtcgaggtccgcctccagcgccgctagggcgacctggctactgccgagcacgggacgatcattaccggtgtgtgacgccatcgcgtcccagacgaccatcgccattgcgttgcgatagcctctccctgagtcacgcttgaagcgagtcttcgtgggtcggagctcgagtccgcgccctcggtgcccatgaagtcgccttgtcgcgtcacaatcgcaaggaggtccccgtgcgccacatccggccgtcgcgacggcgtctcctcctccctcttcttgtgggtgcaaccggattcgccctcgctgcgtgtggaacgtccggtgcggccgagccgtcgagcgcctcaccacacggagtcgtgacgttcgcggaacaggtcggggctgctcccaactacatcttcccgttcaccgcgagccagtacttcacggtcgacaacacgtcccagttccagttcctcatgtaccggccgctgtacttcttcggcgtcgccggtcgaccggtcatcaacgctgagctctccctcgcggctcttccggtctactccaacaacgacaccaccgtcacgatcaccctgaagcactacatgtggtcagacggcgagccggtgacctcgcgcgacgtcatcttctggatgaacctgctcaaggcgaacaaggccaactgggccgcctacgtgcctggcgccttccctgacaacgtcgcgtcgtactcggctccgaatgcatcgaccgtcgtcttccacctcaccggcaaggtcaacccgacgtggttcacctacaacgaactgagccagatcacgccgctccccatcgcctgggaccgcacctcgctcagccagccggcacccagcccgtcggccgccaacttgcccgatacgacgacctcgggggccaaggcggtctacaccttcttgaactctcaggccacgaacgccaacgcctgggcctcgagcccgatctggtcggtggtggacggcccgtggaagctgaagagctcgtcgacgaccgggcgcatggtgttcgtgccgaacccgtcctacaccgggccggtcaagccgtcgctgtcggagttcgtggagctgcccttcacctcagacaccgctgagttcaacacgctgcgcgccggcaacggggcgatcacctacggttacgtgccgagcacagccctcagtcaactgggcgtggtgcgctcgatcggctaccgcatcgagccttgggtggagttcggcttcaactacttcgtcgagaacttcaacaacccgacctacggaccactgttcaagcagacctacttccgtcaagccttccagcatctcgtcgaccagccgcagtggatctcgaccttcctgaagggctacggcgtgccgagctactcgccggtgccgctcgcgccagcgaatccgtatgccgacgcagcatcgagacacaacctctacccttattcgatctcggcagcgaagtcgctcctcaccagccacgggtggacgatggtgaacggcgtcatgacgtgcgagcgcccgggcacggccgccaccgactgcggtgcaggcatcgcgaagggcttcacgctcacgctgagcctgcagtacgcctcgggtaccacgtccatcacccaggagatggacgcactccagtcggcagcagccagcgcgggtatcaagatcaacctctcccaggcgccgttcaatacggtgttcgccaacgccgccccgtgctcaggttcgagctgtacctggcagatcgagaactggggcgcgggctgggagtactcgccggacgactacccgaccggtggtgagctctacacaaccggagccggctccaacgtcgagggctggaacgatccgacgacgaacaggctcatcgccgcaactcacacctcgtcgaatccgcaggcagcgctcgatgcctaccagaactacatggcgagggtcctccccgtcgtctaccagcctctcgccgactaccaggtatcggcgatcgcgaacgaccttcacggcgtgagccagaatgccttcttgaacctgacgcccgaggcgtggcgccttggctgagctgggcgacgctgctcgcggacccctctcgccaaggacccgctgagcgcaatcctccagagccccgcgggtggccggatagcctggaggccactgtgacccaaccagaccctacgccagccatgccccgagcccagcgacgtcgagtatcgaagcgacttcggcgccgacgccgcctcgtcatctccctcgccaccgttctcgcgctcatcgtgctgatcggcgcgggcagttacctctacatccgctatcgcttcggccagatcggacacgtgtcggtcggcgggctcacggcgcagagctccggtcccgagaacatcctgctcgtcgggaacaattcacggtgcacgttgacgaagtactcatcgttctactcgaagggctcacagcacttcggcacctgcagcgaggttggtggtggtcgcagtgacgtgacgatggtcctacacgtcgatccagcgacgcaccgcgcctacctgctgtccatcccgcgagatctctggctgcccatgccgaacggcaacggactcgaactccgtgtcgacgatgcgctcaactccgccgagcgcccctatctccacctgcccttcggaccgaccttgctcgtcaagacgatcgagcaagacctcggcattcccatcaaccactacgtggagttgaacttctacaccttcgagcaagtcgtcaacacgctcggcggcgtcacactcgacttcccgaccaagctcgtcgaccactactccggcctcaacatcacgacgacgggctgccagcacctcaccggcacgcaagccctcgcgctcgttcgagcacgacacctgtactactacaacccctccaccgggacctgggactacgacggcacgggtgacctcggacgcatcgtgcgaacccacatcttccttcgagccctggccagtcaggtgaagagctcggcactctcgaacccgatcacggccaacgcgctcctcggctccctgctgccggcgctcaaggtcgacccgtcgttctccctctcggacatggtgagcctcgcgcttgccttccgacacgtcaaccctggctcgatcccgagcgcgacgttgcccgtgatcatcccctcccagagcacgttcaccgaccctgcgaacccgtccaactatcaggcgccgggctccatcgtcatgccgtgggcccagagcgacctatcggtcattcgccagttcctcggctctgaggcccccaacctcaacgccattcgtccagcctccgtcacggtcgcggtacgcgacgcaagtggtgttggcaacggtagccagctcgtcgctggactctcccagcttgggtttccaacgaccaacctcggtaccgcaacctacgccggcaccgactccgagaccgtcgtcgcctacaagcccggcatgctcgcccaaggcgagcgcgtgctcgccagcctgtctggccaggcagtccttgccgagggctcggcaaatcagcccgccgacgtggtcatcaccgctggatcgacgatcgccaccaccgcaacctcggcccagaccgcagccctgacgacaacctcggcaccgaccgccacgctcaccgccacctcgacgaccacaccaccggtgggaacgctcgtgacctcgacgcagagcctccagcaactcgcctcgtcgaacctgtggcaggccaacgcgagtgggtccgagttctggtgggatccacgtctgtgccccgcccacgcctagtctcgcaggggcgcgcctagtctcacagcgagatgcccgagaccccctcactccacatcgtcgaagtcgctccccgcgacgggctccaaaacgaggcgaccccggtcgtcacccgagacaagctcgaactcatcgaggcatgcgtcgccgccggtgtcgaccgtatcgaggtcgcaagcttcgcacatccctccctcgtaccgcagatggccgacgccgaagcggtgatcgagcagctctcagaggctgccctcgcccgcgcgatcgcgctcgtcctgaaccaacgcggtctcgagcgtgcactgcgtacccgcattcgagagatcaacgtggtcgtcgctgcctccgaaggcttcgccagggccaaccagcgcgccacgcgcaccgagctccttgcgacagcacgcaacgtcctcgccgatgctcgcgccgccgatctgcgtcgttccctcaccatctccgtcgcgttcggatgtcccttcgatggggaggtcgatccccacgaggtcgtacgcatcgtcgagacgattcgagaggccgacccagcgtgcgagatcgccctcggtgacacgatcggcgccgccgcgccgggagacgttgctcgaatgctcgagctgctcgcggacctcgtcgcaccgaacgagctgcgcctgcatttccacaacacccgcaacgctgggatcgccaacgcctgggaggccatgcgcctcggagtccggaccttcgatgcctccatgggaggcatcggcggttgccccttcgcgccacgcgcaaccgggaacatcgccaccgaggacctcgtgtggatggcgacgcgctctggctaccgaaccaacgtcgacctggagcgcgccatcaccatcgccccgctgacgacgcgcctgctcggccacgaggttgcgtcgatggtggcccgagccggcacattccccgccggcacctcctcgcagccgaacccgtccctctagcgcggcgctgctgcctcgcgaggtcgcaccgacagggggaagtggcacgccgcgtggtggacgcctccgaagtcgcgcatcgggggctcctcggtgcggcagatgtcctgcgcataggcgcagcgcgtgtggaaccgacacccaggtggaggggtcatcgccgacgggagttccccacgcaccagcgagcgctccttcgtacgctcgacctccggatccggctcgggaacggcctcgagcagcatgtgcgtataagggtgcttcgcgctctcgaagatgtcgtcgcccgagccaacctcgaccagcttgccgagatacatcacgccgatccgatcagccagatagcgcaccaccgacaggtcgtgcgagatcacgatgtaggtcaggttgtgctgagcctgcagatccttcatcaggttcagcacctgcgatcggatcgacacgtcgagcgctgacaccggctcgtccgcgacgatcagtcgcggcgacaacgcgagcgcccgcgcaaggccgatgcgctggcgctggcctccggagaactcatggggatagcgctccatggccgcaggggccagaccgacctcctggagcaggctcgcgatccgctcaacacgctcggccttggtgccgatcttgtggatgtcgaggggttcttcgaggatctccttgacgcgcatccgcggatcgagcgatgcgaagggatcttggaacatgagctgcagctcgcgccgcacctcgcgtacgtaaccacgctcgttgacgatggagcggcctgcgaaccggatgtcgcccgccgcgggctgctcgagccccacgaccatctgaccggtcgtggacttcccacacccggactcgccgacgagcccaaaggtctctccttcgtagacggtgaacgacacgtcgctcaccgccttcaccgtgccgatcttgcgctgcaccaccgcgcccttggtgacggggtactccttcgacacgtggtcgaactcgagcagcaccggccggtccgtgacggtgcgctgtccggtgcgacgctccaggctgatcgggacacgctccggtgctccaaccggatagaagcaggcaaacggatggagatagccctccggggtcgtgtacggcggcttctcgacgcggcagcgctcctgtgcgtagtgacaccgcggcgcgaaacggcatcccacgagatcgcccgtgaggtcgggcgggattcccgggatcgagtacaggcgctcgggtgcatcgcccgtcagcggtggaatggatgcgaggagcgcctcggtgtagggatggtaggtggaggcgaacagctcggcggcgtcagcatgctcgacgatctctccggcgtacatgacgatgacgtcgtcggcgcgacctgcgatcacgcccatgtcgtgcgtgataaggagcatcgccatgccgagcttcgccttgaggtcctcgagcagttcgaggatctgggcctggatggtgacgtccaaggcggtcgtcggctcgtcgaggatcacgagcttcggatcacagctcagcgcgatggcgatcatcaccctctggcgcagtccgcccgacagctggtgagggtaggattcgagccgctcgcgcggattgggcataccgacgagcgagaggacctcgagcgctcgctcgatggccttgtccttcgagtagccaaggtgccgacgaacgacgtcagtgatctggtcaccgatggtcatgcaggggttcaacgacgtcatcgggtcctggaacacgaccccgatcttgccgccccgcacgtcctggagctccctccgcgacagcccggcgaggttgacgccgtcgaagaggatctcgcccccggcgatgtagcctccctggggcagcaagccgaggatcgacatccccatcatcgtcttgcccgacccggactcgccaacgatgccgagcgtcttgccctgctcgagcgagaagctcacaccatcgaccgcacgcacctcgcccttgcggagcctgatgcgcgtcctcaggtcacgaacctcgaggagtgccatcgcgttcctccatgctccccacgccacctacacggtggctgcatagagcgccatgctacccgcgtcggcgcgggtccggtggcgcagcagcccgtgaatcgaggtgctagcatttcagctccgcggggtgtccccgcagagcttgtcggagtggcggaataggtagacgcgctaggttgagggcctagtgaccgcaaggtcgtgggggttcaagtcccccctccgacaccaagtcccccaccgacgcagctgagatctcgcgccggtcgatcgtgcaacgcgtggcgccctcgcacggaccaaggtgggcctcgatgcccagcacctgacgagacccagcgaaacgccaggtcaccacccctgagcggctccaggaccgccacgagttgctcgacgctcgcctagctcgcacgcggcgagcccttctctcggcgtcgctcgactcttgtccgcatggaggctcgccaccgaaggtgggccatcgctctcacccgacgtcgagcgcgcctctccagacaatcgccgaggtctcggcaaccctggagcgcctggacatcgagccctcgaccgctcgccgcatgcgctatctcgacacctccgcgcgtctccgccagctcggggcgcgggccgcccttcggatacccagccgctcggcgcgaagtgcccccacggaaggggaccttggtaccagactgaggcccgtctcgccgagtacggttggccacggaggtggagacatgctgctctcaacccacgccgcgcaggtggtcgccgagactcgacccacgccgaggctcgtgctctgggagacgactcaggcgtgtccgttggcctgcgtgcactgtcgcgccaacgccatcagcacgcccgatcccgacgagctcacgaccgccgaggggttcgccctcatcgacgatctcgcagctgttgccggcccacgtccggtcatcgtcttcaccggcggcgatcccctgagccgacccgatctcctcgacctgatcgcccacgccgcagctcgaggtctccacgtcgccgtctcgcccgccgtgagcgagcgcatcacgcctgccacgctgaccgcactctacgacgccggggcgcgcgcgatctcgatctccctcgacggactcggcaggaaccacgacgcaactcgccgcgttcccggtcacgcgctgcgcaccctcgaagcgctcaccatggcacgctcggtcggtcttcgtgtgcaggtcaataccacggtcatgcgcaccaccgtcaatgacctccccgcggtcgccgaggccatgctcgcgcgcaacatcacaacctgggaggtcttcttcctcgtgccgaccggccgcgcgagcaccgagctcgccctcaccgcccacgagcacgaggacgtcgcgcgcttcctctacgaaaccaccggctacggcttcatcgtccgcacggtcgaaggaccgttctaccgccgtgtcgccgacgccattgcaaccagcaacgacgcagccctcgcccccatcggcgagctcggcgagcggctgatcgccgagctccatcgccgcctcggcgatcctggccctcgtcgccgtccgtcaccgcacccggtgcgcgacggtgatggcgtcatcttcgtctcacgtaccggcgaggtctacgcctcaggctttctccccgttcgactcggatccgtccgcgagcgcagcctcctcgacatctacgcctcggacccgttgctcgacgccatccgccaggccgcactccccggccgctgtggccagtgcgactgggccaaggcctgcggcggctcccgtgctcgcgcctgggcgatcaccggcgatccgctcgccgacgaccccgcgtgcgcgctcgtgagcgcctgaggccccgaggcaggtcggtaccagtccggagccagcggctcgcgactgcccgtgggctcgcgcacgcctcagtcgacccgcaggccgccgctcggcgcgtcacaaaaccgatcgtgcacccagggcgagcgcagctctcaccggccccaccaccgaacagaactgcagcttccggctcgggctacgcggactgcgtggatccctcaagtccgcgctctcgccgccacgccgccgcgacggctgcgatggcctcgagcgcgtcgtagtgctggactgcgtcggcagtcgcgaccgcgccgagcggctccccgaggaacagacggcgcaccggcacctccagcttcttgccgttcaacgtcttcgggatcgccggcacagggacgatgcgatcgggcacgtgtcggggcgacagctcccgccgcagcgtggcacgcagccgatcgtcgagtccgtcgacgtctccggcgtgcacgaacacgatcagttccccgggtgtgtcgagcgatgaggtgtcgacgacgagcgcctcgacgacaccgtcgacaccttccgcgacgcgatagaactccgccgtccccatgcggaccccgccccggttcagcgtcgcgtcggagcgaccatggataatggccgaccgatcgtcgaagaaggtcacccagtcaccgtggcgccagatccccgggtagcgatcgaagtaggccgcacgcagccgctcgccgtcgtcgtcgccccagaacgcaaccggcatcgagggcaagggctggcgaatgacgagttcgcccatgaccccgatcacctcacgtccctcgtcgtcgaaggccgccgcatccaccccgagcgcgggtgcgctgatacgtccttcgagcgtcgggctcaccggcgacgaaccgaggaacgcggtgcacacgtccgtgccccccgatcccgacacgagctgcacgttccccggcacgtgctcgtagacccaacgaaaccccgcagcggtgagtggtgcgccggtcgaggccacgacccgcaaggagtcgagcgtggcttcgtcgcgaggtcgaacaccggcgacctcgcaagcacgcagatagggcgccgacacaccgaagtacgtgatgcggacctcgtcgacgagccgccagagacggccaggatccggatgctgcggagccccgtcgtaaaggacgatcgtgctccccacgagcagaccgcccatgaggtagttccacatcatccacccggtcgtcgtgaaccagaagaaccgagaaccctcgccgatgccggagttcaacgcgagcaccttcttgtgctcgaggacgatgccaccgtgggcctgcacgatcgccttcgggataccggtcgtgccggacgagtagaggatccacagagggtcgttgaagccaacgacgaccggggcgacggggtcattggcttcgagcgcatcgaaggccacgaccggcacctctgtcgctggtggctccccgtcgcagagcacgacggtggtcaccgacggcagcgactcgagcacctcctcgacgacggcccgtcgatcgagctggcgtccctgccacagtgacgacgtcacgcagacgaggatcgtcggttcgacctgacggaaccgatccacgatcgcccgcgggccaaagtccggagagcagcatgtccagaccgcacccaccgtggctgtggcgtgcagggcgatcgccgcctccagtcggttcggcaggatcgccgcgacgcgatcgcccaccccgacaccgtgagcgacgagccagcttgcgacgcgatcgacctcggcccagaacgaggaggctcgaagcgtccgtacctcgccgtcatcgcgaacctcgacgatctcggcagggtcgacgaagcgagcacgcgcctccgcgctgtagttgagccgtccctccggaaagaatcgtgcgctcggcatggcaccaaccagatcgaccgagccaagatcaccctcgagaccgcacacggcggcgacgtcgcgccagaacgccccgagatcggccaggctggccgtgtgcagagcgccgtaggtcgcaagcggcgatccgtggcgagcctccaggcgtgcccgcacggcaccgatcggaccatcccatgcgtcggccggcggcgaccacagcactcgtgcctcatcggccatcgcctacctccccggcctcctcgagggccgccgccgcccgctcgagcgctcgttgcgctctggccagcgctcgttgtcgagcccgttcctccgcagggtcctcgacgtcgagcaagcgcgcgacgaccagctcgtccaagcggtcggcgacggcgcgcagcgcctcgagcacctccccgacaccctcgtccacgtctccctcccgatcgctcgcagactaggtgacgacgatgagctgcccctcggtgaaacgctggcggagcaccttcttgtcgaacttgccgaccgaggtcttcggaatctcgtccacgaacgcgaaccgttccggcagccaccacttcgcaactcggctcgcgaggaacgctcgcagctcgtcggtcgtcaccgtcgcgccctcgcgcagcaccacgagcgcgagcgggcgctccacccacttctcgtcggggatgccgataacggcggcctcggcgacggcaggatgcgccatgagctggttctcgagctcgatggagctgatccactccccgcccgacttgatgacgtccttggtgcgatcggagatgcgcaggtagccctcggggtcgatggttcccatgtcccccgtgcgcagccatccgtcgtggaagcgctccgcatcgtcgaggtgatagtaaccagccgtgatccacgggccacgcacctcgatctcgccgagcgcgaccccgtcacgcgggagagcggtaccgtcctcgccgaccacacgaagttccacgccgggcacgggtttgcccgcggtcgcgaagtagtccgccaagcgatcgcggggcgtccccgcgggcggcaaggcgagcgtgcagatcggcgaggtctcggtcataccccatccagagatgagcgccacgccgtaacgctccaggtaggcctcgatgagcgcccgcggcgtcgcggatcctccagaggtgatcgatcgaaagctcgacagatctgccggatggtcctcgaggtagcgcaacaactcgttccagatcgtgggcacgccggaggccatcgtcgggcggaaccgctcgatcatctcgacgagcggcgcgggctggaggaagcgcgtcggcatgaccatgtccgcgccactgacccagcacgtgtagggtgcgccccacgccgccgcgtggaacatcggcacgatgatgatcgcggtgtccgcggccgggtggaggaggtccatggcgcgccgtccgtagagcggtcgtgacatctccgcatggaggtagatggaccggtgcgagtagacgacgcccttcggattgccggtggtgcccgaggtgtagcacatcatcgcggcggcggtctcgtcgagctccggccacggatagggatcgggcggctgggcctcgagcaacgcctcgtagtcgtggacggcgaggtcggggcgagcccgcttgatggcctcgagcacccccggatcgagcacaggtccgacgatcacgagatggcgaacgctggtggcctccgggagcaccgcctggagcatgccgagcacgaggttgtccgcgatgatcacgaggtcctcggcgtcggccaccacgaagcgcagctgatcggggaagagacgcaggttgagcgtgtggacgacggcccccatggacgggaccgcgaagtaggcctcgaggtgcgggtgatggttgaacgagaacgtcgcgacacgatcgccgacacccaccccgagaccggcgagggcgtgcgcgagacggtgcgtacgggccgcgacctcgccgaacgtgaacgatgccacccagccagggccgaggtaggtgtggacgtgcgcatcagggaactcggtcgcgccgtactcgaacatctgacgtacgccgagcgtcccatgctgcatggtcgagttcaccagcacctcctttgtcaccgaccatgctgccacaacccctcgaccatcgccacgcaacgcagggaccttcgtcccttggcgccgcgaacacgctcgctagactcccacgcgatggatcgagtggtggtggtcggcgccgggatcgccggcatgacgatcgccgtcgagcttgcgcgccgtggcgctcgggtccaggtgatcgccgatccctcgcgatcgccgacgacgcccgtcgcagcgggcatgctcgccccggccgccgagaccgacttcggcgaggacctgctcgtacggctcgagcaggacgcgcgcaccgcgtgggaagctcttgccgcaacgttggagcgcaacggcgacaccgacgtgctcttcgaggtccgtgggtccctggtcgcggcccagaccccaggtgacctcgatcaccttcggcgcatggtcgatctccagcgtcgcttcggcatgaccgcatccctcctcggcgcgcgtgacttggtcgacctcgagcctgcgctctcgagccacctcgctgggggcgcgctgctccccgacgacgcccaagtcgacaaccgccgagcgctcgcggcctacgacacctgggcagccaagctcggtatcgagcgcatcgaagccgcggttcgtgcggtgcatcccgacgccgtcgagcttgccgacacctcacgcctccaagccgacacggtcgtcgttgcagccggatcgtggctccgcgacctcgtcgaggtcgcactccagccggttcgcggcgtcaccattcggggcacgctccccgttggcctcgccccccgtcactgtctccgaggagagctccgcggccgcagggtttacatcgtcccacgcgcgtcacacgagatcgtcatcggggccacatcggacgaagcgcccctcaccgaccgcgacccccgagctcgcgatctgctcgatctcctcgacgacgcgcgcacgctcgcaccggccatgggcgagctcgcggtcaccgacgtgtcggtcggctttcgccccgcgacgcccgacaacctcccgatcgtggggcgcggagacgacggcgtctgggtccacggcggccactaccgtcacggcatcctcctcgcgccgttcacggcgactctgcttgcggacgccatcgtcggcgatggtgtcgatccgaggctcgcagccctctccccgactcggctcaggtcgcgcgcatgaccaccctcgtcatcaacggttccactcgaacggtcgaggcgaccaccctcgcagaactcgctcgcgagctcgagctcccgagccgtggcgtcgccatcgcacgcaacgaggagatcgcgccgcgcagcacctgggatgcggtcgcccttcgtgacggcgaccgcatcgaactcgtcaccgccgtacaaggaggagcgtcgtgacggtcaccatcggacggctcacgctcgcctcgcccctcatcctcggcaccggtggcgcacgtcgcctcgacgatatcgaggccgcagtcgtcgcatcaggcgccagcgtggccaccgtcgcgatccgccgctaccagccgggggcgagctcggtctacgacgtgctcgcccgccatcacgtcaccccactccccaacaccgccggggcgcactcggcgcacgaggccatcgtgctcgccgagctcgcacgcgaagccctgggtgtcgactgggtcaagctcgaagtcgtgatcgacgaccggaccttgctccccgacccgttggagctggtacgagccacggaggcgctgagcacgcggggcttcgacgtgctggcctacacgaacgacgacccggccacggcacgactcgtcgaacgcgccggcgcggtcgcggtcatgccgctcgcgagtccgatcggatccggtcttggcatccagaaccctcgcaacctcgaggccatcgtggccgacgctggtgtccccgtcgtcgtcgacgccggcatcggggctccctccgacgccgcgctcgcgctcgagctgggcgccgatgctgtcctcgtagcctcggcgatcatgcgcgccgaggaccctgcggtgatggcacgagccatcgcgctcgcagtcgaagcgggcgcactcgccaggcgggccggacgcataccggctcaacccctcgcggtcgcgtcctcgcccgtcgagggcctgcccaacgtctcgctctagagcgcgtcggccacgttcgcacaaaggagaccgtgatgacccctacccccgccgtggcactcaccatcgctggctccgactctggcggcggagccgggatccaagccgacctcgtgacctttgccgcgttcgaggtccacgggacgagcgccattaccgccgtcaccgcacagaacaccgtcggcgtctccgcggtcgtcaccatcgaccccgacgtcatcgaggcgcaagtccgatccgtgaccgacgacttcatggtgcgtgcaacgaagaccggcatgctcgccaccgcgccgatcgtcgagcgcgtcgccgcgctcgctgcctccggtatcctcggtcctctcgtcgtcgaccccgtgatggtctcgacgaccggcgcgaccctgctcgatgctgacgccgtgcaggctgtgcgtgacgccctcctcccgagtgccgcgctcgtcacacccaaccgtgccgaagcggaactgctcacgggcatagccatcacgagcatcgaggcccagcgtgctgctgcgcagcggctggtcgaactcggcgctcgcgccgcgctcgtcaagggcggccacctcgacggacccgatgcgatcgacatcttgttcgacggccgcaacgtcgtggaactgcgcgcaccacgagtatggacgcgcaacgaccacggcaccggctgcacgctctcggctgcgatctgcgcgtgcctcgcgcgcgggctcacgctcccccgcgccgtcgaggaggcgaaggcctacgtgactcgcggtctcgccgacggcgccgactggggcctcggaactggacgcgggcctttcagccatttcgccaagggccgcccagcggtcgtggcctgagaccactcacccgtaccactcacgccacggagctcgcaatcgactacgataacggagcattgctgccgctcaccgtgagaggtcgcgctcagtcatcaggagcgtccatggaacccaacgtcgccacctctggggcaccgcacgagcggaccgcaaccgcggtggtgcgtcggagcatcgccggcccgcctgatcgcgaactcgttgcggcgctggcggcgctcgcagacgcgatcgaggccatcgactcttccaccaacccggcgctcgtcgacgccgcgacccgcatcggtgctcgcctcgactacctcggtcatcggccgagcaccctcgtggccctcctcgccgcactggcggagagccttggtcgtcacaccacggccgacaccgcggtgatgcgagccctcgcgatcgcgacggatgccctcttcgcacgccgggagcgcgaactcgttcgtctctccatgctcgcaacccgcgatcccctgacggggctcccgaatcgtcgagcgttcgcagacgccctccagcgatcgtgggcacgcgcgaagcgtacgggtgagcgcgtcaccgtcatcgccctcgacctcgacgacttcaagcacgtcaacgacacgtacggacaccgccgtggggatgaggtcatggccgagttggcccaccgcctcgccaaggccgtccgcgccaccgacgtggtcgctcgcaccggcggggacgagttcggcctcgtcctcgaccccacgggtgaggaggccgcggtcgaaccggtgctggcacgcctcgagcgcgagctccagcgcccactcgcaaccctcgacggtggccgtctcctcgcctcggcgggcatcgcctcgagcgatgctctcaccatggaggccgatgcgctcctcgacgctgccgaccaggccctctacgtcgccaagcatgctcgcccggtcgagaacgaggtgctgcgcatctcctactggcaacgaacgggcacacccacgacagggcacaggctcgcccccccacacccctccgaaggcatctcggtcgtgtatcaacccatcatcgatctcgccacagggcggaccgttcgcgccgaagcgctcgcccggaccgacgcctcgtcggccgtgcactccgtggagtcgctgctccaggccgcgacgcgagccgagcacgcacgcttgcatcgccacatcgtggcactcgtcctcggtgacctcgccgccctgggacccgatgcacgggtcagcgtcaacgtggacgcgggcgtcctcgacgatcaggtgctcacgaccacgctgctccacggactcgaccagctcgcacctgggcaactgcgcatcgagatcaccgagcgcgacatcttgctcactgctcatggagacgtcgttcggcgcctccgcgagcacggtgcgaccatctcgctcgacgacttcgggaccggctttgcgagtctgtcgcgcctgctcaccatccccgtggacgagatcaagctcgaccgcagcgtcgccgctgatcggcagatgggatcggtggcgagcgccgtgctcgcgatcgcggtggcactcggacgcgctctcgacatcgacctcgtcgtcgagggtgccgacagcatcgagcgtgccgcgcagttccgcgcgatcggcgtgccgctcgcgcagggattcgcgatcggcgagccgaccgcgtcgctccgccaggcactcgacaccaccatcgatctcgacacgctcgatcgatccctcgtctcgcgggacgtcgccgatgcgcgggcgagcatgtgggagcaggcgatcgcatgcttgctcaccgccgagcccgatggcgacctcaccacctgtgtcatcgccgccgacctcgacgagcccagacggcgagcacacctggagcaccaccgcatcatcgcagagatcctgggccgcgcgggcgtcatcgacctgcgccgcggtgccgaacgcgtcccatcgccatcgtcagcgcggcgaggaccctcgtagcaccctaggagtgtgcgcgaggacggctgacgctctcgccgaccgtcgccgcccggttccgcagcgcctcagctcgtggtgggggtcgcgcgccgagcgagcgcgacggtcctcggagccacgaacccgatcacagcctcaccagcctcgctgaccgcaagcagcgcccgtgcaagatcggagcgcacctcgaccgtctcggttgcgacgacgtctgccaccacgcgcgaggcccccacccacgcttcgtcaaggtcggcgcgaagccgcgccggcgcctcgaggtcggcgaccaagcgctcgagctctgcgcgaaacaccgaggcggccgacgtgagtgcatcgcgattgggcaccaccatctctgcgacacgagccccatcgctccgcgctacgcgggttgcgtcccggagcgaccccgaaccgagccaccaggctgctgggtgtccgctgtcagcgaccagcacgcgacccatcgcagcggcgaggaggtggggcagatgagacaccacggccagcgtctcgtcgtgcgccgtggcatcgagtgcgaccaccgcacccgcgcccgcgtcgccgaagacgaactcgagcgcggtcgcgacatcgtcgtcggactcgctcccatgaaggacgaaggcccacgacgcaccgtcccagatcgatggatccgccgatgcggcgccatggccctctcgtccggccatgggatggacgctgagatggcgtaggccagccggtgcagcgtcgacgacggggcgcttcaccgaggcgacgtcgagcaccagacctcgcgccccccgctctccgagcgcgcagagcacatccccgaccaccggtgtcggcgtcgcgacgaccacgatctcggctgccgagacggcgtcccagccgaccgtcgccgaggtgcgttcgcgaacccaagcgaccgcctcgggatcctcgtcgatcaccgcgagtgggccacggcgaccgagccggagggcgagggaggcaccgatgtggccgagccccacgatcccaacgctcggacgcccgaactcagccatcgtgcgcgagaccatcggacggcggtgtcggcctcggcacgacgacctctggtccctgccagcggggataggaaccgagcagccgcacacgatggccgagccgggccagttcgccaagcgcatgctcgagcccagggtcagccgcatgaccccgtgtcccgatcaggaagtagtgctcgtcgccaagcccgaggggtcgcgagacgatcgaggtcagattcacgcccgctgcggcgagcacgctcgtgatctcggcgagcacaccgacgacatcggcgcgtggcacgacgacgagacgcgagcgatcgtcgccagtgggcgccgggagttcgtggccgatcagcacgtaacgggtgcgaacctccggaatgctcgtcacggagtcctcgagcgcgatcagctcagcctggtagccaacctccggcggggccagcgcaacaagcccaggacctgcgagcgcgacctcctgacaggcgtgacgcgtcgagagcgcctcgcgcacctccgccccggtcgcagcgatccacccagccgccaacgcaaggatggcaggatgggagatgacgacgtgggccgacgcccccgcgtcagcaccgaaggcccagatgggctcggccagcaccgcctcgccgaccacgagcacgcgtgcatcgacgagccgatcgagggtcgcggcgagttcgccctcgaggacggtctcgaccggtacgacgccaagcagtcccggggtcgcctcgacggtcgagacgacctcgtcgagcgagatcatcgggagagggtcggcgtccgcgagtccgaagagcccgagcgaacgatggctcgagctcccgagcggctcggcaaacgccaccatgcggcctgggcccatccaacctccttggttggttcagcctacctggcaccacggcgccaccttggttaggcgaccgcttcgtcctggggggcaccatggcgccgcacgagcgcgagcagtccttcgaccagttcggcgacgagcgccgacgcggtcggatcgaccaagcgccccgacgcatcgaagcgccgttcggcctcgttgatgaagacctccgggcgcgcgagcacgaccgagttggttccgtggaggacctgacgcaggtgcgcctgcgcgcgaaccgtgccgaagaggcctggagcgacaccgaggacggcaaccggctttccgatcagcgcaccccgaccgaacgggcgcgacaaccagtcgatcgcattcttgatcaccggcgtgtaggagtggttgtactcgggggtcgcgatgatgactccatcagcctctccgaccgcggcgcgaagccgtgccgcgctggcgggcaggtcacgttcgagttcctcggcgtagaacggcacctgatcgagacgatcgaacacctcgtaggccacgccctccggcaacacgtcacggatggattcgagggccctggtgttccacgatccccgacgaaagcttcccgacaacccaacgagctgcatcactgcctcccctcatatggtggtcgccgccgatcgagcacgcctgcaccggcgctctcagcacgagctcaccgcgattgcttgcacgtgcaatcagtctagccgcagatgctcgctacgctctccccatggcacgcaccgtccgcctcgagggatccgtcgctgaagtcgtccgaacctgcctggtctacttcgtcgcgaccgcgccgagcgaccctcgcggccacgtgaactgctcgccgcgagcgaacgacggcacgttgatcctcgacggccccgatcggcttcgcatcgtcgacctcgtcggttccggggcggagacgatcgcacacctgcgcgacaacggccgcatcacggtgatgatcgcctcgttcgacaagcgacccctcgtcgtccgcatctacgggcgggggcgggcccgctcaccgctcgacttccccgagctcgcctccacgctggtcggcgtgcgtgctgtgctcgacatcgcgatcgaggaggtgcggacctcctgcggctacggcgtgccgatcgccgaggggctgcggccccgcccgcaacttggcacctggctcgaagcgaagggtcccgagggcctcgccgactacgtcgcccgccacaatcgctggagcctcgacggcctcgcgagcatcgacggcacctggccgagtgaggcaccgagctcgtagcccccgagcaagccgctcgcccgcgcagccatcaccgtcgctcgatcgagcatccacccagacccatgacccggaccatcgagcgcgaccagcccgttcaaccaggctccgaccccagctgccagtgaaggccggtgcgcgagcaccctggcaccagccgcgaccgcccgatctgcgagccgaggattccagagggcagctcgatggaggagtgctgcgccagcgaggaacggcgccatctgggcctcggcccaacgaccgtaggccggtcctcctcccagcggtccccttgcaccgagagccgcggctgcctgggccccagaagcgagcgccgcccagatcccttcgccttggagtgggttcacgaaacccgcggcgtcacccaccaagagcacacgaccgcgccacggcgccaccccgatcccacccatccgcaaccagccaccgagcacaggagcgtcggccacatcgacgagtccgatccgaccgaggtagtcatcgagcaaggggcgcagccctcgcaggcgtgctcgctctcccccaaccgcgatgcccacgcctacgttcgcgatgccatcggcacctcgaaaggcccatccgtagctcgcgaacccactcgcctgcgcaagcaggtcgactcggtcggcatcgagcgtcgacgacgcaacgtagcgacgcagtgcaaagccccacagcgcccgtgtcggtgacgccgcccccaccgaccgcgcgactgtcgacagcgccccgtcggcaccgacgacggcgtcggcgtcgagcacgccgtcgtcgaggtggacccgcacaccgtcagctccttggacgagaccacgaacccggccgacgatggcacgggcccctgccgcgacggccgcgtcccgcagccatgcatcgaagagccgcctcgtcaccatccgaccctcgccggggtgcgcgagacctggggatgccggcaagtgcaggcgcgcaccctcgacccagacgtccaggtcgccgatccggggccactcgggctctggcgtgagccctacggcggccaaggtcgcgagcgcctgaggaccgaccacgtcaccacatgccttgtcacgagggaaggtgctgcgatccacgagcgtcacacgccagccggcgagcgcgagctgtcgcgcggcgatcgaccccgcaggaccggcaccgacgacgacgcacgacgggagaggactcatgggtccaggctacgagggccccctacgagaacgacacttggagcagtcgaacctggaggcgagccccaccgggaccgggcgtgggatctttgatcccgacctcccagtaggacccatcggacccggccttcgacgcgatgatcgtggtcgccgtcgacgacgcgctcgccgactcgacgtgccatccctcgtcgggcagtgccgcgacgaagaagttgcgaatctcggatggcgtcaacgccgaacgcaaccagacccacgcgtcgaactcggtcccgtagggattggcattatgacggcccgtgatcgttgcgtcggcggggatcaagatggtgcgctcgatgttggcggggatcacgttgccaggatcgagcccttgccacgccccgagtgacgtcgtcgctgagtatggaatcggcgaggaggcctcctctccgccaccagacggaatcgccgcgagcgagccgatcgccgcgacgaggatcgcagcgataccgacgccccagccgagaaccttcttcgaacgaggtgcgagcgccatggtgttaccagtctcgcacgagcgcgcgccgaagcggtagttcgagggcgccgacacagtaacctgatctgtcgcggcggcgtggccgagaggtgaggcagaggcctgcaaagccttgtacagcggttcgagtccgctcgccgcctccacaatcgggcgtggggcagatcgcggcacgcatgtcggatcatacgcgatcgccatggtcgccccacgctccacgaggcgtcgcaggtgcgagaggacgcattggtcacgctctctccggtcggacctgcggcccgcgtcaccggtcgccatcgatccgcgcgagtccgacgcacgatgacaacgccagcgccgcaacgtggctcaccgacgaccgaccacgacgtgtcagggcaaacgccccgccacgcccacgaccttcgtccatcgttgcgacgcaaccacgctgtacacttgagtgggtgatcgagatcgcgtcgacaatgagcgatcccgacgcctcgtgaaggaggtcgacgtgcaggatcgcatcttccaggttcggggcatgacgtgcgaccactgcgtacgcgccgtgcgaagcgaagtcgctggcgtcgccggcgtcgtcgacgtcgacgtcgatcttgccaccggcatcctccgcgtccgaagtgacgcgcccatcgacccagatgccgtactcgcggcggtcagggaggctggctacgacggtgtcgccacagactgacgccccttccgggcctcacgaggaggtcgctctgcgggtcagcggtatgacctgcacctcatgcgcgctgcgcatcgagcgctcgctcgacaaactgcccaccgtcgacgcggacgtgaacttcgcaaccggcaaggccgaggtccgcttcgatcccgccgtcgtcgatctcgccgaaatccttcgtgccgtgcgtcgcagcggctacgacgccaccgtcgccctctcgagcgacgcctcgcctcgcttccactggtgggcgatcgccctcgcggcgctcgtggcagccggagccatggtcgcgccgccgacacagctcgcacgcgatgtcgagttggtggcgaccctcgtcgtcctcgcaacggcaggtcgcccgttcttcgtcgcggcctggaacgccgctcgacaccgcagcgtcacgatggacaccctggttgcgctcggcgctggcgtcgcaatgacggcgagcgccatcgtcaccgtcgcgggcctccagcacgagccgacctacttcgacgctgcagccatgatcgtcgccttcatcgggatcggcaagctgctcgaggaacgttggacgcgtcgcgcgcgagcaggtctcgacgctctcgaagagctcagccgtcgaaccctcgcgcgcatcgacgacgacgggagcctgcacgaagttcccctcggcgagctcgaggcacacgaccgggtgctcgttcgcccgggcgacatcgtcccggcagacgcgcgagtcctcgacggggatgcggccgtcgatggcgctcttcgcaccggacgtcgcgatctgcggcgcgtcggccccggtgacgaggtcctcggcggtgacgcggtcgtcggctcgtcactcacgatcgaactcgatgcacctgcccgactcggcctcgtggtcgagctggctcgtctcgtcgaggtggctcagcaccgccgggcacgtctcgcgacgctcgccgatcgcgtctcggcccgcttcgtcccggccgtgattgcggtcgccgtggtcgtcgcgttcgttcgtctcgccatcggcgcaccggtcgccatcgcactgagtagcgccatcgccgtggtcgtcgtcgcctgtccgtgcgccatgggtctcgcgaccccgatcgccttcctcgtcgcgagcacgcgcgcggccgcgcgaggaatcgtgctcgaacaccccgatgccctcgagcatgccacctccatcgatacggtcgtgctggaccgaaccggcacgatcaccgaggccgatctcgttgcccactggcccgagcgcgtcgctctgtccgagcgacgcctcgtcgcggcactcgctgcgcgctcacgccatccggtctctcgagcactcagtcgagtcgagggcgacccggcgaacgccagcggcgacggcaacgaccccgagccggtggtcgagcacgttgtggagacgccaggcgtcggtgtcacgggacgggtcgatggacacgagatcgccatcggctctcccgcctctgtcggtgcgaccggcgtggaccctgccgcgagcgagcgagcagtgttcgtccgcatcgacgaccaatcgcctatcgtcatcgaactcgccgaacgcacgcgcgagggcaccgcagcaacggtggcggcactgcaccgccttggcgcgagggtcatcctcgccaccggtgacagccgcccaaccctcgcggacgaggcgcgtgagttcggcattgacgacgtcgccatcggcctcgatcccacggccaaggtcgcgctcgtcacgaagctgcgcgctgacggtcaccacgtggccatggtcggcgatggcaccaacgacgccgccgccctcgcaaccagcgatctcggcatcgcactcggtggtggcacgcatctcgctcaggccaacgcggacgccgtcctcctcggcgacgatatcgccatggtgccgaccgtgctcgatctcgcgcggcgcaccgtacggacgattcgccagaacctcggatgggcactcggctacaacgtcatcgccatcccggccgccgctgcgggtctgctgtcgccgatggtcgccgccgcgctgatggcgatgagttccctcgtggtggtgggcaatgccttgcgtctcgacgtacgcgagtcggcgggcgcatcgggaacgactgaggtccgctagagtggggccccatcgggccgttggcgcagctggtagcgcacttgcatgacgcgcaaggggtcagaggttcgagtcctctacggcccaccatatcgccgttttcgaacgcatggtcaagagcaggtcgaaggctcctgtgcaggtagcttcgacgtcgtgtccatcgtgcacgtggagctcgtccaagatgctcacgtcccaccgatggtgtacattcactcactggcactccctggccgccctcggcctactaccgcaggctcctcctcggcaagcggctcaagcacgggaggagtgctcgtgggccgaagcgtctgcgaggtctccttcgtgtcgtcgtggccctcctgtgtggcaccgagctctgccatggactcctgcaacaggtcgtgccactcggcaacggcccacccctcgtgctggccgagcacgacagcggtgacaggcggaggatgacggcgtcgtttccgaagaccccgacgacgtggtgcgccgcttgatctcgtggttcaaccgctctgagcgggttcgtcgaccagatcgttcgccagtggcgctctgggaagtgcgtgaaggtgtgagacctcctccttggcctcggcgagcgtggtagcgaccacggggagcgtgggggcaagggagtcgatgacctggtcgcactgggtacgtagcgctgccgggtacggctcgagcgacgatcgtacggatcgtgaggccaggaccatctccttgagctccccttcttcgatgcgagcgagcacgtcgcgcacgttgcacgcagtagctgtgccagctcgccccgacgacgcacctcgcgatggcttggtgaacccccgctctggcatcggagatgacgaggcgcacaccactgagacctcaagatccctgagctccctcgagaacctctcggtctgcccatccccgacgcacgaccccaaggacctcgtgcgtctcacgtggcatgcacgcccgtcgtgaccacgacggcacgggagatgacctggtgggcaaggcggccgttcgcgtcggtggcatcggcgacgagggagcagaaggcagagatggtccagcctgcggctacgaaaccccgccagctcctcgtctgaggttgcgatgatgcgagagacctcgctctctgtgacccccgttccaccgagggccgcgaccaggtcatcgactttgcggtgctgacgccctgagacgtaggcctccagaacctcgcacgtagagagcacgatcgacgcaggcggcgacgctcgcagatgctcgggacacgctcccctggcggagctgtgatggaagttctgacacgacgtctcctccggtgcccgggttcgcatgcgggcgcggaacgaagacggtctgccatatgggttaccactacctgtgggggtggactcggtctttcccgcgaacccggtggcaacgccgatgtcgatcccacgctcccttggcaccgggccgtcgaaccgagacctgaggcaagggcgccgcgaccttcggcgcgactaccgaccggtagacgcggatggcggcgtgctcaccctcggagaagccctgctccagggtgcgggccggggtcatgatccccgacgcgacggagcacgagtcggacgtccggaaccgtcgatttccccgagacccagccacgcgacgcgaacccacacgtcagtgaggttcgaacacgagtgactacggctcaccaggagaagtgtaccgaatgtggtacacgtcccgcatgagcaagatcgtccccattcgcgagcttcgcagtgagctcagccaggtcatcgaccaggttgccgacctgcgcgagcatgtcatcgtcactcgccatggtcggcccgcggccgttctcgtcccagtggatgagtacgaggccctggaggagacggctgagatcctctcggacaccgagacgatggccgcgatcgacgaggggcgacgtgaagtagagcgtggggagaccctgacgctcgacgagctccgccaagaactgcagtcgcgccgtagaggatgagtcgggtcgagctcgcccggcgcgcccgcaaggagatcatcgacctcgactggccactgtccgacgcagtggtcgaggctctcgggctgctcaagcgcgagcccgaggcaggtcgcctccttcggggacggcttcggggactgtggtcacttcgagtcggtacgtatcggatcatctaccagctcgacaatgatgagcgcgtcgtgcgcgtgctcgctgtccgccaccggtctatcgcttccacgaccgatccgcgctgacagtcagttcctggggagcgacccgatccgttctcggagatcgtcgaagttcgaatgcgagtgcctacggcccaccgcatgtcgacgtcgtcgtcaaacgtcgacacagactcgtcatggagatccaaggactctcgggagcccgcgtctcatctcgccgctttgcacgtgaacccgtcgaacgcgaccgccccttgcagcctgctcgaatgatcgcacccgagacgagccgcgatcgcgcagcaagtcgcggagcgttgaggccgcagctgtccgccttcgcttcgccagacagtgctatcgaccctcgtcgtgggaagtacccccgctgcccggttgcggagcgatcctggcgtagacgctcctgggcacctcggtcatgtcccgcacctgttcggcgttcacgccagaggcgattggcgcctccagcccgaccgcgcgacggccgatcacagcagcacggccggtgagccgtggcacgtggcgatctgatcgccatcagatgagacgcgcgcatcgagcccgagccatgctcggccgggttcacggccccaccactctctgccagtccgtcggccgggccaggacgccaccgtctcccatcccggcatcgaagccctacgtacgagacacggcatgcgctccagcttctgcgccactgcgaggccagcgactcatcggatcacacagccgctggcccgcccaaggtctcgacggtaggctcgtcccatggcctcgagtacgtacctccatggccaccacgagagcgtgctggccgcccatcgacggcgaaccgccgagaactcgtgcgcgtacctcctcgaccatctccaccgcggtgccacggtcctcgacgtgggatgcggcccgggcaccatcaccgtcgacctcgcacggatcgtggcaccaggcacggtcgtcgcgctcgacgccgagatcggcatgctccaagcaacggcggcgctcgccgcagagcgtcagctggacaacgtgaccgtggtcctcgctgacgcgatggccttgccctggcccgacgccaccttcgacatcgtccatctccaccaagtgctccagcacgtccccgatccacgcgcgctcctgcgagagtgtcgacgcgtgtgccgaccaggaggcatcgtcgcggcccgagacgccgactacgcgggcttcctctggagtccgctcgatccggacctcgaccggtggcagacgctctacgagcaggtagcccgtgccttggggggcgagccggacgccgggcgttacctgctcgaatgggccagcgacgcgggctttcgcgaggtcatcgcatcggcaagcacatgggtgttcgcaacctccgccgaacgggcctggtggggagagtcctgggcgagacgggccctgcagtcgggttttgcgacgacggctctcgccacgcaactcgcccatcgcgacgagctcgacgccatcagccgggcctggttgcgctgggcacacgcgcccactgggtggctcctcgtgcctcacggcgaaatcctcgcgcggcggtgagctcgacgatgagctcgacgcggtgtgcgacgaacgcccttggcggcatcgcgtcgaccggcccccgagaggaagtccacccgtaccctcggcctgacgtcctcgcgtgagcgctcgcaagtcctgtggggaaccacacgagcgcgtcgagagtccgagccctggccgaggccgtgcggctgcgctgttcgcaagtatgtacgccgatcagatcactgcggcgtacgtccctccgcgggcctggctgcgaccacgtcgtagtctccgcgaatgacgaagaacgagccgcggatggtgcctgccaaccgcgaacgctgcctcgcaaacttgaagcgctcctcgagctcgcccggaacgggaactccgtcggccagtttgaagccgaccgcgcgcttgccacctggcgcgagcgtgtagaggacgttgacggccacgccgttgtcgtagaacacgtgcgtccagtcgatgccgtccacgacgaagtgagcgacctccaagggcgtcgcctggatctcgagatcgcgctcgtgccgcaggaggcgtgccacccactcgacgatctctggcgcttcgtcggccgactcgacctcgaacgcgtgaccgtagtgggtcgagaagtaacgcgcctcgttcgcccgcaagccagcaagcgcctccgcatacggcgacgcctcgagtccgtccgtactcacagcgtgaaagtcgacgatccgacccattgcgacctccgtcctcatcgaggctgtccgaccgccgttcgaccgggagcagccagcaagcgccatcgactccgcgtgccactcgagacgaccatcgacgagggagctgcatcggcgcctcccggcgccggagccttgccccgacttcgcctcaccggcgacgagcgctcgcgcgcaccgagcagactactcccgaaccggcacacgggcctcggcgaggcgccatcgcctcgagaggcccggcgcatggacgactcgtgccctccgagagttgcacggctacacccatgctccggcaccttcgtaccgctgcggttccaccaccgctgccatgggccactcaggctgcacctcacgaggcgatcggcgtgcgagcaccagccggtccgagcgcactctcgtctgtgaccgagcgcgacgccgcgggtgctcgccagcaccgctcgcccgcgcaccaccggatcgcacagcgtcagatcgcaagaagcgcatcacgcgccaacgatcgtgccaccgaagccgtagccaaagccgctggagccgtagccgctgtagccgtagccaaagccgaatccgccgaaaccgggggcctggaacccgaatccgttaccggcaaacggggctgtcgcggcactccctgagcccaggccgctcgtcgcgtcgtactgggtggtgaccgtgacggaatcgctcgagggcgacaccgtcggagccgcgatggtcactccctgttggtcgaccatcgaaatggcctggagcgtcccgctcggcagctcagccaacggtgcaccgttcgcctcgacgtggcgcatcacggtcgtcgagacgggggcaaggttcatgatccctgcctggctggtgggtgcctcggtgatccactcggccgaggtctcgacacctgaggccgccgacggcgagagcgtcacgacggtatcgaccgccggcgacgatgaccctgccacggtgagttcgagtcgccaccggtcggtcccgacgggtgtgatcgccgccatgacggtggcgccggtgggaatcgtgattgtgtcgaccgcggcgttcggtagctgctcgaagaacgccaccgtctgggcctcgcccttgggcccaggctcagtgagcgtaccgacctggatcaactggtgtgaccgcatcccgcccagcccgacccactctccgatcgcgctgttcgcagagacgtcagcctgtgtgaacgacggggccgtccagctcgcccggacacttcgctccgcgcttccgagcgcggcgagccccgaccagttctcggacgcgctcgttgcgctcacgagcgaggtcgatgccgagccggacccgctcgatgtcgaacgcggcgagttcgtcgcgaccgaccctggggccgggttcgtgacgacggtggagctcgggtgggtatcgagcccacttgatgctccggccgcgtggcccgcccacgcgaacaccgcaaccgccatcgacacaccgagggctccggcggtcatgctcctccgtacgtttcgagcagttcgcatggtacgtgatctatgcacggtgtcctacctgaccaagaaacccgcctgagaagcttctgggctacgctggcacctcacagagcgctcagcgatcgcacggggcgccctcagtgtggatgtcgcgcgcgccccacccgtccggggtgagtctcgggcaacgtgagggccatcacgacgccccagacgacgaggagcgctgcacccgcatccacggcagcgcggagcccgagcgcttgggcgaccacacccaacacgagcggaccaaccgcgtagcccccgtcacgccagagccgatagaccccgagtgcaccgccccgccagcgcgggtccgcgcgatcgccgacgatggcgatcaggttcggataagcaagtgccatcccgacgcccgtcacgatcgccgcggctaccgcagtgaacggacgatgcgcgagagcctcgaaccccagcccagcgccgatgacgatgatcccaccgacgaccggccagcgccgaccgatcgtgtcggccagaagaccggtggggatctggagaagcccccagacccacagatagacacccacgatcaggccgatcaacgccaccgaatccccctcgtgtaggagcaacagcggcacgaaggctgccatgagcgaatcagcgaacttggtcagcatgcctgcaaccgagaccaccccgagcgcccgatcccgccagctcacgagccatgcaagatggagcagcgacgggccgggtcgcgccgactcacctacgctccccccatctgccgacgcctcgacgagagcatgccctctcgtctcgctcgcaggccacacgctcgccatgcctcctaccaccacgaccacgagcgcgaggatccacggcgccacactgcggccgccttcacccagcagcaatccagcaccaaggccgccaagcccgacaccgacgtagccagcagcctcgtcaattcccaccgcgagcgctcgacgagtcggtccgacgaggtcgatcttcgcggtcaccgccatggtccacgtcagagcctggttgataccgagcaccgcattcgccgcgagcacctcccaccacgcgtgcgccacgaggatgccaacggcatagggaacgccgaagagccaaccgatgcgcaggatggtccgccgcccatggtgatccgacagatgacctgcgacgaggttcccgatcgccttcgtgacgccgaacgggacgaggaagctcactgtcagcagcaccgaccgcacgccgaagacggccgacgcaagaggaggcagcgccactcgttccacgccgatggtcgcgccaaccatgacggtgatgaacgtgtacacgccaaactgccgccaattggccccgagcccgagtctcggagtagcagaaccgcccatgcgcctcattcctacattcaaaccaatgtaagaatgagactagccctcggccacctccgttgagcccgactcgaccgctcgaccgtccacgagccacccgaggaagccgtcctcgagccgtcgcgcctcgatcccacggtctcgcagccaccgcaccgcgatggatgcgtacgcacaccacggaccacggcagtagacgatcacctcggaaccgggtgcgagccgcgtcggcacctctcggagcgcgacgagtggggccggcacggctcctggcagatgcgccgcacgccactcctcctccggccgtacatccagcacgaccaacgacccgtcagccatgcgatcgatgacgtcggctgcacgcagacctgcgagctcctcaggtccgagatacgcagccgcgagcgcctcgacgtcgcgatcgagctgtgcgctcacacgtgtcagctgcaaccacagctcggcgacctcgcgtgaacgcaggcggtagtacacgcgtgcgccctcgcgccgagtcgcgacgagatgagcgatcgccaggcgacgcaggtggtgcgaggcactctgcacgctctggtgcgtctcgcgagcgacctcttccacactgcgctcgccctgggccagcaggtcgatgatctcaaggcgccgcccggatcccagcgccgtcgcaacctcggcggcccggtcgaagagcgcaaccttgacagcatggtcgctctcgagaggggcgtcgctcacgtcgctccaggtccgctcgtggcactgcgccactcgtaccccacgcccggcaccgaccgcaacgcgccctgggccgggccgagcttggcgcgtatgcgcgataccaccacccgcaggtgatgggggtcgtcatagccgggaccccagattgtctcgagcgccatgcgatgggtcaccacacgtccttcgtgctcaacaaggtagcgcacgagatcgaactcgcgtctcgacagcgacaccggaccacgctcgtcgtcgacgacgagacgccgcgcagcgtcgagcgtcagtcgatcactgatgcgctgcctggtcgcaacgacgtgacccgacccctcgaggcgccgctcgagtgcacgcagacgagcttggagctcgagaatgccgaagggcttcgtgacgtagtcatctgcaccgttgtcgagcgcagcgaccttgatgcgctcgtcatgggcggcggagagcacgagaacaccgccgcgatggaactcgcgaagccgcgcgacgagtgccaccccatccatgtccggaagaccgaggtcgacgaggatgacctccggcggatccgcaaccgctcgctggagaccttcgatgcctcgaagtgccgactggacctcgtagccggctgcgtgcagcccaatcgcgagcacgcgcgcaagggcagggtcgtcgtcgatgatcaggatcgaactcacaccaacctcggcaacacgacgcgcacactggtagcgtccggttcggattcgaactcgacgcgtccaccgtgcgcttcgacaaagctgcgtgcgatggcgagcccgaggcccgtgcgacccgagacgcccgaggcgtggaaccagtcgaacaagcctctcgggtcgacatcgccactcataggggcgtggtcgacgacctcaatgagcgcatcgccactttgctccagaactcgcacctccacgacatcgccgaggggtccgtgccgaaccgcgttgtccacgaggttccagacgacctcgcgcagcagggaggcgtccccgagtaccttcaccggcccgtcggcgagcacgcaaacctcagacccgaacccacgtacctcgaccgctcgaaccgcatcgtggaccacctccccaagttcgcacaccacccgccggacccgccgcacgcctgcctcgagtcgactcacgtccagcagatcttcgaccagcgtgctcgctcgccggcactgtgcgagcgccgtctcgaggagctcgtcgtggtcgctcggcgcgatagccgccccgaaggcagccaccgtgctcacggccgtttcgatgctcgcgagcggtgtcaagagatcgtgcgacaccgtccgaaggagtgacagacgccagccgtcgacctgctcgagcgtggcgaggcgtacttcggcctggcgaagccggtcgcgctcgagcgccgccgagagctggtgtgcgacgacctcgagcgcaccgacggtcgcctcgtcgaggcgtggaccccacacaaccagggttccctcgggcccacccaacgtgctcacgatggaaccgcgggcctcgaacccacgctcgcgcagcacgatcgagccccgacccgttgcatccgaggagaaggctcgttgcacacgagcagcgtgctcggcattcgaacccgaccagatcagctcccctgcgccatcggctcgaacgagagccgcgccacctggaccgttgacgcgagccagcgcctcgacggccgcacccacgaggccggccgcgttctgcgcaccgaggagacgctcaggaaggtcggcgagcgcgccgaggatgcgagcctgacggagcgcccgatcgcggcttcgccggaaccgctcatccagcgtgatcgcgattgcgcccaccaccacgtagataccgagggggatccaattgacgccgcgacccaccgcgagggttccatagggagggatgaagaacacgtcgtaggcgatgaacccggcggcgaccgcggcgacacccgcgaccgccccaccgatcgcgacgctcgccactaccgggaccaccagcaccaacgccaccgtcgctggcggcacgaccgcacgcaccggaacgagcgcgacgacacccagtgcgaccgtcacgacaccaacggccgcgcccggatagcgcagcatccggcggctcgtgctgaggagtgacatgcgtctacgatcctaccgatggatgcgatcgacacggaggacgccgaccagcttgtcgccacgcccgaagtcgaacccgtcggccgcttccgtatctacctcggtgccatgcctggcgtgggcaagacgtgcgccatgctcgacgaaggcttccgacggttccaccggggcgcggacgtcgtggttggctttgtggagacccacggccgtgactacaccgcctcgctcgttcgagacctccccgtccttgcccgacgacgtgggacctaccgcgggcgcccggcagaggagttcgatctcgaggccgccctcgcgcgcaaacccgaggtcatcctcgtcgacgagctcgctcacaccaacgtgcccggactcggcgcccacgccaaacgctacgaggatgtcgcgacgctcctcgaagccggtatctccgtcatcaccacactgaacgtccagcacatcgagagcgtcgccgccctcgtcgaggacctcctcggcgtgcccgttcgcgagcgcgtccccgatgcggtggttcgagccgccgatcagatcgagctcatcgattcctcgccacaagcgctcaggcgccgcctcctccatggccacgtctacccgcccgatcgcatcgagtgggcactcgagcactacttcaccacccgcaacctcaccgtgctccgagagctcgccctgcgcttcgtcgccgactcgcaggtcccgaccccaacactcgcggtcgcatcccgggctcgttggcaggcgatcctcgagaccaaggagcgctacctcgccggcgtcacgctctccgcggcgtcgccacgcgtgctgcgacgcgcagcccgcatggcgctccgcagccacgctgacctctatgcgctgttcgtacaccccgacgagtacgatcccacgcgcgatgcgcctcgcctcgacgcgctccgcacgctcgccgccgacctcggcgcgatcctcatcgaacgtgacggctccgacatcgcgacgctcctcgtcgacgaggcccgcgctcgccaagtcacccagatcgtggtcggcgcctcgaggcgccggcgcatcgacgagatcctccacggctccgtgctgaaccgactgctgcgactcgccggaccggtcgggatcgacgtccacgtcatcggcgttcgcgactacgacccgagtccggatgagttcaacggctgatcgccgccttgcgctcgagacgcgcgagcgccatgttgagcgcaaggacatccaccacccgctcaccaaggaacccgaactctggaccagtcgccgtcagagcaaccaagcggcgcagctcgctggccggaactccggtcgcgcggtgcaccatgggcacctgcgccagtgcactcgcgaccgagatctgcggatcgaccccgctgcccgaggtggtgacgagctcctccgtcggcaccaccccttctgcccgccagtacgcaacgagccgtcgcgtcgcactgaccaaggcggccgagcgcggaccgaggttcgtgccgccggtggccatgggatcgtcgccatcgggacgcccatggaaccagcgcgcaccccgccaggtctggccgacgagcgtcgagccgtcgggtgtcaatgacccctcggcctggcgaggaaagaccgtctgggcgatcgcgacctcgatgagcgggtacgcgagaccacacagcacgaggaagaccaccgcggcgcgcaccgagcgcaggagcgtccggatcatgagaacgccctcgtcgcggcgagcacaaggtcgatcagcttgatgccgatgaagggcacgatcacgcctccgatcccatagatgaacacgttgcgccgaatgatcgacctcgccgacgacggtcgaaagcgcacccctcgcagggccagcggaatgagcgccacgatgacgagcgcgttgaagatcacggcagacaggatcgcactctccggcgagtgtaggtgcatgatgttgaggaccgagagacccggataggccgtgacgaagagcgccggaatgatcgcgaagtacttggccagatcgttcgcgatcgagaaggtcgtcagcgcaccgcgggtgatgaggatctgcttgcccacctcgacgatgtcgatgagcttggtcgggctcgagtcgaggtcgatcatgttggcggcctccttcgcagccaccgtgccggagttcatcgcgacgcccacgtcggcttgtgccagggccggggcgtcgttggtcccgtcacccgtcatggcgacgagcttgccgtccgcctgttcctcgcggatgagctcaagtttgcgctcgggtgtggcctcggccaagaaatcatccacacccgcctcggccgcgatcgccgaggcggtgagcggattgtcacccgtgatcatcaccgtacggatacccatcgcgcgcagctgttcgaagcgctcacgaatcccggccttgaccacgtcgcgcaactcgatcagcccgagcacgcgatcgccagctgcgacggcgagcggcgttgctccctcgcgcgcgatcgacgccgacagctcatcgagttcgactgggatcacgccaccctgttgacggacccattccttgaccgcctcggtcgcacccttgcgtatcgagccctcgtcggtgtcgacgcccgacatgcgcgtggtcgccgtgaacggcacgaaccgcagcgacgccgggtcgacgggatcacgaagaccgtaggcgtccttggcgagcttgacgatggagcgaccctccggggtctcgtcggcgagtgacgccaggcgccctgcggcagcgacgtcgccatcggccacaccgccgatcccgatgaaccgtgacgccatgcgattgccaaaggtgatggttccggtcttgtcgagcagcagcgtcgagacatcgccagcggcctctacggcacgacccgacatcgcgagcacgttgcgctggaccatccggtccatgccagcgatcccgatcgccgacaggagagcgccgatggtggtcgggatcaagcacacgagcagcgccacgagatcgacgatcgggatgccgacgtgcgcatagtgggcatagggctcgaggacgaccacgaccggcacgaagatcaccgtgagggcgacgagcaagatcgagagcgctacctcgttgggcgttcgtcgtcgatcggcaccctcgacgagggcaatcatgcgatcgaggaagctctccccagcacccgcggtgacccgaacgacgatgcggtctgagagcacgcgtgtgccaccggtgacggacgatcggtcaccacccgcttctcgaatgacgggtgcagactcgccggtgatggccgactcatccaccgaggcgacaccctcggtgatctcgccatcggcagggatgacgtcaccagcctcgcagaccacgagttggcccgcgacgagctgcgtcgccggcacccgctcctcggttccgtcgtcacgcagacgacgagcttcggtctgcgtacgggtgcggcgcagggcgtctgcttgcgccttgccccgcccctccgccatcgcctcggcgaagttggcgaagagcacggtgaaggcgagccacaccgtcaccagccacgagaacagcgatggatgcacgatggaggcgatcgccgtcacgatggtgccgaggtagacgacgaacatgacgggattgcgcacttgcacacggggatcgagcttcgtcagcgacccccgcagggcgacgcgtagaatcgtgcggtcggtcagcgagcgcgaactggcgaccccacgtacgggcgtggcggatggacgagtgggtgcggtcatgcgaagaacctcccatgggcgacggcctcggcgatcggaccgagcgacagagctgggaagaagttgagggcaccgacgaggatgatgacgccgatcaacagccccgcgaacatcggcgtcgctgtgtcgaacgtgccggcggtggcaggcaccggttccttggcggcgaggcttccggcgagtgccaggaccggcaccatgacaccgaagcgacccagcagcatgacgatcccaccgacgatgttgtagaaatcggtgttcgacgagagcccggcgaacgccgatccgttgttgttgccttgggacagcatggcgtagaacacctccgagaagccgtgcggccccgcgttcaagatcgcggcgcgcgcgctcgggagcgcgatcgcaaccccggtagcaacgagcaccgtgatcggcatgaccaacacacccaccgaggcccagatgatctccgtgcgctgaatcttcttccccagatactccggtgtgcgcccgaccatgagccccgcaatgaacacggtgacgatcgcgaagatcaacatggtgtagagaccgctccccacccctccaggtgtgatgtccccgaaagccatgccggccatcatggcgaggccgccgatgggggtataggagtccatcgaggagttgaccgatcctgtcgacgtctgcgtcgagacgatgttgtagagcgtggagttgtcgatgccaaagcgcgactccttcccgacgaggttgccacggctggccagcgccccggcagcatgctggatcgcggggttcggctggtgttcggcaacgagcgcgaccgcgagggtcacgccaaagatgatccccatcgcagcgaggaccgcaaccccatcgcggacgctcgccaccatgcggccgaaggtgtaggtcagggccaccgggatggcgaggatgaggtagatcgagaggacattcgtgaggcccgtcggattctcgaaggggtcagcaccgttggcgttgaagtagccgccgccgttggtgccgagctgcttgatcacctcctgagaggcaaccgggccacgggggatgacctggtggaccccgttcagggcgtcgacgacgtgcacggggccacccagcgtctcgagagcaccctgccacacgaagaccaccgccatcaccagcgagatcggtagcaagatccacaacacgccgcggacggtatcgacccagaagttgccgatggtggcgcgcccccgccgagcgataccgcgcacgagcgcgatcgcgacggcgatcccgacggcagccgaaacgaagttctgcaccgcgagggccgccatctgcgagaagtacgacatcgtggtctcgccggcgtagttctgccagttcgtattggtcacgaacgagaccgcagtgttgaaggcgagagcaggcggcacgccaacgaggtgctgcgggtcgagtggcaagtgcgcttgggagacgatgatcaggtaggtgacgacgatcgagacaccggagaagacgaggagggagcgcgcatagcgttgccacgactgctcctcgctcgcgctcacgccgacgagcgcgagcacgggccgctcgagtcgaaccaagaggctgtagcggccctcgtacaccccggccatgtacgcgccgagcacgcgccaggtcaccgccaaggccacggcgagcacgatgagctcggtcgcgaacgtcatggacgacacaccacctgttgcatgagtccagcctcgcgccgcgacacgcggagccgacacacaaccggcgatctgtgacgctcctgagacgcgcgaccgcccctgccgtgacaccgccgtgacggcgtgatggtggccccgacctgtagccttgtccccatggttgatcgctcaccgcgaacccgactgcgtcgcttcggcatcgcttcggtcggcgcactgatggtcgagctcgccttcggcctcgcaaccaacgcactcgtgcacatccctgtgcacgacccctggggcggagcgcacccaggctgggtgctctacgtccacgccgcgatcggcttcgcgctcctcgtgaacggcgcgatggtcgtcaacaccgccatcgactccggcgtcccccacgccctcggtgccgcagtcgtcggcgtgctctcgatcatcgccgcaatcggcgccggcatcgccttcgtcaacaccggtgcccagcaccagatcctctctgtggcgatggcgctcgcgttcgtcgttgcgctcgcggcctacatcgccctctggcaagctgcccgacggacccgcgtcgcctagtcgctgacctccgacccgggcatcgggacgtccaaggcgcgcgggaggatcctcccaaggaccggcacctggacgacggcgagcccgacggcgagcccgagcacgccgaggatccaggtgaatagcggcgcgagcgcaatgacggttgcagcgagtggcgatgcgaggaccgcggtcgtcgaccagagcgaccctgagagcgcgttcgcccgagctcgctcctcgtcgctcgccaaggcgttgacgagggcgggcgcgaccggcgagtagagcgtctcgccgacggcaaacacacccatcgccacgatgagacagagcgctgcgaagccgcgatcggcgcgacctgccagcgcaaccgcagcgatcgcccagctcgctgcccatgcgatggtcgccgcgagcagctgtcgtgaacggcgccaccgcctcgtggcacgactgacggggacctggagcaccacgatgacgatcgtgttgaccgtcagcgcgaatccgagaatcgccggtcgtgcaccgacttgcacgacgacgaaggccccccaccccccatcgagttcggcatagcccgcaaggaggagcccgatctcgatgagcagaaaccaacgcagcgcgacgttgctccgcaacagggcaaggtagccccctcgctgacgcgcgtgcctcgagcctgtacggggcacccgcggcgcaatccgcaccgcgacgagcaccgccgccaccgcctcgacaccagcggcgatcaaccacaagacctggtagtgcacgagctggcctcgcccgagatacaggcccccgagcgccgacgcaaggccgataccagcgttggtggcgaggaagagccgcgcgaagacgtggtcgagcgtacgtcctgcgaccagcgagccgacgatggtctgaccggccacccagaacaccgcctgcgagaggtacgacaccaacacggcgacaaaggcgatccagtgacggtcggcgacggccatcgcaccgtagccgagcgcccccgcgccgatcgcgatcgtgagggccgatccgagccgcagtcgatgccccagcagaccgagcgccatcgacacggcgagtccacagatcgaaccggcggcgagcaacccaccgacctccaccagcggcacgcctcgggcaaggtgcaggtaggccacgatgtagggcatgccgagaccggagccggctgcggccagtccgttcacgacgtagagcgtgccaagcggcgcaccggcttctcgggagatcggcacgccacaaccctagggccgacgagccttggaccgaggctgtccatacgagcgaccgaagttgggtaccgactcgtccagctgcgaccagctcgcaataagatggcccccgtcacggttgacatcactgcacgctgaccaactctcgaccgccgaaggagcagccgcatggcgacatcgacacccccgacgcacggccgactcgcaccggtcttccatctcttcgacctcttcccgctctcggtctcgagcgtggggccggtcttctcggtcgccgcgaccggtggcgtcatggccgcctatgccgggtggtgggcccttcccgccatcgccctcctcgccacgccgttcgtggtggcgtccttcgtcttccgcctgctcaatcgccactttccgcacgcgggggcctcgtaccactggtccgcacgggtgctcggccgctccttctcccgctaccaagcctgggtcctcattctcgcgtacttcttgtcgatcccacccatcgcgatcccggcgggctcctataccctcgccctcatcgacccgggccacaccccttccaatctcgccctcatggccgtgaccctcggctggatcctctttgccgcgatcccgctccttgctggcgcacgcccgaccgctcagatcaccaaggtcttcatggtcatcgagatggtgtcgctggcactcatcggcatcgtcggggtcgcgcgctttggcgcgacccacgtcccgatccacttcggccggccaccgatcggtgggatgctcatcgtcgccgtcgtcgcggctacggtactcgacggctgggagatcgattcctacgcagccgaggagtcgcacaagccccgatccgaaccggggatcagcggcatcatcggcgcgttcctcgcgctcgtgttctacgcgatcctctatccgttggtctttgccgaaaccccgatgcgactgctcgcgtcgccgcgtgacgccgatccgatcgccctgtgggcacagcgggttctcccggccggcctccactggaccgtgctcattcccatcctcggctcgacggccggtggactgtggctgaccacttacatcttgacccgagccctctatgcgatgggccgcgaacgcctcgtcccgcaggcctttgcccgaaccagccgacggcgcgtccctcacgtcgccaccatcgtcgtgctggggctcgtcgtcgtggtcgtcgccgtgcagaccttcgtctcctcgctgtcgagcttcttcgccctcgtcctgtcggcggcaggattcttcctcctcgccgagttcctctccgacacggtcaccgcgatcgtcttcctcacacgtgcccatcggcgtcttggcatcgaggacgaccatcaccatccggtgctgctcgggctcgccatcgtgtcggcgctcatgatggccggattgctcgtcgccttcttcgtctatggtccgagcgcgatcggcagcgggatcgaccaggtcacggccgtgctcctcgggcttggcatcgtatttgtggtgcttacacggcgtcgaacgaccgcccccgtcgtcttcgtgccagagggcgcggacgactgaggtcacccgcggcgcacccgcaccgccttcctagggcaccacgacgagccggaccgacccgacgccctcgatgatcccctcccagtgacccggcacgagcggcaccatcggcgtcaaggtgccggcgagcacccactcaccgggctcgagggaaccaccgtggcgggctacggcaccggtcaaccacgcaaacgagcgccgcggatcgccgagcaccgcctcggacccgccccggaccacctccgtaccgtcgcgcgtggcgatcgcgaccaggcgatcgaacgggatgccgtcgcggctcgccacgcggtcgccgaggacccacaggccggctcccgcacgatcggcaatgaggcttctgccccgcaccggccaaccgacgatccgcgagtcgggaatctcgaaagcaaccgccagctcgtcgacgacgtcgtcgacttcgtcaggctcgagaatcccctggatgcgctcggccacacgcagggccacctcgacttcgagccgcggatcgacgagccgcgcgagcgacaggtcgctacctgacccgatgcggtcatgctcggcgagtggtccgaagatcggctcctcgagccccatgcgacgccgagccgcttcgtcagtgaggcccactttccaccccgaacgcacggccccatgggcgtcgcgccgtgcccacaggcgcgcttgcacctcgtaggcgtcctcgagcgacaacgttccgaggtctgactcctcgacttccgacgcctcgagcagctcggcgaccgcctcgaggcgatcgccacgagaccggacttgcgcacgctcacgctcgaccatggcacgagtgtaggtcgcctcgcgtgcagaggactcgagccgccggccctccttgggtggcccaatcgtcgaccaccggtcaggtcgcttgcgatctggacgtgctcgccgaacgtggggcttcgtcagctcgcagcaccggcacgtacgagctccgcgagcacgcggagcgcgtcgcggggaccgctctggcgaccgagtctgagcacccgacgcggcgacaggacgtaacggcccgacgggagcggctcgccaagcaagatcgaccgagccgcaacgctcgcaagcgcaccgccagcggcggctgtcgagccaagctgcacgaagcccccgagttcggtgccgacagcgttggccgatcggatcaatcggacgctcaggttccgaacaccgacgatgcgcaccagagctcgtcgctcctcggcccgtgggagcgagcccttgagcagtcggtcgagggtcttccgggacagccgcccgttgaacggcacggtcggcccgagatcgtaacgctcgacgtcgaggacggaacgttccccgaaatcgccgaccgtcatcagcgcgacctgagccgaggccgcccatcgccgaagtcgggcctttgcgaccacgtcatcgacctcctcgatgacgagatctggacgaaaggcctccagcatggcgtcggccgcctcgtcgtagccgccacgaagatgcacctgctcgatgtagggatcgacctcgctcacgaactgcgcgatgaggtcgagcttggccatgcccacgtgtcgcatcgagccgcgaatgcggttgagattcgtcagcgtcactcggtccatgtcgccgaggagcagcgcagcgccgatgccaacgcgtaccaactgttcgacgatgacgctcccgacgctcaggccgaagacggcgatacgcgcacgctcgagccgtcgttgctcgtgggcctcgatcaggtatcgattccgtgcactgcgcagtgcccgcagatcctcgacactcggatagcgcacgagctcacacgaccacgggaagtagaaccacgtgccgtagcaatccggatccccaccgacacctgcgcgcgctgtaatctctgcacgagactcggatcggcccctcgggttctcgaactcgtcgagctcctccagcaactcgccgaccgcatcgacggtcctgtggatgcagacctgctcgcgaaggtcggcgagccgacgacgatcctcctcatcgtccgcgacgaatcgggctggaggcgcccacggccgccgaccgttcacgccctcgccacacgtcgccatagtgatcagccccctcctcagcccgcacgagcacccgacgctcatgcaacctcggacgccgaggtggtgcaaccataccacggtgcactccgaccacgcaggtgcgtcgatcgatccagcagaccaagcgagcccacatggtcctggccggtccccctgaaacgaggccacccgctctgtgagaaccgcgacccgaatggacgagcgagaaggagtgtgtatgaagcgcaggaagcgccacaccccggagcagatcctccggaggctggccgagggggacgagatgctcaacacgggcgccacggtcgctgaagcgccccggatttcgtgcgcacccccgtaggtgggaccgattcggactcggccgccatagtcctcctgctcgacctcgactggcaaacgacgtcccagccgctgcatgagccttgcgcgtgtcgtagcagcgcacccggaccgaggtcacctcctcgcaatccgtgaggctcgccagaggcccgctcaaccatcgctacttggatccaccgctacaacactgtcgggctgtacccgagcctcgagtagcgactatcgatcgaggaggagctcttctgggcccgggaggagaaggccgtggcccacctgcagcccgtcgagcaagcggcgcgagtccaccgctgtcaaccttgagaggagagccaacgacagacagcgccccacggtctcgcaccgagcgcacgatcgacgaggagatccctctccagctcgtggacgcgcgtctcgcgtcggtcgtcgatctcgctcgccaccactcgtggtatccagggtcgtgcgtgtcgcgatggggaacgctctcgcgtcgacgccgacaccgcaccgcttcgacttgacatcaggtcgcacaagcgaagcgatgggacacgtatgccagcgacggccttgcgtgcggcggtcggcgttgcgtgcggcggtcggccttcgtcacacggtgcccccggcaggattcgaacctgcgcacatggtttaggaaaccactgctctctcccctgagctacgggggctgaaccggcacccactatggtagctgccgcccatcgctacgaccgagaccagcctgcacgggaatgcacgtccgaccgtcggccttggcatcggtggggagatggggaggttccatggaagacgtcgtcgctgaaccggtgatcgcgcgcctcgtacgactcacgccggccgtgcgtgcgcgcctccgcgcgatgctcccggcgagtgcggtcgacgacgtcatccaagacacgctcgcggcggccgtcgcacaccacgacgagctcgagggcacggacggacgcctgctgggttggttgctcgtcgttgctcgtcatcgcgccatcgactggctccgtcgccaccgcgggccactcgatattcgaaccctcctcgtcgacgacgccgacacaccggatccggcgagcgccgtcgtcgaccgcgtcgtcctcgaggccgcgctgtcgctcctccctcagcaccagcgcgacgtcgtcgtcgcggtctgcgtccatggcgccccgatcacacgagtcgccgacgacctcggcgtccccgcggggaccatccggtcgcgtctgcactatggacttgcggcacttcgatcgcacctggaggccaaccgtgccatcccatgacgatgggtgcacgctccgcgaggcgtacctgctccacgagctcacgcctgacgaggtcactcgcttcgaggggcacctcgcttcctgcaggtcgtgccaggaccgcctgagcgacaccgcgcagttgctcagagcgctcgcagacctcgaaccacccgacgaaccggtgaccgggtcccaggtggcgcccatggcgcacgaccctcgcccagctcgcgtcgccggccacagtcatcggcgccgtcggggggcgctcatcggattggccggcctggtcgtcggcgcgtcgctcaccttcgcgctcgagcatcccgccgagcagaccccgtccgcggccgaggtgatcacccttgccgctcccccgatccacggcacgctcgtcgtcgaccgccgtgcatggggatcatcgatcaccctgacagcaaccggcctaccgtcgacgggccaggtctcactcgtcgtccgctcgaccggtggacaggtggtggacgcagcgtggcgtgcgatcggaccccagaggatcaacgtccaggcgccgaccccattccaaccgagcgccatcgcagccacgacgctcgtggcccacggccgccacacgaccgtgctctggagctggcaccgactcggcacagaaccggggaccacctagacgcgcgcacacgacgagtgcacgtttgcaatcatgcggcctacgaacggctacactctgctatccgtatgggcaacacgcctgcccatgcaaggaggcacggatgctggtcgtcgcccgccacgctcccgcaacccgaccccggccgggcatggccgatctcgagcgctcgctcaccgaggagggactcgtcaaggcacaagcactctcggtcgagctggtccggctcgcaccgacccatctcgtctcgagcccggcacgccgctgcatcgagaccttggcgccgctcgcgaaggcactcgatctcgagatcatcaccgatgatggccttgggcccagtgcgaaggctccacagatcgccatgagcctcgcctacctcggagcgctcgacggtgtcaccgtcgtcgccacgcacgcgccccagctcgaagtcctcctcgagcagttgctcgccgatcacggcatctccgtggacgccgacgcactccatctcccaccggccggctacgtgatcgtcgatgtcgccgaaggcgtgcgtccccctcgcatcgaccgcgtccgcgcctaccgcgacgtgggaacggacccgctcctcctggtcggctagcgtagccccgtggacagagcgctcggggtcagcgagctgatcgggcgcgtcaacgacgccttgggttcgctcggcctcgtcaccgtgcgcggcgtcgtcgagtcggccaaggcctcccaacgcggtcacctgtacttcgatctgatcgacgacggcgaccgccaagcccgcgtgagcgcagccatctgggcgtcgcgccgtgccggcatcgagacggcgttgcgccgcgctggactcggctcgctcggcgacggcgcgctcgtcgtggtctcgggacggctccaggtctacgctccgcgcggctcgatgtcgctcagcatcgaccgcgtcgagatcgaggcgatgctggatgctcgcgccgcaacccgccaacgccacctacgccaactggccgccgaaggcatcgtggacgccaaccgacgcgtgccggtccccgccgtcgcgctccgcatcgcgctcgtcgcctcgcgtgatggcgtggtgcgtgaggacgtgcgacgcgcgctcgccgacacgggcttcgcgttcaccgtcaggttgtaccacaccgaggtatccacccgcgcagcgagcgtccagatccgccgcgcactcgcggccgcgatcgccgaccagcccgacctcgtcctcgtcgcccgtggcggcggttcggagggagacctcgccgccttcgacgatctcgaccttgcccgagcggtcgccacggcaccggtgccgatctgggtcgccatcggccacgccgtcgatcagccgctccttgcctacgtcgccaactgcgccttcgacgtgccacagagcgccgccaaggccctcgtcgcccgggtcgaggactttcgcgagggccttgccaccgagatcgcaaccgcgatccatcacgctcgggcacggctcgatcgcggctggctccacacgcgccagatcgcccacgccatcgaagcacactcgcaacgacgtcttgcggccgcacaccgcagcctgccgagcccgtccgtcctcgacgctcgcaccgaccagcgcctcacgaacgagcgccacacgctcccggcgacctccgtcatcgacgctcgagtccgggcgcggctcgctcgcagtcgcgcggtgctcacagcagcgcgatcggcccgcgacatcgtccgcctccgcgtacgcctcgaagtccgccagctcgtcgaccaccgccgtgagctcgccgcggcgacgtcggccatcgccaccgctcaccgcactgagcttcacgcgcggcaacgacgcctcacgcgcgccgcggcacgccggcgagcacaccacgatgccgctctcgccgccgtgcgtcggcacctcaccgccgcgtcgtaccggcgagctcgccgggatcgacgcggcctcgagttgctcgcacgccgcatcgaggggctcgcctcaccgctcgagcgcggcttcgccatgatcaccgatccgacgggcacctggcttcgccgcgcggacgccatcgcaacccacgcaatcgtgcacgcccacttcgtcgacggcgtcgccgcgctgaccccagctcgacgatctccgaccacgacgcatccccacctgaccacgcgccaaggaggacgacccaatgacgactgacccggccgatgttcgctggctcatcgacctcgacgaggacgccttcgcgcgagccatcgagcaacgctccttcgaggatcttcgcgacacggcactcgcactcaccgaactcatcgactccgacgccatcggcgtcgatgacctcgcgaccgtggtacggcgtgcgagggccatcctcgacgcgtgcgatctgcgtctgcggcgcgtggagaacgaactcgaccacgacggcaccgccgtcgaggaagcctcggccgaggtcgaggagccgttctagagctctgccgcgagcgcgtcgagggcatcggcgagtccctcgacgatgaccccgatctctgcgggctcgatgatcagcggcggagacagagcgatcgaggtcgccagcacgcgcacgatgatgccacgctcgagcgccaggcgcgcgagtcgagcgagggcgtcggggtgttcggcgagcaggtcggaacgcagctcgacggccccgagcagccctaggccaccgcgcacctcggcgaccaacgcagaggaggccagcggtcgaagccgagccagcagctcgccttcgagcaccgcccctcgtgcgaggatctgctcgtcctcgagaatgcggcagttcgcgatgcccgccgcagtgcaggtcggatgacccccgtaggtcggcccgtgccgaaagaccggggctcctggttgcttgaacggagccgccacacggcccgacaccatgaccccaccgagcgggagatagccgctcgtgacccccttggcgaaggtgatcagatccggctcgacgccgagacgctcgatcccgaaccaggtgccgagtcgaccgaacccgcagatcacggagtcgacgatgaggagcacaccgtgtcgccggcaggtcgctcctagcgcctcgaagtagccgggaggcggtggatagacgccgccagcaccgatgacgggctcggcgatgaccgcggcgacccgctcagggccattggcgacgatggcggcctcgacggcctcgacgtcgtcccacggcacctgcacggtggtcgggatgagctcgccaaagcccgtccggttggcagggatgcccccaagagaggtgccaaagccccaggttccgtggtagccgttcgttcgcgagatgagcacggtgcgctccggctggccgacgagcgagaagtaacggcgagcgagcttcacggccgtctcgacggcgtcaccgccacccgacacgaagaacacctccgactcgggcatcggcgagcgagccgacaagaactcggcgagctcctcggccgggcgattggagaacgtgccgaacgtggagtagccggcaagctcacgcgcctgcgcagcgatcgcatccgcgatctccgcccttccgtggccgacgttggcgtaccacagcgccgcggtcgcatcgaggtagcgccgtcccgtgtcgtcgtagacccagatgccctcgccccgcacgaacaccaccggattcgtgtcgctctcgtagagctgaccaaacggatgccaaaaccgtcccatgcgtccctcctcggacgcgagcctacgggacgtggcgaacggtgccgtcctgtcgccgcacgacgacctccgaacggtcgcggccccgctgcttggccagatagagcgcgacgtcggcggctgcgagcagcgcccgaagatccggcgcgtccgtctcagccgactccgccaacgcgacgcccaccgaggcactcgcctcgacaccgacctcggcgcgaacgctcgaggcgatcgatgctcggatcgcctcgccaagctggcgagcccactcgagttcgacatcggtcacgagcgccacgaactcctcgcctccccagcgcgcgaccaagtcgcgcgctcgcaggcacgaacgcagggcctccgccgaggcgcggagggcaaggtcaccggcgaggtggccgtactcgtcgttgagggccttgaagtggtcgagatcgacgaagaccaccgcgaccgcacggccctcgacctgagcgtcatggagcgcctctgcgccggacgcctcgaaggttcgacggttggcgagcgcggtcagggcatccgtctccgcgtagcggcgcaactcctcagttgcgcgaacctgcccgacagcgatcgcggcctggtcggcgaagaactcgagtgcctggatctggccgaggtccggatagcgaccgtccaccgggttgtcgaccgagatcactccgaggagccgctcgtcctcgagaagtgggatcgacagcgtatcctcgggctgccaggcgtcgtcgtcggcgacgtgctcggctaccgggaccgacatgcggcgagcgaggtcggggtgcagcggataggcgcgatgccggaacaggtacgaccgagagatgcgcatctgcggcgccatgaccgcggcgaacagcgagagtgggatgggaccctcggtatgcaggcgctccgcctcgacgggatcgacgccactcgtcaccgcgaggacaagcgaatcgccttcgcgcaggtagatcgcggccctcgcgaagccacctgccgtcgtgacggcatccgcggcggtctggagcacctcgaggagcgccgtgcgccgctggacgtctcccgaggccgcgaggagccctgcgagtcgagctcgctcggcctcgaggatgcggacctgggccgagacgcgcgaacgcagatgctcctggacgagggcgagcccgaccagctgtgcgagcacgtccaggtacccgacttcctcggcgtcgagacctccgaggctcaccggctggtcgaggaacaagatggcgcccacctcttgctcccacgactccacgagttcaaaggtgagcgttgccgggttccacccctcgacgagcgactccgtctcgcggatggccgccttggcgagcagctcgtcgagcaacgggtggtctccgtcgacgacgtggaggctaccgatgcgccgcgccaccgcaacgaggcgatcgagatcggagcgtgcgagcgcgatctcccggagctcccgagccgaggtcaaccgacccgcgacgtgggtcacacggaagtacccatcgccctcgagactcgcgagcccagcactggcgaacgacgtcaacggagcaatggctgcacacagcgcgcgatcgaggaccgtgtcggtcgtcgggcgggcgagaacctcacccgcgatggcggcaagttcggcgaagcgccgcgcggtcatggcctctcctccgcctcccctcatcggcactatcggacgctggatcggcgatctcaagtcacacgggcagcctcgcccacgccgcgctcagcaccgtggagcgcgtgtcgcgcctacggctgcccgaacgcgaccggcgtacccgaccacccgatcgggtcgacggcgaccggccgaccgggttccgtggcttcgaccaccgacccgccgccgacgtagatggcgacgtggtcgataccggacgaccccaacgtatcgtagaagacaagatcaccggggaccagctgcccgtagccgataggcgccgagtcggcggcctgcgcagcggcgtcgtgcgggagggcaaggccgagctgggcgaagacgtagctcacgagccccgaacagtcgaagtactgcacccctcctgaccactggcccgcggcgccataggagtaaccggtatccccgcgcgccgcgatggcttcggcgatcgaggccgcctgctcgagcagcgatgcggacgcaccctgagccggcggcgtcgcggcaaccgccgccgtctcggtggcgagttggacactcgcccgctgctcgaccgctcgctgctgagcggcttgggcctgagcgacgagctgggccatctggcccttcagcgacgccaacgccgactcgacggacgcctgctcgctcgcggccgccgctcgcgcagcggcggctaccgccgccgtctggctcgccgaacgcacgagtgccgcgagctgggttcgctcgacctcgagcgcgagtgccatggcccgatactgggcgacgaggcttgtctcgtcggtcgcggcgaccgacacgtccgtctggacgatcgctgcgctgttcgggctcccggcgagcaccgcccccatgcccgccaatgcgtcaccgctggtgaactgatcgagggccgcacgggcgagccgggcccgttcacgcccgagcgcctgtgtctcgctcgcgatacgcgcacgcacacccgcgagctcggcctgatcctgggcgagttgcgccgtcgccgcgtcgtagcgctccgccgcgacctggaccgcaccgtcgagggcggtgagcttcgcagcgagctgagccgcttcggactggtcggtggcgagatcgacgggacgcgcaagcggcactgcttggagcgaggccgtcacggccgcagcgatgccgaggagggccgcccgcaccagcacgcgccgcatcgcacctcccgcacccagattgcgctcaggctaccatgccactggcggccgcaccagacaggcgacggcggcccgtccgagcgatggaggtcagcgatggtgcacggcgtcgacgacacggcccagggagcaccttcgggcgcactcgccggcatcgtcgtcgcggacttctcacgggttctcgccgggccgctcgccaccatgatcctcggcgacctcggcgcgaccgtcatcaaggtcgagcaccctcgcggcgacgagacgcgcacctggcgccctcccgagcgcgacggaagggccacctactatctcagcgtcaatcgcaacaagcgtgccatcgcgctcgacctcgacgacccgaacgatcgtgccatcgcatgtcggctcgccgcccgagctgacgtgctcgtcgagaaccttcgagtcgggaccatggcccggtggggcctcgcctacgacgacctccgcgcgacgaacccgcgcctcatctacgcctcgatctcgggctatggtgacggacccggcgctcacctccccggctacgacgtcgcgatccaagcagcgagcgggttcatggacctgaccggccaaccagacgggccagccacgaaggccggcgtcgcgatcgtggacgtcgagaccggtctcaccctcaccatcggtgtcctcgctgcgctcgtcgcgcgggagcagacgggacggggccagctcgtgcggaccagcctcctccagagcgcgttgttcggcctcgtgaaccagatcggtggctacctcgcgaccgggaacgtgccacgacggctcggcaacgcccaccccagcctcgcgccctaccaaccgctcaggtgcgccgatggcctcctcgtcatcgccgtcggcaacgacgcgcagttcgagcgcctcgcgacggcgctcggcctcgacggcctcgaggatgacccgcgctttggctccaacgccgatcgcgtgcgccaccgcgacgagctcgccgagctcctcgaggcgcgactcgcgaccgagacccgcgagacctgggcgcgccgtctcgaagccgcgggcgtccccgcatcgcccatcaactcggtcgccgaagcggtgacgctcgccgagtttctcgggctctcgcctcgagtccggcttcccggcccgctcgagctcgacacgatcgcgaacccgctcgccctctccgacacaccggtcacctacgcgctcgaacctccggatctcgacgccgatcgcgactgggtgctggcgtggctcgatgcggcagaacgaaacgcctgaacgagacgccgtgccacgtggacgagccgcccatcggcaccgaatggcccgacgacctggaccgagaacggcacccggctcgttcgccacgggcccgctccgcccccgaccggcacgctgagcgccggcaggccgagggcgttccaggggatggtgagctcgttgagccgcaacgtcgaccaggcactgaggggtccgggcggcgcgaggagggtcggcacgagcgcgagcgcctcgctgtcggcgaaccaggcctcaaaggccgcccgccacgcgtggagccgagcacgtgcctcgagataggccgcaccgtcgaccgcgagcgctccctcgagccgtcgcctcacccacggatcgagccgatgcgcctggcggaggagccatccccacgtcgccgccgcctcgaagtcgaggatcgtgccgccggcacgggcgagctcaccgagatcgaccggcgccgacaccagtcgctcggcgagctcgccgagtcgcccatcgacgttgggctcgccgacacccacaccgacgagtggccagtcgcccaccagctcgtcgatcccgagcgcacgagcgccctcggacagccgatcgatgtcgggggcgatgagccccacggtgtcgagactgggcgccagcggcgccacacccgacgtcggcagaaggccgtagctcggcttcagaccgaggaccccattggccgccgctgggatccgcaccgatccgccggtgtcggtaccgagggcgagatcgacgagcccgagcccgaccccgaccgccgatccactcgacgaaccacccggcacgagcgacgcgtccaacacgttctccggggtgccatcgaacgggttgacaccgtgcgtcccgtaggcgagctccaccatgaccgtccgcgccgtcggcacccacccggccgctcgcaaccgtgcgacgacggtcgcgtcccgaagcgcaggtcccaccatggtgccaaggagccgactcccgacgcgcgtcggcacgccgacgacgtcgatgttgtccttcaccccgaggcgacgtgcgaccggagccgcttcgatcgacggggcaccgagtgcccaattcctaggagccgtcgacatctgcctcctctgtcgcgacgccagacacctgtccgatggtcgcaacctgcgtcacactgggcgccatctgccgcaggtacgtgtcgaagaacgcgatgctgacggcagcgacggcctgctcggcaggcccttcggtcgtgtagggtccgaggtggtcggccccgaggagccactcgaggtacttgggcgcctgggcgtccgcgtagatcgcctgggatgcggacggcgggttcaccgtgtcggcggagccctgcacgacgagcatcgggacggacgagccgaagaacgacccgccgaagggggagaacaccgcgcccgacagcacggcgacggcacgaacgccagggatcgcacagcaggtgttgtccgcgctcgcaaggaccacgtcgccgccgtcgctctggcccgcgagcgcgacgtcgtcggtcgcgacacggcccgcgagcacgcccgagcgcgcaagcacgtccatctcgccgatggcggccgagaggtcacccggttcgttgagcatgtccgactcgaaggcgtccgcgatcgccgcgtcgtgcaggtcgaccccgtaggtcgccagcgcccacgcagagctcagtgggaagcggggagcagcgaccacgtagcctgcgcgaacccacgcctcgatgagcggcacgtacgcactcggatcctcgtcgaagccggccgcaaacacgatgaggggatagggtccacccacgctcgcgaccggggcatcggccacgatggtactcgatgccgtccgggacggatagaagacgtccagcaggtagctgcgttccgaacacgcgtgcgtcgtcggtacgcacgtcaccctgccaggctcggtgacggtcacccgaagctcgcccaccccagcgatctgcccgctctggtgcgcagacgacgagcgcggccgcgtcgacgagggcgctggctcgtgtcgatgcgtcgtcgacgcgctcggggtcgtcgtcgctcgttccatggccgtcgccgtcacgaccgacgccgacgccacgacgacgacggcaccgaccccgacgagggcgcggcgcctagccctgagtctgcgtgaacgagacgccgttctcgacctccgcgatctgcgcgatccttcgcgcgtgacgccccccatcgaagtcggccgcgaggaacgcatcgacgatggcgagcgcgaggtcgtgaccgagcagacgcgccccgagtgcgaggacgttggcgtcgttgtgcgccctggcgaggcgagcggacagctcgttgtagcacagggctgcacgcacgccccggaccttgttcgccacgatctgctcgccctgacccgaacctccgaagacgatcccgagttcggccgcgccggtcgcgaccgcctcggcagcaggctggcagaagagcgggtagtcgacggactcctcagagtcggtgccgaagtcgaggacgtcgagtccagcctcgacgaggtggcgcttgacggcctccttcagcgcgtagccggcgtggtcggcgcccaatgcgatgatccgactcacaggtaggcccccggtgcttgctgggctccaggaggctgcggcaggccgcgaccgcgcaactgctccagctgtgcattcgaggccatgcgctgggcaaacagggtcgcttggatgccctggaacagaccttcaagccacccgagcaactgggcctgcgcgacccggagctcggcctcggacggcacaacgccctcttggaacggcaacgagaaggaccgcagctcgtcggcgaggtcgggtgagaccacctcgctcagcgcgcgcaacgactgctcgtagatctcggcgaggcgctccctggagcgctcgtcgagggtcgcctgacggacctcgtcgaggagcgcgcgcaccatcgccccgatgcggatcactcgagccggcgacatcaccgcatcggtatcggcgctaccagcgttgggctcgcccgatgctccagccgtcgtctgctcggcgtactcagaattctcagccatcagctccctccatcgaccggctacgcacgaccccgcggcagcctacctcaccggacctaggggcccaccgcgatcggcacgaggacctcggcaggggtcagtgcaccgtggcgagcgcgcatccgtagcgcgccttgatcggctgggtcatcgaagaacacgggcgcggtcgcgacgaggcagacgtcgccgaggcgttgctcgaaggtctccgggaccggccccccgaagagcccagcggcgacggcctcctcgcgtgtgaacaccttcgcgacgtcgccgtagcgagcgcggcatcgctccgccaacgccgccggatcgccagcggtgtgcaaccatcggaaacgaccctcgcccgacaccagcgagcagtcgcctcgcacgtcgcgatcgagtcgcagagcgcctccgtcgaccgccacctgaccatgatcggccgtgacgaccagcgtcacccctggcggcagccgctcgagcagcaggccgaccatcgcgtcgaccatgcgcagctcgcgccggtaggcctccccgagaccgaactcgtgcgcggtggtgtcgatcccttcgtagtaggcgtagacgaaccgctccccacgagcgagtgcctcgtcgatacgcgtcacgacctggctcaaggtcgaccaccaggccagccgcgcgccacggagatgcaccttcgtgaagcaggtgtcggcgtaggcgaacttggtcaccgcaacggggttcgccccgaggaacggggtcaccggcgcgagccgctccggtgccggcgccgggcctcgcccgttcacagtccagcgcaagacgttgagcacggatccaggcccgacgacgacgcggtagccaagcacgccgtgcaccgccggcaccacgccggtcgtgagcgacgtcagcgcggtcgcggtcgtcgtcggtgccgtcgagtgggctggcaccacccggagcgcgccgagggtcgcaagctcgtgccgatgctccatcaactggagatagccgagtccgtcgagcacgagcaggacgactcgctcgggtgaccccacgtggtcggccaaccacgcgggtgctgccggctggcccgccatgtcgagcaggccgaagatccccggcaccacaccggcgagcgacggcccgtcgtagcgtggcactatgaagccgtgatcggcctcgcgcgcgatctccatccgccctccttgggccaaggctaccgtgtgttcgccgcagcctgaaagccgaaccgccgcgttcgtcgcttcacgaccactccacggctcgcgtgtccgtgggcgctcggcccgagctcgcgctcgagccgcgaccagcatgggagctgagctccgtcctgcccgcaccccgagcgaacgacaggagtcgtcgcaccctcgaacgagccagcctcgctcgggaacgacccggccccaggcgcgctcgtggcccaaggtgggcgatcgaccgatcgccccacgacctcgcggccaggagctaggctcgagatagtgagggtctccacgcgcggtgactacgcagcccgagcattgctctcgctcgcgctccacccgagcgaccaaccgacctccgtcgccgagctcgctcgacgcaccgggctaccccagccctatctcgagcagatcctcctcacgctgaagggggcagggctcgtacgctcgaagcggggcgcaggcggcggctacacgctcggccggagcgcggaagagatcacccttgcccagatcatcgcggccgtcgacgggccgatcaccgtcggtgacttcaaggaaccccacgaagacggcgcgtgtgaccacgaaggtcagtgcgcgctgctcgaggtctgggccgaggtcggccaccacatggccgatcacctgcgcagctacacccttgccgagatggtgcgccgtgctcgtgggctccgcggcgacgtgctcggcgccgtctcggatcctcggtgatgacgaccgacggcgagagcgacgcgcgctaccccgcgcactgggagagcgacatcgtcgcagccgacggtcgcacggtccacgtgcgacccatccgtcccgatgacgcaacagccatcaggcgcctgcatgggcgctgttcacccgagaccatctactaccgcttcttcacgccgttgccggagctctcggacgccatgctccagcacttcgtggtcgtcgactacgtcgaccgcatggccttcgtcgccgaatccggcgacgaactcatcgcggtcgctcgctacgaccgcctcgcgggctcctcggatgccgaggtcgccttcctcgtcgacgacgcccaccagggccgcggtctcggcgcggcgctcctcgaactgctcgccgcctacgcgcgacagcacgggatcgggcgcttcgtcgccgagacccttccggacaacgtccgcatgctcaaggtgttccaggacgccggctatcgagtcgcacgcacctgggccgacggcaccgtgcatgtcgtcttcccgatcgatcccacgccgagctcggcggccgtgatggccgaacgggagcgccgggcggctgcccgcagtgtggccgcgctcgtcaacccgacccgcgtcgccttggtcggcgcgagccgaacgccgggcagcgtcggtgacgtgctcctcgccaacctcctctccgcgcgcttcgagggaagcctctgggtggtcaacccgaacgccgcagcggtccgcggcatcccgaccgtcccatccctgcgcgccatcggccaacccatcgacctcgccatcgtcgccgtgcgcgccgaggagctccccctcgtgctcgaggacgcccacgccgccgaggtgcgtgcgctcgtcgtggtcaccgctggcttttccgacatcggccccgaaggggccgaggaggaacgtcggctggtggcgagcgctcgacgtctcgggatgcgcgtcgtcggtcccaactccatgggggtcgcctcgcccgcgatcgggctcgccggcacgctcgcaccctttgcactcgaggccggtggcacctcggtgcacgcgcagtcaggtcccctctcgctcgccatcgtcgccaagttggcgcaggcctcgatcggcatcgcgagcttcgtgtcgtcgggcaacaaggccgatatctccggcaacgacctgctcgcgtggtgggagaccgacgagcggacccgttgcatcgtcctctacatcgaggacttcgggaaccctcgtaccttcgcgcgcgtggccaggcgggtgagcgcgacgaagccgatcctcgtcgtcaaacccgagcgcgagggtcgcagccgtgtcgagcccgaccgaccaggtgtgctcgacaccgaggtcgcgatcgatgccctcctcgagcgcaccggcgtgcttcgcactcagacgctcgaggagctgaccgaactcgttcgtctgctcgagtctcagccgctgcccgccggcgaccgagtcgccatcctcgccaatacccaggggcccgcccccttggtggccgacgccgtcttgcgggccggcctcgatctcgctcccctcgagcccgccaccgtcgagcgcctcggcaccctcggccgcgccgcggctcgcaaccccctcgagctcgggcccggcgtcgtgccggccgactgggaacgtgctctcgaactgctcctcctcgacgccacggtcgacgccgtcatcatcagcttcatccccaccgtggtcggcgcgcccggcgatcctcgactcctcgccaacccactcccgggaggcacgctccgcggcgcaccggcccagagcctcgcgcgcgcggccgagattgccgacgccgtgacgaaggtcgccacccagcgcggacgcgatcgaccgaagcccgtcgtcgcgaacttcctcgcgctcccgggtgtaccagaacgcctcggcgccggtccccgcaccatcccctcgttcgactttcccgagtcagcggccagggccctcggccacgcggcccgctacgcccgatggcgggcgagggccaacggaacgccgctcgagctggtgcccctggctggcgactgggcgcgcgatcccctcgacgaatccgccgacgaggaccgcgagctcgacgccgaggccgtcgcgggcctcctcgactggctggggatccctcgacgcgccccatcgggcggccgccgcgaggaactcgagggtcgagcggtgcacctgcgcctcgagctgatccacctggagcgctacggcccattcctgcgagcgggcctcgctggtgacgccttccgacgcatcggggcctcggtggccgtcgcactgccccacaccgaccgtgacgtgatcgacttcctcgaggcgatcccgggcgcggacctcgtcgtcgggtcggggccgtatccgagcgacgacctcgtcgcgatcgtccaccgcctcgtgacgcttgctgaacgccgctatgacgtggcggccctcacgctcgagcccgtcgtcggcacggcaaggggctggtgggctcgcagtggtcgctgtgtcgtccgaccactgcgcctcgaacccgcgatgatcacgcgaagccttcgcgcgcccggatccccctcacccgcctgagcctcgtcgcaccggcgcgagctcgggtggcgagccgtcgagtggtgacaaaccctcactttgcggcgagcctgcgccctcacaggagggcgtcgatggcccccacgagcatcgggtcctgtggctcgacagtggggcgaaaccgctcgatccgctctccgtcgcgcgagacgaggaacttctcgaagttccactgcacgtcacccgccacgccatcaccatcggggacctcgcagaggctcgcgtagaggcgatggcgcccctcgccgttgacctcgatcttcgcaaacatcgggaagtcgaccccgtaggtggtccggcagaacgtctcgatctcctctgcggtcccgggctcttggccgaggaactgattgcacggaaagccgagcacgacgaaaccatcgtctcgccgtgcatggtagagctcgacgagcccctcgtactgcggcgtgagaccgcagcgcgacgcgacgttcacgacgagcagcaccttgccccgataggcggagagttcctccttcgtgccgtccagccgctccatcaccaaatcgtacgggaacatcgaacccctcctcgcgtctaccgcgttaggtcaaggcctccgtgggcgaagttcttcccattccccagatctcgcccggcgtgctcaggacaggttgagggccgcgtacttgacgttcaggtactcgtggatcccttcgaacccaccctcacggccgaaccccgagcgcttgactccgccgaacggggctgccgcgttggagacgaggccctggttgacgcccaccatcccggtctcgagggcctcgatggtgcggactgcccgggagagcgactcggtgaagatgtagccgacgaggccgtaggtggtgtcgttggcaaggcggatggcctcgtcgtcgtcgtcgaagcgatagaccggtgcgactggaccgaagatctcctctcggaacacgcgagccgtcggaggcacgtctcgaagcaccgtgggcgagaagaagtaccctcggtccccgcgccgctcgcctccggtgaccagtgaggcacccgcagcaacggcatcttcgacgagccccgagaccttcgccaacgcgtcagcgtcgatcagggggccgacggacgcatcgggctccgtaccgcgcgcgaccttgagcgacgccagagccgtcgcgaggcgctcggagaaggtgtccgccagggactcatggacgaggatccggttcgccgacgtgcacgcctccccgccgttgcgcatcttcgcgaagaccgcgcccgcaactgccttgtcgagatcggcgtcttcgaacacgatcagcggtgcgttcccacccagctccatggacaagcgcaagagccctgacgacgccttgcgcatcagcaggctcccgacctccgtcgagcccgtgaacgacagcttgcgcagaccagggtgtccgatgatcgcgtccgagatcgggccggggtgcgaagtcgtgacgacgttcagaaccccaggcggcagaccgacgcgctcgaagatcgacgcaagggcgagcgtacacagcggggtctgctccgccggcttcacgatgaccgtgcacccagccgcgagcgccggggcgatcttgcgtgttcccatggcgagcggaaagttccacggggtgatcaggtagctcggtccgaccggctggcgtgtggtgagcacccgtgtcgtggcgtcgggggagacgtagaagtcgccgtgcacgcgcaccgcctcttcggagaaccaccgcaggaactctgccgcgtaggcgacttcaccccgagactctgcgaccggcttccccatctcgagggtcatcagcagcgcgaggtcatcctgggcagccatgaccgcctcgaaggctcgccgcaggatctcggcccgctcccggggagcgctgtgggcccacgcctcttggtgcgcgacagcagcgtcgacagcctggcgagcgtcgtcgaccgtagcgtcggcgacggaggcgatgacctcaccggtcgcgggatcctcgacgtcgaagcgacccccgtcagcggcctcgcgccacgcgccgtcgacgtagagtcccgtcggcaccgtccgaacgaccgctcgctctcgctcctccacgtcagcctcctcctgtcggatcgcagcaccctgcagcgaccgtagcctaccaagctcctcgcaacggtatccatcgcggaccgcgccgcgtcagctcgattccgcactgccctaggctcaggccatgcacgcatcggagcagtacctgcgcgagctcgtcgagctcgaccccattctcgcgaccgagctcggcctcgacaccgatcgtctccccgacttctcgcccgacggcaacgacgagcgagcgctgctcgctcgtcgcgcacttgcctggctcgccgacgaatccgatccggaccccatcgccgccgacctcatgcgcgagcgactctcgagtcagctcgcactctacgacgccggcgagcacgagcgggcggtgaacgtcatcgcctcacctcagcacgccatcaaggaggcgttcgacctgatgcgcatcgagggtcccgacgacgccgaacgggttgtccgccgccttcgagccgtcccgagcgccctcgccggctaccgcgcgaccttggagcgaggtcgagccaacggccgtctggcgcagcgacgacaggtgctcgccgctgccctgctcgccgaacagaccgcggatgcctacttcgctggcgtcgagcgtcgtgtcctccaggcaacgcagcaaaccgaagccgaccaacggctggcgggcgcgatcgaggccgcgcgctctgcctacggcgagctcgcgagctacctcaaggatgcctacgccccgagcgccatcgaccaagacggcgtcggcagggagcggtgggccctgtggtgccgccacgcgaacggtcgagatgtcgatccggaggaggcggtcgcgtgggcggccgacgaactcgccgcgctcggcgccgagatcgagaccgaggccaggcggctcggcctcgaacccgggcctggtctgctgacggcgctcgatcaggacccctcacggcagatcgtcggtgtcgacgccttcctcgcgtggaaccaggctcgcatcgacgaggccatcgagatcgtcgactcccgagccgtcacgatccccgccgcgatccgtcgatgcgaggcgctcgaggctcctcccggcggtgctgcggccatgtactacacgccaccctcggaagacctcgcgcgcccgggacgcacctggtatccgacccatggcaagacccgcttctcactgtggaacgagctgaccaccgtctaccacgagtccgtccccggccaccacctccaactcggcatcgcgacctggcgtggcgcagcgctcgatcccttccaacgaacgctgggctcgatctcgggtcacgtcgagggctgggcgctctatgccgagcgactggccgacgaactcgggctcttccccgacccggcgtttcggatcggctatctcctctcgcagcgcttccgtacgctgcgcatcctcatcgacatcgggctgcacaccggcatcggtgcgcagcgacgctcggccgagcccctcaccccagagcgcgccatcgacgacctcgtccagatcgcaggtctggagcgtccgttcgctgcaagcgaagtcgatcgctacctcggctggccggcacaggcgaccagctacaagcttggcgaacgagcctggcgagacgcgcgcgagcgcgctcgcgcgcgtggggtcagcgatcgccgcttccacgagtcgctcctcggcctcgggttcatcagcctcgaccagctcgcgaccgtcgcggccacgctggcaccgtaggggtagcgccgtcgtcgtgcgccaccccaacgacggccttagccctgcttgggtggacgggtcgcgctgcgcaccaacgcccgaagggcgagcaccaccacggcgacgatcgccacgacgaccgcaaggctgatgatggcgtgcacaatggtcagcaagaagcccaagaccagcacgcccacgacgacgaccgcgacacctatgaggacacgtccaagcatcggaccacctccacggtcaaccctagaccacgatgctgagcgaagtccgaatccgcgctcgagaaccgccgcacatctcgagtacctagctgacgatgtccttcgacagaaagctcgacacagcagccgtaccccacacgaccaaccacgccgcctgctccgcaaggtccttgaggatgggcgtcaggtaggccggcgagcggaacaagttgatgaacgagccccagtacgtcgagagcaagatgggtcgcacgacggcgagctgcgggacggcgccgatgacctccgcagcgatcacgatggccaacgtgatcgcggtcgccgtgagcgacgacgaggtcgccgtcgagatggcgacgccgacggccaccactccgaccagcgacgctcccacgacgagcgcgctgaggagcacgtcgccgacgccggacgcgacgccgacggcggtcccggacagcgtcacgagccgcccgtgcggaaacaagacgaagcccacgacgagcccgacgaccgcgacggtgagcgccgcgacgatggcgaacaccagtgcggcaacccccttggcgacgacgacccgcgagcgagaccccccggacaggagcaggtagcggagcgatccgttggcggcatcacccgccaccgcatctcccgcgacgatggcgacagccagcgggagcaccagggtccccatggtggcgagcgcggcagccggcaagaagacggcgttctgggtgatgaccgagaagaacggcggaccgccgccgttgcgaggaccacccgcgaccttgaccacgataccgagcacgatcggcaagaccgagagcaacacgaggatgaccaggttgcgaggacggcgaaacacccggccgagctcgtcaacgaacatcgaagccctcccccacctctgcgaggaagagatcctcgagactcggcagcaccggggtaacctcctcgagttcgataccgcgctccaccgccgaggcgatgagtgctggcatcgccgagcgcggcgcgacgacctggaccgcgaccccatccgcagacgccgtcgccccagggagggcgagcaagcgctcgagcggccgaccgcgcaggcgccaggtcggctcgtcgatctctcgcagctcactgaccggcccctggcgaacgacgcggccctgcgacatgaaggccacgtgactacagagcagttccgcctcggcgagcagatgggtcgagaggaacacggtgcgaccctcgtcgcgaagggcagcgagcagccggcgcacctcgcgcatgcccgcggggtcaaggccgttggtcggttcgtcgaggaccaagagctccgcatcggtcatgatggcttgggcgatgccgagacgttgtcgcatgccgagcgagaaccgagcaacgcgtcgatccgccacggccccgagccccacccgttcgagcgcggcttcgatcagccgctggcgcgcgcccgacgcgacgcctctcgcggccaagagccgggcgagattgtcgcgagcgctcaggtacgggacgtagcccggaccttcgaccagcgcgccgacccgtgcgcgcacggaggcgagtcgcggaaccgtcgcaccgagcacctgcgcgcgaccggcatcgaggaagatgagtccgagcagcgcgcggatcgtcgtggtcttccccgatccgttcggaccgaggaagccgaagatgctccctgctgggacctcgaggtcgacccggtcaaggacacgggtgcggccgaaagacttctcgagcccctcggcactgatgacgatgctcacccaccgatcacgacggtggcgtcgctctcgaggatcgcaggggtgacggcgccgacgaggacttgtccgctcggcaactggagggcgttgacgagcgcggtctggagcagcatggcgtgcgctccatcagcgagcgtgactggctgctccagggtgcgaagcgtcgagccgaacgacgaggaccccgcagacgtcgaggtaggcgcgccgagcgctcccttcggcaacaccgcgacgcgatcccagcccgacccaagcgtcgtcgcaccggccacgttcactgcacaggttccgggcgcataccccgtccagccggacgcggtcggcgtcaccgacgaactctgcagaggaaccatgcagcccgtcggcgagagcgccacggactcctgacgcaccgtggcaccggctggcggcgtgaacgtgaacgtggacgcaggcagcgagccgaaggagatctgggtgaactgccacgagagatccgtggtgccatcggcaccctgaatcgccataccgagcacttggtcattggctgcgtcaacccagaagctcacccgcccgatggtcgagccggcctgcgtcggctggatcacgagggtatagacaggctgaccagcgacgtaagtgttgtggccgaggcgcacggtcgaatcggtgccaagtgccgcaacgatcgtgtccgccgccgtggtggggtcgaacgtcgactgtgcggccgaggacatcgacgatggcgccgagccagaggccacgagatgcatcgcctgctcacctgatgagttccacaaccacaccccggtgcggctcgcgtagaggtcccgctcgctctgggcgttgagcacctcgacccgcagaccttcgcccacaccgcgccacagccgcacgctggccgttccttcagggattgccacggcgttcgtcgacgacgagccctggacgcccgagagcaaggacgccgccggacccaacaggttggacgtgatctggagggtgcccgagaacgactggggtcgagccccgagcaccgccgcgaccaactcctgcggtgacaccggcgtcaacgactcggtctgcgcactcgccagcgagggcgtcagtgcggccgcggccaccgcgaccagcgcggctccgacgggaatgccaacgcgtaccccacgacgtcgcacaccatgcgccatggctcctcctctacgtcctctacgcttgcccgtcctcaacgtccgacggcgctcgatcgacggcactcgattcggtgcctgaatcccacgctagtcctccactcagagcgccgtcaccgccgatgtgtcgggatctcaggcaaccataggcctcctacaaggacaccctcgagcgcgtctcaccccatcctcagctgcgacgacacactcgaccttgtgcgtacggaccgtcgcggtggcccctgaaggacgatggatgctcccaaccatcgggccacggcgcagctgcatcgcgccctcgcgctcacacgcagacggtgcacgagcggctggacccagagcgcgtgcgtccgtcgcctcgcacacgccctcgtggccgatcgagcggagcacgctcgagcgtggcggcatcgaccacgggggctgcgaacaggaagggagcgcaccgtcgtggtcgcagcatgctgcccaccgaaccaacgcgaacgccgtcacatcggcgaaccacggaacgtgtccgagggttctgacgcgagcggtcgcgccggcggaagcgggtgtcagcagggaaacaatcccgacgcccgacgtgttatactgtggcagcgccacctcgtgccctcgtcaagttcgacccgtgtccacgccgatcccgaagacgacgaaccgaaacccgactagatcgagtgggcagccagagcatggcgagagcctcggggggctgtgcgagcgcagtggctctcgtggcaggtcgggacacgactcctggtcgctacacggagcacggcgcccagcgtagttcggcgcgtcgatgaggggcagcagcgataccgttcatgagagagggcacgatggcgacgaagagtgatagcgcgctgaagcagagttcgcgtaagcgacgctcggtccaggcggaggtcgactctgcgctccaggcggcgggccttggagcggactcgatccgcctcttcctcgacgatctcgccaagcaccccttgccgtcggcggctgaacaagtcgaactcgccaagcgcgtgcgcgagggcgacgaggacgccaaggccgagatggtcgccgccaacctgcggctcgtcgtccactgggcgcgccgctaccaagatcgtggcgtcgaactggccgacctcatccaggagggtacgttcggcctcatccgggctgtcgagaagttcgactggcgacgcgggttcaagttctcgacgtatgccacgtggtgggtccgccagtcgctccagcgtgcggtccacaaccatggtcaggcgatccgcctccccatggaggcagcagagcgttcccgtcgcgtcgacaacgtcacccgtgagctcgcggctgacctcggccgtgcgccgaccgaagaggagatcgcgatggccgcgaacctctccgcgagtcagctcgccgacgtgcgtcacgcggctcgcgtcgtcgcgagtctcgatcaggcggtgggcccagagggcgagacgagccttggcgatctcgtggtcgcccaggacacctcgttcgaggaagaggtcgacgaatccatctcgcgggaaatgctgcgtcgcgccgtcgaagagctcgacgaactcgagcgccaggtcgtcaccctgcgtttcggtctccaaggagatcggcctgcttccctcgaggcgaccgcgcgcatcctcgggatcggaccgcgacgggctcgtcgcctcgaagcgagtgcgcttgcaaagctcgctgagaatccgcggctgaggacctcggcggcctagaacatcggcggcagagcacctcggcggccaagaacctcggcgggctcgggccacggcccacgcacacttccagcgtccccgacggccaccgttgggcctccgggcattgagctgcaggcgcactgcgacaggctggggcgccatcagcgactcgccagccaggcaccgcaccagatatcagaagccgaaggcgacatcgctcggcgagcagccggccacactcccgcccgaggggctcgtcaacgcccctcgtcgacgcggagaatcgcctccgtgcgggcgcgcgccgcgagctcgccgaggtcctccgggagctccgcggtcacctccacgcgtccaggacgcgttggatgctcgaacgcgagcgcggtcgcgtggaggaacggacgttcgagcccgccgtaggggacgccatagacctcgtcgccaacgatcggatgcccgatggcgctgaggtgcacacggatctggtgggtcctcccggtctccagcgtgagctcgacgagcgacgtatccggaccatgccagaccaccctcagctgcgttcgagcgtcacgaccgccgctcaccaccgcgacacgggacagatcgcgcagatcgcgaccgagcggcgcctcgatgcgtgcagcttgcggcggtacgcccacgacgagtgcacggtagcgacgctccacctcgtggtcgtggaccgcccgccgcaacgactcgtaggcgcccgcgctgagggcgatgaccatgaggccactcgtgccgcgatcgagtcgatgcacgagcccacgacgcaacggatcgccgggaagggcacggagcgacggccaccgttcgagtgcccaatccgcgacgctcggacgcacatcgcggaggtgggtgcgatggacgatcagaccagccggcttgtcgatcaccgccacgtcgtcgtcctcgtagcagaccaccggtgcgccctccggagccggcggagcggcaggatccggccaggtggcctcgaggagctcgccggcccgcaggcgcctcgaacgtcgctgctcgacacggccgtcgaccaggaccccgccatcgtccacgagctgctgggcgaacgcccgctcgatcccgccggcgatcgcgaccgcccgatcgagacgctcgccagcgagcgacgctccgatcgtgaggcgcagctcacccacgatgcccgcgcacctcggacagagcgagcacgaccaccccgaccgtgatggcggcgtcagcgaggttgaacaccggccacagcgggagctggatccagtcgatgacggcgccgtggtgatgacgcaccacgcgatcagccagattcgagatcgctccaccgaccacgagagacgcggcgatctgcgaggcgacaaagcgccgcgtcaggccccacgcaccgatcgcgacggcgaccacggtcgcgacgacgccggcgaccacggggtgacctacgcccagcgagaatgcgacgcccgtgttcaagacctcgacgagatggatcggcccgatgctcaccggatgcgttgcgaagtggtcctcggcgatcgtcttcgtgacctggtcggcgatgacgacggcacccgcgacgcaggtggtcaggaggatgcggcccctcaacgacggcgcgtcagccccccctccttgcaccgcacgcacaagcgcgcgtacgggagcgcgcgcagccgcgccctggcgatcggctcgtggcagacctcacaggcaccgtaggtaccggcatcgatcttggccaatgcatcggcgacctcactgagcgctgcgcgagcgctggcagcaagggcgaggtcgcgctctcggtcgatcgcggccgtaccaccctcgccagactcctcgtcgaactgcacctcgagaggcccgttcgtctgcacgagctgatcggcctccgccttgagctgcgaagcctgctgctcgagatgggcccgctcgacgaggagcaggttgcgctgctcctcgatgaacgtcccttcgtcgagcgcgtcgagctcgtcctcgtccaatgcgaggtacgcctcggcacgctcgtcgttcggaatagttcgctcagccatgaagtcctcactcctcgctacggtgccggccccgggcacgcacgagctgctcaatgatagctggcctccccgtcggcatcgacgccgacgaagaagcgcggcccagctcagcgctaggctggcgccatggacgaggcacctgagccatatcccgcgcaacctgcgacccttgacctcccagcactcgagcacgacgtgctcgcctcgtgggagcgcgaaggcaccttcgccgcgtccatcgagcgccgtcgcgccgagggggcgccagccttcgtgttctacgacggcccaccgttcgcgaacggcctgccacactacggccacctgctgaccggcttcgtcaaggacgcggtaccgcgctaccagacgatgcgaggcaagctcgtcgagcgtcgcttcggttgggattgccatggcctgcctgccgagatggcggtcgagaaggaactcggcctcaccagccgtgaggacatcgagcgcgtcggcgtgggtgtcttcaacgaccactgccgagccctcgtcgaccacacctcggatgagtgggaccgctacgtcacgcgccaagcgcggtgggtcgacttcgaacacgcctatcgcaccatggacctgccgttcatggagtccgtgatgtgggccttcaagcgtctctacgaccgcggactgatctacgagcactaccgcgtgctcccctactgctgggagtgcgagacgccgctgtcgaacttcgagacgcgccaggacgacgcctatcgcccgcgtatcgaccccgcggtcaccgtggccttcgccgtcgagggcgacccgagactcgcaggcacgctcgagggcccactctgggcccttgcgtggaccaccaccccgtggaccctgccatcgaacctggccctggccgtcaaccccgccgagacctacgtcctcgttcgctcccaagccagcgatcaagacgccggacgcacttacgtcctcgcggaagcgaggctcggggcctatgcggaccgatttcccgatgccgaggtcctcgcgcgcgtggcgggccgcgacctcgtcggccgtcgcttcgcgcccctgttcccgttcttcgccgacacgccgggcgcgttcgtcatcctcggcgccgacttcgtcaccctcgacgaaggtaccggcatcgtccagctggcccctggcttcggcgaggaggaccagcaggtctgtgaggcgaacgggatcccggtcgtggtcccggtcgacgaccgtggccgctacacggccgaggtcgagccatgggcaggggtccaggtcttcgaggccaacccggcgatcatcgaggtcctccgcgaccaaggagcgctcatcacccaggaggactacgagcactcctacccgcactgctggcgtaccgagacgccgctcatctaccgtgccatgagctcatggttcgtcgccgtcacggcgctcaaggaccgcctcctcgccgagaacgagagtatcgactgggtaccggcccacgtgaagcacggcgcttttggcaagtggctcgagggtgcgcgggactggtccatcacccgaaaccgctactggggtgctccgatcccggtgtggcgcagcgacgaccccgcctacccgcgtatcgacgtctacggctcactcgatgaactcgagcgtgacttcggcgttcggcccagcgatctccaccgaccggcgatcgacgagctggtgcgcccgaaccccgacgatccgaccgggcggtccatgatgcgacgcgtccccgacgtcctcgactgctggttcgaatcgggatcgatgcccttcgcccagctgcactatccgttcgagaacaaggagcgcttcgaggccaacttcccagcggacttcatcgtcgagtacgtcggccagacgcgagggtggttctacaccctccacgtcctcgccgtcgccctcttcgaccgaccgccgtttcgccactgcatcgcgcacggcatcgtccttggcaacgacggacgcaagctgtcgaagcgactgcgcaactacccggacccttgggaggtgttcgaggagatcggcgcagacgccatgcgttggttcctcctctcgtcgccgatcctgcgcggccaggagatgctgctcgagcgcagcgccatggtggacacggtgcgccgggtcatcaatccgctctggaacaccttcaacttcctcgtcctctacgctcgcgccgatcaccttcgcggccagcgcgtccacagcgcgacccacgtactcgatcgttacctgctcgccgcgacccacgatctcgtcgtcgaggtgaccgacgccatggatcacttcgaactctcgcgtgcgacgacggcggtcgagcgtcacctcgatcgcctcacgaactggtacgtccggcgcagccgctcgcgcttctggtcgcggcgcgacgacaccaccgaagatgccaagcgcgaagcctacgacaccctccataccgcgctcgaaacccttgcgctcgtcacggcgccactgctccccatgctgagcgagcacatctatcgcacgctcacgaacgaggcctcggtccacctcgccgattggcccaacgccgaggccctcccgagcgacccgacgctcgttgcccagatggaacgcgtgcgcgaggtctgctcactcgcacactcgattcgcaaggcagcagggctgcgtgctcgcctccccctccgtcgtctcaccgtcgtcctcgcagatcccttcgatctcgagccctacgtcgagctcatccgggacgaggtcaacgtcaaggaggtcgtggtcgagcccgccgccgaacacccagtgacgtggcagctctcggtcaacccgcgcgtcctcggaccacgcctcggggcacgggtccaagacgtgatccgcgctgcgcgcgaaggtcgcttcgacatcagcggcgaccgcgtgacgtgcgacggcgtcgagctcgcgcccgacgagttcaccctgaccctcgccaccgacgaccccaaacgggtgcgttccttcgccgaccgccgcggcctcgtgatccttgagaccacggtcgacgacgaactcgagcgcgagggccttgcgcgcgatctcatccgtctcgtccagcagcatcgcaaggatcacggctacgagatcgtcgaccgcatccgcctcgcgatcgccctcgaccgcacgggccgggtccagggtgcgcttgcccagcacgccaacgaggtgctcggcgagtgcctcgcgaccgaactcatcctcgacgacgcagcggcactggatcttcccgaccgctcgcaggtgacgatcggcggcgagcaggtgacgatcgcgaccgaaccagtccgcgctctgacggagcccgacggccagcgctagcgacgcagaggggcccctcgcgccagggagtgcactcgatcggactcttcgagcgccactgatcaacgacgagtgtgtcgcccaccccgcgagcgaacccagagcgaccacgtccacgcgaggccgccccggcgggcagcgacgatcctcgctgcccgccagcgacaccaccatcagtccgcgaccggactcgctcgcagctcggccgcgctcgcgaacgcgtcatgcgtctcggcgctgtcgcgccccgacgccaccgcccacgcgtagaacaccaaccccaccacgatgtccgcaacgatgtcgtagggataatggatcaagcccttgtggtggtcgaagggagctccgaagcgagccgcaccgaagcaggcaagtgcgagcatggcgagcaggtacaccacgagccacgctccatgacgccagtcggcggccgtgatcttggcaacgggagctccgagcgcggccgcaacgacgtagacagccgcaccccccaagatccccacgacgagcttccagtcgacgctccagcccgaccagtagatgatgagcgtcccgccgatgaacgcgagcggcgcgaggatcttgtcgcccgagagccggaagggtcggtgcgcatcggggtggaagcgacggaacaccgagagcgacaccggacccatgacgtaggtgaacgccgtcgccgacgagatcaccccgaccagactctgccagctcgggaacggcagcaagaagacgatcgagaacacgaccgtgatccccatggcccacaccggcacgccgaagcgctccgagatcccggtgaacacccgtccgaggtaacgattccgagcagacccaagcacgacacgcccacccgacgagaggtagacgagtccggttcctgacggagagaggacggcgtctgcgtagagaacggccgcaagccaaccgaggccgatcacggtcgcaacctgcgcgaacggcgatgtgtagctgaggcctgcccagcccttggcgagggcggcgtgcggtacggcggcgatgaagaccacctggaccagcgtgtagatgagggcacccaggaggatggcgctgatgatggcgcgcgggacgtcgcgctgcgggttgcgagcctccccggcgagatcgaccgcctgacggaaacccagcagcgagaagacgatcccgccggacgcgaccgcgatgaacacgccggcgctgccgtagggcaagaagccgtgcgtggccggggccgtgtagttgctccagtccttggcgacgaacaagatcgcgaggatggtgagcgtcggggtcacgaacttgaggaacgtcacgaccgagttgatcttcgcgaacaccttgaccccgtagatgttgatcgcgaagaacacgaccagcaagatcgcctccacgacaaagtcgaggccagtgttgttggcgaacgctcggatgtagtgctctgcgtactggacgaccgcctcggcctcgatggcaggaacggccgcgtatccgaggaaggcgccccaactcatgatgaacccgaccagtgacccgtgggtgaagtgcgggaaccgcgtgatgccacccgcctcgggcaacatacccgacagctctgcgtagaccagcgcgatgaagatcacgatcaccgccgcgatcagccacgccaccaccgccgcagggcctgcgtagttggcagcgtacagcacgccgaagagccaaccggatccgatgatcgccccgagaccggcgaacgtcaggtcgatgtaggacatctcccgtcgtaaccggccccgccctccactgtggtcgctcgccatgcacaacctcccccgtgcgatcggcaaccttcggatctcgctccgaaggccgtacgcggacctgcccacgtacgccgcgaacgctagcagccgcgatgccgatgcgggatacggaatgcaacgaattcacgaaccagcaacggcccgatcgtgtcaccgtgtcctcgccgcccagcgagctatcgcgtcgacgctgcgtgttccgcgcaccgctggatcgggagcaggtgactccacccccgcctgaaggcggggacttcgggtgcgctgttcacgcacctgtggctcctaccgcaggaggaaccttggcggaaacgcctgccgccgtgcggcggcgactcgggccagaagccctgcccgcgctgtccaccgtgcgccccacggcaataccaccaccaacgagggcgatggcccgatcaaggatgttccgtgcggccaccgcgtccgcatgtgcggtatgaccacactgcacgcatgcgaacgatctcccgcaccctggcctgctcgctgggtctcggaccccgcatgcaggacaggtctggctcgtgcctgccggtggcaccgccacgagcagggagccgtacttcgggcacttgtagtccagttgccgacgccgctcgccaggagctatgtccaagatggaccggttgagtccggctttctgacggactctggtgccgggagcctcgaccgtgcccctggccgagctcgtcatgtgcttcacccgcaagtcctcgatggcgacgaggctgtggttcttggccaagtcgctcgtgagcttgtgggtgaagtcctggcgtctccgggcttggcgagcccggagacgtgcgatctcacggatcgtccgacggagtcggttcgagtaccggcctccgttgtgacgcttcgcgtaggtgagctggcgagccttacgccgttccaggccacggagccgacgctcttcgcctggggtgagcgtcgggggcatgatcctcggggcagactcgccagcgacgtaggcggcgcaggcaataccgaagtccacgcccaccgtgggtccgtcgttcacgggcgcgcggtgggtcgtggcgaggacggtgaagttcacctgccacacgccaccgagcagcggaacgtggccgaggcaagctcaccatcgagtgagcgcgagcgtcggaaccggacccaccccagcttggggaggcgcacttcggaccattttcggttgaggtggcggatctggagatcggaggccgagggccggaagcggagttggccgcgcctctcgaaggctggcttacgggcgcgtccttgccaccagttctggtgtgcccgatccacgtcacgaagtgcttgttggagaaggtgtgccggtggctcggccacccactcgacgcacgagcgcagttcagccagctcgtgacattgttcgcggtacgtcacctgcgccctcgctcttgaccacgccagttgccgatgctcgatggcgaggttgtgaatggcacggcgagtatgtgcccaggtggtcattctggctgcctggtgcgggctcggggagagccggtagctccgaccgacgtactcgcccacgtcaccaacgctcgtcagcgtcatacctgcaaggaggggctgttcgaggtagtgccctacgtcgagtaacagcgccgaccagcatgagagcgccgcttacctcccgcctcgaggcgggagtccgcgcggcgcgttgtggtcgccgtcactgcctcggcgatggactcggtccgaggcgagcggtcgctcgagcggcgagctgacggtggcgcgacctcgcggccctggacccccgggtgagggcaccgacgcgtcactcgagacggccgctggatgcctcgacgggtgcatcgagaccgaggtgcacgtatgcccggggcgttggcattcggcccctcggcgtgcgcacgatgaggccacgctggatgaggaacggctcgtagacctcctcgagcgtgcccgcgttctcccgcaccgcaacggcgagcgtcgaaagtccgacgggacgcccagggaactggacgcacagcacccgcaagatctcgaggtccacgcgatcgaggccgaggacgtcgacgccgaagaggtccaaggcctcgagcgcgagctcacggtcgatcgcaccgtcgccgcgcacctcggcgtagtcccggacccgacgcagcagccgattcgcaagcctcggcgtgccccgcgatcgacgagcgatctcgagcgccgcgtccggctcgatcggcaccgagagggtgcgcgccgcacgttcgaccaccgcaacgagctcgtcgtcaccgtagtagtcgagccgatagtggtagccaaagcgatcgcgcagcggcgccgagatgagcccgacgcgtgtcgtcgcgccgaccagcgtgaagcgcggcacgtcgagtcgcaccgagcgagcacccggccccttgccgagcacgagatcgacccggaaatcctccatggcgccatagagcagctcctcgacggcccgggggagtcggtggatctcgtcgatgaagagcacttcaccaccgtggaggtcggcgagcaacgaggcgagatcaccgatccgctggagcgcggggcccgaggtcacgcgcacaccggtgccgagctcgcgcgcgatgatgaaggccaacgaggtcttgccgagcccgggagggccggcgaacagcaggtgatcgggcgtctcaccccgaccacgtgcggcctcgagcagcacctccaactgtgccttgagctcccgttggccgatgaagtcggcgagacgctccggccgaaggctctgctcgagcgcccgttcgagcggatcgagcgcgatggcgtccgatccggctgcgcggcgtcctccggcccactcgcgacgcggactcatcgagccagctccttgagcgcccagcgcacctgggcctcgaagtcaaggtcgccggggcaccgccgcacgacggcgtcgatctcgcctggccggaatccgagttcgccgagcgcagcccgcagcgcggacacctcctggctcatgggcactcccgtcacgggcgcgaggcgcttcgcggtcggcgcaagctcgaggacgacccgcttggccgtcttcggtccgacgccggcgatcgcggtgagccgcccgaggtcctccgtggcgatggcggtccagagctcgtcaccctcgatcccgccgaggatgccgagtgcgagctgcgggccgaccccactcaccccgatgagcgcatcgaacgcctctcgctccgcctggctcgcgaagccgtagagggcaatggcgtccgcccgcacgatcgtgcgtatccagagctcgcactcatcatcgcggcggagcagcgtcgcccacggagcagtcacgtgcacttcatagccgacgccagcgacatcgatcacgaccggtgagcgcccggcgctcgccacgcggccgtggagccacccgatcatcgctcccaccgccgctgcgcgagccgcgtataggcgatcgccatggcgtcggcgacatcgggcggctgcggcggctcgtcgagaccgaggagccgcacgacggtccgctgaacctgctccttggccgccgacccgccgctggtcgccgcgttcttgaccgtgttcggggagatgtcgtaggccaccaccccacgccgccagagcgcgagacgaacgaccccgacgacctcggacaccgggagcgccgaggagacgttgcgcgtgaaggcaagacgctcgatcgccgcctccgtcggatcgaaatcgtcgagcacgctctcgaacccctcggcgatctcgtgcaaccgactggcacggcatgcccgtgccgccgtcgtcacgagacccgcgcccacgagacgtagggtatctccggtcgcctcgatcaccgcataccccaggcgtgcgagacccggatcgacgccgaggatgcgtagcctcgcctcaggcaccgacggcctcgcgaaccgcctcgagcagctcatcggagggacggaacgtgagtccagcccgcgcgatgtgcaggtagatcacccgctggtcgcgatcgagcacgaagacgctccgccgatagaagccgagcggaccgagcacgccataggaccgggccacctcacgatcggtgtcggcgagcagcggaaaggcgatcccacgtcgctggacgaagctctcgtgtgaatcgagaccttgcggcgagatcccccacatcacggcaccgagcgcgcgaaagtcatcgatggaggctgagtaggcgcgcagctgggccgagcacaccggcgagaagtcctcggggtagaacgcgagcacgaccggcgtcccgcgttgcgctcgcaggtcgtagcgctgtccaccggtgccggggagcacgaacggcggcgcttcgtccccgagcctcacctggctcactcggccacgaactcctcgaggagcgactcgggcatgtcgaagttcgccgtgacttcttggacgtcgtcgaggtcctcgagcgcctcgacgagcctgaggacccgacgggcctcctgggggtcctcgaccgggacggtggtctgcgggaccaactccacctcggcgctctccaccgcgaacccagcggcttcgagcgcatcacggacggcaccgagatccgacgccgcgacggtcacgagccacgcatcgccgtcgtcggtgaggtcttctgcccccgcggcgagtgccgcttggaacaactcgtcctcgtcagcgtcgcgcgagagacgaatctgtccgagacgctggaactgccacgacacggcaccgggctctgcgagcgagccgccgttgcgcgagaaggctgcccggacgtcggcaccggttcggttgcggttgtccgtcaggcacgacacgatgatcgccacaccacctggggcgtaaccctcatagttgacctgctcgtagcgagcaccttcaagctcaccagtgccgcgcttgatggcgcgctcgatcgtcgcctggggtaccgaggcgtctcgcgccttctgcaccatggtacgcagcgtcgcgttcgccgaggtgtcgcctcctccttcacgggcagccacctcgatctggcgaattagcttggcgaacagcttgccgcgcgccttgtcgacggcgcccttcttgtgcttgatcgtcgcccacttggagtggccggacatggtcctccttgctacccatacgtgcccgtcaccgggcaagcagagcttactcgtgccgcacgaggtgtcttgagatgtcctcgcggcgtgcgccaccccgcgcgaaggcgaggacatggagccgtgcatcaccgagcaactcagggtggaacgaggtcgccacgacgttcccctgtcgcacgacgaccggcacggttcgctcggatccatcggcgaactggtaggccacctgggcgaccacgtccaccgaggatcccacacgcgtcacgacgggcgcacgaatgaacacggcccgcatcgggccgccgtcgacacccacgacggtgagatccgcctcgaaggagcgcacctggcgcccgaacccgttccgtcgcacgtcaacgtcgagcaccccgaacgaccattggtcggggcgccctccctcgatgccacgagcaagcaagatgagtcccgcgcaggtgcccagcgctggcatgccctcggcgagcgccgccgccaacggctcacgcaacgcggccgcctcgatcagcaaggcctgcgtcgtcgactcgcccccgggcaacacgatcccgtcgacagcggcgaggtcggcgagacccttgacggggcgagctgcgaggcccgcagcggcgagagctgcgaggtgcgcgtctgcgtcgccttggagcgcgagcaccccgatcatcggctcaccaaccgcgctcggcgagtcgctcgtcgatctgatcgagaccgaggccgaccatcggctcaccgaggttgcgcgacaccgcgagcaccacgtcgggctcgttgtagtgcgtggtcgcctccacgatggcacgtgcccgcttggcgggatcaccgctcttgaagatgcccgagcccacgaagttcgcctcggcgccgagctgcatcgtgagcgccgcgtcggctggggtcgcaatacctcccgcgcagaacagcggcacagggagcttgcctccgagcgcatggacctcagcgacgagttcgtagggagcgccgagtcgcttggcccatccaaagagctcctccgggcgcgcctgggcgatggctcgcaggtcccgcgtgatggagcgcaggtgtcggaccgcctccacgacgttgccggtacccgcctcacccttcgaccggatcatcgccgcaccctcagcgatacgacgcagcgcctccccgaggttggtcgcgccacagacgaacgggacctcgaaggcccacttgtcgacgtggaactcctcatcggctggcgtgagcacctcactctcgtcgatgtagtcgacctcgagagcctcgagcagctgagcctcggcaaagtgcccgatgcgaaccttggccatcaccgggatagtcacggcgtccttgatctgctcgatcagggcggggtcgctcatgcgtgcgacgccgccatcacgacggatatccgcaggaacgcgctcgagcgccatgaccgcgaccgcacccgcatcctcggcgatcttcgcctgctccgcgttgaccacgtccatgatgacgccgcccttgagcatctcggcgagtccccgcttgactcgtgccgtgccgacttcgtactgggtcatggctcctcccttcgaacctggccgctccttgtgtaccagagtctaggagggccgtgtaccacacactcgctcagacgtcgatcggtcgacgtcgggtcgcccacggctcgtcctcgatggcgtctgcgcgcgccaggagttcgtcagcgttcatccccgtcgccgcccatgcccaccacacgagcccggccgtctcgcccgtcggctcctccgcgaggcggcgcaagagccgtgcgacgaccggagggtaccgagtaactgcacacgcgaccaggtcgagctcccacgcgagcgcgctcatccacgggcggcgccgaccgccaccgaggatccgatcgatccccatcgcgagcgacaacggcccgagcaatccaagcctccacgcggcgagcgtgcggaccactagcgcctcgagttcgaacgacgacgcgagccgtaccgccccggcggtcagcacgacgagcggctccccgcgacggccacggaccaaggctgcgttcacggcgtcgccctcgatcaccgcaacctcggtggctccgagcccgagcagcggctcgaccccctcgacgatcgaggcgagccgcgcctcgtcggatcggctgagcgcggctcgcctccctcggggcttccggggcaccatggcgacgaccaacaccacagcggccacgatgatgacggccaccaccccaccgagggcagcggccatggcggtgagccctaggagcgctcccacgacgcccaccacgacaccggcaccgatcgcaaccgcggcaagacgcgcgagagcccccgtgagcaccactcgacgccgcaacggccgccgcacaccccacagctcgataccacccgtgttcacgtcaccgacccctctcgactgacccgctcgacgagctcgaggtagcgacgagcaatcgagccgatgtcatgggcgtgtgcgcgctcgtagcctcgtgcgacgagcacacgccgacgatcgcgatctcccactatcgagcgtattgcgccggcgagcgccgatggatcgtttggctcgacgagcacccctgcatcggcgacgaccggccggtagccctcgattgcactcgcgaccaccaccgctccccgcgccatcgcctcgaggagcaccacaccgaacgactcgccgccaagcgacggcgcgacgaggacctcggcctcccggtaggcacgatcgagcgtcgcgtcgtcgacgcggccccgccacgtcaaccaccccggccagcgctcggcagctcgacggacgagcggggcgagcgggccgtcgccaacgatcacgaccgacgacaccgagtccaccagcatcggcagggccgcgagcaagacccgaatccccttgcgctcctcgaggcgcccgacgaacgcgacggagccgggcctgcgtgcctgatcatccggcaccgcttcgggcacgctgagcccgttcgggatgatctcgatcgggccgggggcccatgcgcgagcaaccatcgctgccgatggcgagaccgccgtcgcgacgcgtattccccgcgcccccacgcgaccaacacctgcgagcagagccctgccaaccccacgcggcatccctgcgcggtgcccggtcgcgatgacagggatgctcgcccgacgggcgagggcgatggtcatcggtccgaccaggggcacgagcggctcgtggaggtgcacgaccgtcgcgcctcgcatcgctcgcgacagcgaccggaccatgcgcagatcccagccgatcggggcacgggacccgttggcagggacccgaaccgaccggccgagaccgccctgcccaggtccgaccagatccaccgacacccccagctgcgagagggcgcgcgtgagcgccgcggcttggcgctgcacgcctccgggaacgtcgaggtcgtaggggcacacctcgaggactctcacgaggtccgcctcacgtcgtcacagtgcgagcatcggcgaccaggttgtgccattgactcggtgcggcctggatctggcgctcgagtgcgcgcaccacccgtcgatgaagctcctcgatgcgagcctctcgtgacccctgcgtcggcggcatgatcggcgcccagatccgaatcaggtgcctccgtcccggcagctggtagcacgccgccgggtagaccggcgctcccgacaacaccgacagcaccgccggcccggctgccaccgagaccttccgaccgaacagttccccgggacgacccgaaccggtgacgtcgcgatcgaccacgagcgcgacgcgcccaccttcccgtagggtgcgcaacagagcccgagttgcctggacgccggtggggacgacgcggatgccgagcgcatcacgcagtcgatcgaagaagctcgtcaccgacgcctcgggaagtcgctcggccaccgccgtgacgggtgcgccggcggccgacgcccacaccccggcgacgtcccagttgccgacgtgcgccagggcaacgatgcagccttcaccgcgcccgaccgcctccaggaatgcctcgtggcccgtcacctcgacgccgtcgagcagacgcgccatcgcgtgaggggctcggagcgtgtcgacgtagtagcgcgcataggacacataggcccgaagcgtccaggcgatcgcccgcggatcgctcatcgggcgtctccgcgccaagcactggtgctcccaggcgatacgccgccgcgatccggtcagcacaaaggcgatcgccccaccgacccaccagacgatcggatcgagtcgccacggcagccgtcgcaccaacgcagaggcgatctcgaaccgtcgagctcgcagaccagcgcgcagcgaccttgcggtccgcaccgcctaacgcgcgtcgcggcgccgccgacgccgagcagtggtcacttcccgcgacccgagcaaaccgctcagacgcgtccgcagccgcgcccgccgccgccgattctcgcgtcgcagcgcgacgaggcgctcatgggcacggagccgatctggctggcccgaagccgagcgccagatcctgacgaagcgctgtgcagccgtccaggtcgacccgaggagcagcacccacaccgcgatggggagcagcgcccacacggcgatgccgaggaggaggacgaccgagcgctcagcgcgctcgaagacgccacccttggcctggaaaccgagcgactccgccttggcgcgctggtacgagatgagcgacgccgcgagagcagcgccgaaggccgccacgccaagaccaggctgatgctcgacgagcaccaaaccgaccccaagtcccccgaggaccgccgcgtcgctcacacgatccgagaccgagtcgaagaacgcgccgcgacgggaagcagccccactcgccttcgcaacgggaccatcgagcaagtctccgaggaagccgacgagagccagtgcaaggcctacccagcgtgcgccgaacgcgagcgcgaggccggcaccgatcgccgcgacgatccctgcgccggtgagcacgtctggtgtgatcccgagccgcgcgagctgacgaccgaccggcgcggtcgcccgatcgacttgccccctgaactctccgtccagcacctccggccactccttgcgatcgcccatccgatgtcgtcgtcgctgcaacgcatctacgctcggacaacgctacggcgtagcctaccacatcgcctccacccgcctgtgctggtcgcacggggcgtgctatggtgggccagctgcatcgacagcttgggaccgacgggaggtgccgtggacgccactgtcgcagcgagcccgcgtgctcgcatcatctgcgtcgtcggacctgcgggcgtgggcaagaccacgctcgtgcaggcgctcgccacgctccagtctccaccgacgcgcggcgacgacgatgcccgcgcactgatcgacacgtcgccggaagagcgcgcgcaccaccactccgtcgacctgggcgtcgtacgcctcgagcaccgaggccacgcgatgaccctgctcgacgtccccggtatcggtgagctcgccgctgcgcgggcacttgcactcgccgtcgccgacgcagcgctcgtcgtggtgccacccagcgacagccccagcccggagctcctgcgcatctggcgcgagctcgacgagcgccaactgccccgcttggtggtcgtcaatcgctgcgacgacagccgctgtgcgatcgacaccgtcgtccgtgccctcaacgagcgcctcgaggcccatctcgacgccgtcgagctcgtcgccatcaccgccgacggccatcaggacctcatcgacgtgctcgcggaggcgtccatcgtcggcatcggcactgacgagcacctcgaaccgctgcccgaggtcgagcgcgagttcgagcgccaggcacacgacgccttgctcgacgacatcgtggccgaggacgacgccctcctcgagcgctacctcgccggtgaggagctcgacccgaccgagctcaacgctgcactggcgatcgccatccgcgagcggcacctgacccccgttctcgccgcgtcggcgaccacgcgtctcggcctcacccatctcctcgacatgctcgatgccctggtaccagcgtcgccgacgccaacggacaccacgagcgcgctggtcatcgccacaagctccgacaactttcaaggtacgtccgcgacgctcgccatcgtccgcggcgccatccggcccgacagcgtcctgcgcgactcggcccaggaccgcacggagcgactccatcagctgctctggccgaccctgcccaagcctacgccgacgacggaggccgccgcgggtgacgtcgtgatcgcccccaaggtgggggccgcggtggggacctggctcatcgatcctgctggccacgacatccccgatccagtgcagcgcccgacaccgacctacacgctcgccgtcgaggttcccgaccagcgcgccaacgacaaggttcaagcagctgccgctcgcctcgccatggaagacccagggctgatcgtcagccgggaggcagagacccaccgcctcttgctcaccggcatgggggcgacgcacttggctctggtgatcgagcgactcggccgccgcagcggagctgcgatccagacggtcacgccacgcacgccctatcgcgaaaccattgcgggcacggtcgaggtggaagggcgccacaagaagcagaccgggggccacggccaatacggcgtcgtggtctgccgcatcggacccggacctcgtgcgagtggcgtggtgttcttcgatgagatcgtcggcggggccataccgcgaaccttcattcccgcggtcgaggcgggcattcgggaggcgtgcgagcaaggtggtccgcatgggttccccgtcgtcgacctcgaagtccacctcatcgacggcaagcaccatccggtcgactccaacgagctcagcttcaagcttgcaggggcgctcgcgctgcgcacggccctcgagcgagcagggagcgtcgtcctcgaaccgatcgcacgtgtgcacctcagcgtcccggcaagcgcacagggcgacgtgctgggctacgtgacgtcacgccggggtcgcatcatcgagtccactccggtcgggccgagcgtcgagatcgaggcagaactgcccgctgccgaactcacgcatctcgccgtggacctccacggcctgacggcgggccagggatcgttcacgagcacgcacgaccgctacgagcccgtcccaaccgcggtcctcggacgcttgctcagcgcgacatccaagtgacgccgccctacggcccgactcggcactccctccctggcaactcacggtcgacgaccacacctctgcaccccgtacacccgagaaccgtgcgttctgcggcgctcggagagagcggtatcgtgaccaccgatcctcccttgcccaaaggctgtgatcgagtcggggcacgccacggtgagctggtgcgactcggtggcggcagccggacctcggagtcgctcggcaagcatgtcgccatggccgcaggcagctggcggtggtggctcgtcgagccaccaccgggtgcgtaccactccggccgacgtcggcagactcgatgaacgcacgcacagtcagagggccagtcgtgcgcgccgcgatccgctcctttcggcaggggtccatccgctccagtgaacgacgaggtcccccgcacggctcacgttggcctttgcacgcggccttcacgacgcgcgggagcacctccgctccaacaagccgagagcgacggcggcttgcacgcgggcgatcggctccgccacgacgctcaggcctcggctctggagggctctcacgaggtcacgctgcgctccgctctcgttcggaacggcactcgcgccgtccgacacctctcggcacgttctccgcgacggcgaccacatggagctcatgtggccccaacagatcacaccacgcggatcggtgactcgacaagggacgaattacccagcgttgtcgatcacctcaatgcgattcccaaaggggtcgtcgacgtataagcgccggactcccggaaggtcttcgtcccaccgccaggaagcgcccgacgcttcgagcttcgcaacgagatcgtccagctcctccactcggagggcggggtgcgccttgcgcgccggcctgaaatcctcctccaccccaagatgcagctgcacgggcccgcacgcaaaccagcggccaccacgagctgcgagcggctctggcttcgcgaggacagtgaagccgagtacgtcgcggtagaacgcttctgcctcgggctcgcgaccggctggcatggcgagttggacatgatcaagggctacgactcggacgcccacgacgtgaatcctcccacccacgctcgactcgtgccgcgcccggcgccaagcgctcatcaccgctcgcgaccactgacgccgagaacagctggacgcctccttcccagaggcagcctcagacaccgcagtgctcgtcctgtcaggtgccaagcccagcgaggcgttgtgcatgccgggcaccgacgtcgatctccatccgtcgtgccactcgcgaccacatcccgcgaggggtcgtccccaggtccgcgcctcttccccagagacaccgtcgcggacgacgagcgtcacgacccccgcggccaccgctcactcgagcggcgcgcgcgacccacaccactgctgcgagtccagaaggccgatcagctcacggagcaactgccgtactcgggcccggcgccggcgtcactacgagctcgccggccacgcgcggcgcaaccgatcgcgcgtgtccccgagtgcctcggggaggacccgtgtctgcgcggcggtcaccatgaagttcgcgtccccgacccaccgaggaacgacatggacgtgcaggtgctcgacgatacccgcacccgatgcccgaccaagattgaggccgaggttgatgccctggggatggtaggcgctctccagcgccgccattccctcgcgcacgagctcccacatctcgccgagctcctcgtgcgagagcgcgccgaggtcgctgccgtgccgccgcgggaccaccatcaggtgccccgacgtgtacggatagaggttcagcacgcagaaggcacgcgcgcgacgagcgaccacgagatcatcggccccatcggccccgtcgccgatcgcgcacaggacgcacccgtcgaccgccggagcaccctgcgtgacgaacgcggagcgccaccccgcccagaggtagtccatcacggacgcacctccgccatggcgaccgctcgtgcgatctcgtcgatcgccgtctcgagcgcgacgccgcgggcctgcgaccgatcggggcgcgtcagcccgaccgaatgcgcagcgacgtcatcgttgcccacgaccacgatgtaggggactcgctcggtccgagcacgtcgcacccgtgccccgagcggttcgtcggccgcgaccacctgagccccgacgcccgcagcaacgagcgcagcacgaacctcctcggcccagccggccgcctcatgagccaccggcaaaatgcggaccggttcacgcacgagccacggcggcagctcaccatcgaagtgctcgatgaggatggcgaggaagcgttcgacggacccgaagagcgcccgatgaatcatgaacggacgctccatccggttgtcagcgccctggtagccgaggtcgaagcgctgcggcaactgcagatcgacctgcaccgtcgagagctgccagcgccggccgatcgcatcacgcaggtggatgtcgatcttgggcgcgtagaacgcaccctcgccctcggcgacccgataggtgagccccgaccgctccagcgcgctccgggcggccgacgtcgcgaactcccagtcctcgtcgctgcccacggacttggcgggccgcgtcgacagctcggcctcgaagtcgttcagcccaaaggcgccgagcaggcgcatcgcgaggtcgagcaccccggtgagttcgtctgccaactgatcgccgcggcagaagatgtgggcgtcgtcctgcgtgagcgagcgcacccgcgccaatccgtgcaaggtacccgaacgctcgtagcgatacaccgtggccagctcgaacagccgcagcggcagttctcggtagctacggggatgctgccggtaggcgaggatgtgcatggggcagctcatcggcttgaggaagtactcctcgtcgtcgagctccatcgccgggtacatcgactcgcggtaccagcccaggtggccagagagctcgaacaaggcgccgcgcgtgacgtgcggcgtccacaccgggacgtagccggcggcaaagtggatgcgacgggagaactcctcgagacggtaacggacccaagccccgtcgggctcgaacacggggagaccgccgccgatctcacgagggaagaagaagagccgctgctcctgaccgagccgacgatggtcgcgccgctcggcctcggcgatctgcgtcagccacgcctcgagcgcctccggggactcgaacgccgtccccgcgacgcgctggagccgtgggccgtgctcgtcgccgcgccagtacgcgccagagaccctgagcaggcggagggccgagagatggccggtagagggcacgtgtggccctcgacacaggtcgatgaagtcagcacccgtgcgatagatcgagaccgcagagcccgaagcggcatccgtctcagcctcgccagcggcgatgcggtcgaggatctcgagcttgaacggttggtcggcgagctggcgccgagcctcgtcgagctcgagctcgatgcgctcgaagggttcgtcggccgcgacgatgcgttcgacctcggcggcgatcgcggcgagatcgtcgtcgtcgagactgcgtcccccggggagctcgacgtcgtagaagaacccctcctccgtcgccggtccgacggcaaggtgcgtacccggccagaggcgcgagatggccttggcgaccacgtgcgcacccgagtgacgaagcacctggcgaccctcgggtgtcgaggcagccacaagggtcgcacccggaccggctcgatcgagatcaacgagctcgccgtcgtccgagcgcgccgcgaccggtcgagtggggtcgacgaaccggctcacagctcgaccccgagcatccgtgcggcctcgctcacaccccgacccgctcgagccgcccggtcgatggcctcgagtgcacccggggtgtcgaggtcgttgtcgagcgccgcgtcgacctcgtccacggcaccgtccccggtgccggctgcgcgccagagcccatagcgctctcgcgcctcctccaggagcccacccgtccagtcccacgacgtccggtagtgctgcgacagcaacgcgagccgtaccaccgcagcgggcacttccttgaggagctcgcggacgaacacgaggttgccgagggacttggacatcttgacgccgtcgagccgcaccatgccgacgtggacccagtggcgcacgaagggttcgccggtgatggcccgcgactgcgccgcttcacactcgtggtggggaaagatgagatccgaaccaccgccgtgaatgtccaccacggggccgagctcgcgcatggcgagcgccgagcattcgatgtgccacccgggccgacccggaccgaaccgcgactcccaggcgggctcgtcggccaaggacggctgccacaacacgaaatcgagaggatcgtgcttcctgggatcgtcgggatcgccgccacgctccctggcaagtgcgatcatggtgtcccgatcgaggtgggagatcgatccgaacgtgggctcgctcgccacggagaagtacacccatccgtcgacctcgtaggcgtgccccgagtcgacgaggtcctgtaccagggacaagatctccgcgatcgccgaggtcgcgcgtggctcgaccgccggccgtcgcaccccaagggccgtcatgtcctgatcgaactgcgcgatctccatcgcggcgaggtcgaggtagttggtcccgagctcgcgcgccttgcgcaagatgtcgtcgtcgacgtcggtgacgttgcgcacacagcgagcgcgctgccgatggcgctcgaggtgtcgtgcgagcacgtcgaaggtcacgtagaccgccgcgtggccaaggtgcgcggcatcgtagggcgtgatgccgcaggtgtagatcttgatctcctcgcccggtcggagctctaggtccacgacccgttgcgcttgtgtgtcgtagatcctcattggccgtcgtcctccctgatacccaccactcgcaggctcgacctcgcgcgatagcgcaggttcacgttcagcagcaccgcggtcatcgcctccagtgcgccggccgcggcgagcgaaccgacatagagcgctcgcagaccgtcgatgctcccgaggagctccatgacgacaccagcggagctctggaagtccgaggccaccatggtgtcggcgtgcacggggcgcccgagctccgcgagatcgcgggccggcacgtggtgcagcgccgcgaccaccatcgaccgcgggagcgtcgactggaggagctgggccaccgatccgcgaggcggtgccagcgctgcgaactccgatcccgtacgcaccaacgcattcgcgacgcacaccacggtcttggccgcaagcgcctcggcgaactccgccgcgacaggcacgacgctctcccagggcacggcgaccacgacgagatccgagcgagcggcaagctcgttaccgcccccgaccagaccatcggcgagctggggccagcgatcgccgagccgactcgccgactcttgcgcgcgctccggattgcgcgagcccagcacgaccgtgcggcctgcctcggcgagtcgagcaccgagcgcactgccgagcggcccggtcccgccgatgatgccgacatccacgaacgcccccagagtcccatcacgaggacgccgctggggcaggactcgcaggccccaagcggctaccgtaggtccgagtctacggtgaaggagatcacatgggcatcctcgagggcaagcacgtgctggtcactggcgtcctcaatacctcgtccatcgcgtaccacgtcgctcgagtcgccatcgacgagggtgcggaggtctcgctctcgagcttcgggcgcgccatgtccatcacccgacgcgtcgccgagaagctcggcatctcctccgagatcatcgagctcgacgccgccgatcccgcgagcgtcgacgcagccgcagccacgctcggcgagcgacacgaccgtctggatgcgatcgtccactcgatcggctatgcgccgccgagctgcctcgacggccccatgctcgatgccccgtgggacgacgtcgcggtcgcggttcgggtgtcggcgtactcgctcgccgagctcgctcgcgccttccgaccgatccttcgctcgggcgaccatcccgccatcgtcggcctcgacttcgacgcgacggtggcgtggcccggctacaactggatgggggtcgccaaggctgcgttcgagtcactctcgcgctatctcgcacgcgagctcggtgccgacgggattcgcgtcaatctgatctcggcgggcccggtccgcacgatcgcggcgaagtccatcgacgcgttccgctccttccaggacagctgggccacgcgcgcaccgctcggctgggatccgaacgacgccaccccggtcgcacgcagcgtcgtcgcgctctgctcagacttcttccccgccacgacgggcgagatcatccacgtcgatggcggctaccatgcgatgggtgcctgagggcaccgagatcgctgcggctcacgtggccctgggcgttccgcccgacccaaccaggaggtgcaccgatggtgcgcatcccgagcacgctcgccagctccttcgcgatcgcagcttcgcttgccgccgcgagcgcgatgtcgttcgctcagccggccggcctccgcggcggtcagagcggcaacggctggaccgtcaccgcgaccggcgcgtcatcacacacgacccccactgggccgaaccctggcctccagcccgtctactggccggtcctcgtcacgcacacgggttcgtcgctcgcgacgagctgcgtcgaggtacgcacgctcgacccgggcgcgggatcgtatccgaccgtgctccaggcggccgaggccgcatgggcgcatcttgccggcgtacctcgctgtgatgcgagcgggccgtcgccgtcggccatcgtcaccctctggaccaggaccctcgcggcgacgctgaccccgccgagcgccgctgtctggccacccagggggatcgtcggcctgcccctcgaggtcacggtcgccggagcgaccactcggacgttcaccacgcagacccctgcgggacccctcgtcatccgggcgaccggagcactcgcggcgcagctcggttcagcctcgatcaccctggcgagcggcgacgccacgctgaccccggacgtcgtcggtagcgtccgcctgctcccgatcgagacctgggacgccgtagcgaccctcgggacgaccgagctcgcgctgcccgccgtcacgatcgtcggcccagccaagctcgtctcgatcgccgcactgcacgccgagctgcgcagcctcgcctagcgaacgcagcgagcgccaaacgagccgtcaccgacagcgtgcccgcacccgaggcaccaccgacgagtggccttgtctggactcaagcgctactggtcgtcgaggtcgtcaccgtggagcgtcgaggcctccacgtgggcgacgggttccgtccccaaccggcccgcctgatagtcctcgaacgcttgacgaagctcagacctcgtgttcatgacgaacggcccgtaccacgcgatcggctcaccgatcggggtgcccgcgagcacgaggacctgggtccgtcgcctcggggctgcgagtacgaccccttcgccctcgcccatcaccgcgagatgaccagcctcgacctcgacgcggtcctcgccgatcagcgccgcgccgtcgaagacgtagagcaagcacgtgcgcacggcaggggtcggaatccgagcctccgcaccggcctcgaggatgaggtgagcgaccgtcaccggccagtaggtgtcagccggacccgagatgcccccgaggctgccggcgaccaccttgaccagcgcgccgccatccgcgctctggccgatcccgagatcaccgcctcgcacgtcctgatagcgaggggccgcccacttctgccgtctggggagattgacccagagctggaaaccgtggaagacgccaccggtcacgacgagccgctccggcgggcgctcgatgtgcaagatgccgctcccagcggtcatccactggatgtcgcccggggcgagcgcaccaccaccgccgaccgaatcggcgtgttcgaacgcaccctcgagcagataggtcaccgtctcgaagccccgatgcggatgccagggggtgcccttgggctcgccaggaccgtagtcgacccgtcccatctcgtcgaggtggatgaacggatcgagttcctcgagtggcacgccagcgaaggcccgcttcaccgggaaaccctcgccctcgaggcccgacggcgcggccgtgagccgcacgactcggcgccacggacccgtcgccctcaccagcacgtcagctcgcgtcacgttcgtcatcgggcctcctttgttgcagatgcaatcatagtcgctcgtgacggacgaggagggctcgcaccgctgcgacgtcctcggcgcggggaccgtcgcccgctcccgggacctcgagcaccacatcggcctccggcaggcgccgatcggcgacgagcgagcagagcgcctcggctccgatcgccccctcgccgatgttcgcgtgacggtcgcgccctcgaccacgctcactggccgaatcgttgcagtgccacagcgccacgggcacctgtgccgcctggagcgccgtgacgatctcctcgcgccccgcggcttcgtcgatggcccagccgacggcgaacaggtgctgggtgtcgagacacacccccacccgcttcgtccggagggccccagccagggcccccagctcggccggaccggacgccaccgaacccgtcgccgggttctccacgagaatgcgaatcgtcgacgtcgcctcgagcacgcgctcgagcccctcccggatccgctggcgcgctgcatcagggtcgtcaccaggcgcggagccggcgtggacgaccaccgactcggcgccgatgccttcggcagcgatcgcggtctggcgaagcaacgccagcgatcgatcgcgcagcttcgcgtcgacggaggcgaggttgatcagatacgacgcgtggaccacgatccgttcgacgccggctcgctgcgccgcctcgcgcaccacatcaggctcgggcgccacgccgacggaccaccgccacgatcgaggggagcccaagaagcactgcgcaacgctcgcgcctcgctctccggcgcgttcgagcatcttgagcacaccgccagcggccgacacgtgacagccgacgcgcaccgtggcgaacctcccctgttgcaagtgagccctgttgcaagtgagccctgttgcaagtgagccctgttgcgagtgagccctgttgcgaccgggccctctgtctgggtccctccgtcttgctcggcgctgctaatcctcgcgaccgaactcgggcagctcgaccgtggtcgccgaacgcggcgactcggtcgcggccggcttcgaggatgcgccctcaccgaagaggtcctccagcatcgacagaccgtcatcgcgtgtcgtctgctcggcgcccgcgcccgcctcgtggcccgttggccggtcggccgtggcagcccccgcctcgtcaggggcgacctcggcccccgtgtccttggggccgtcctcagggctgtcgacatctggctcgccagccgacccgccggaccgagccccaccggcggcctctgcggcctcggcagcgagaccggccgcgtccttggccagcagggacccatcggccaccaggtcgtcgacgacggagcgagcgtgacgggcgagttcgcgcaagctgccctcgatcctgcccccctccgcctggagtcgctcgatcacgccggcgaggcttgcggcgagccgatcgctccgcgcacgcacctccgcggcctcacgctcgaaccgcgaccggaactcctcctccagtgccgcagctcgcgccttggcctcgtcgacgacacgggccgcctgggtcgccgcctcgcgccggagggcctcggcctcggcctcggcgtcgcgccgcaacgtctgcgccgtctcctgcgcgagtcgtagcgttcgaccgatcacgctgtccggatcgaggtccacctccacgccagcggcagactcctgggaacgctgctcgtcggcgagggcaaggcgtgcctcgagttcgcgaatccggcgtcgcgcgtcggcgagttctcgctcgagcacctcgacgccctcggccacgcgctcgaggaacgcatcgacgtcatcttggtgatagccgcgcatgcgttcgcgaaactcgacctcgcgaatcgcacgcggattgacgacatgctcgtccatagcgactcctgtttcgtacggctgcgggcgtctcgggccagagcgcggcggttaccgagcgatgatcgggatcaacaggagctggatgaccaagatcacgatgagcggagagagatcgagccgcacccctccgccaccgatggcgggcatcacacgcctgatcggcccgagcaccggctcggtaagccgcccaagaatgatgcggatctcatggagcgtaccgccgggattcgttaccgggaaccagctcagcacgaccgagagcacgatgatgatctcatagagctccagcaggtcgatgagcagtcccctaactcccatgctgtagtccggcccctctctgaacggtccgctgtcgcatccggaacatgtcctcgtccgcaacctcgatgcgcgctggcgacaggaggtagacgctggaggagatctccttcaacttgccaccaagagcataggcaagccccgcggtgaagtcgatgatccgacgccgaagctccttatcgactccttcgaggttgatgatgaccggctgatctgccttcatgcgatcaccgatctcctggacgtcggcgaacttcgtcggcatgacgagatggatcttcgcccgctcgggctgagcactcaacgtccgcaacaccggttgggtgcgttcctcgtgctcccccgcatcctcgccctgacccatcagcacctgcaccttcggtgttcccacggtactcaccggctccgtgcgcagccgccggtccgactcgacgacgtccctgtcgaaccctccagagatggttccttccatctcctcatcctcctcaaccacgcccaaccaggcaagcgcgcggcggaacccgctcatggaacctccactccctccgacgcgctcaggttagcacgtgaaccggggcgagggccgagcaaagcggtccccaatcgcaggattgtcgcaccctctgtggttgcccagcgccaatcagcgctcatgccaaacgagcgctcagggagctccaactcgtccgcaagggccacgagcgaacggaagaacgtccgcaccggtgcttcctcacccggcaacgcgacacccatcacgccgacgacacgcagaccaagggatcgagcggcggcgaccagctccggagcgccttctcgcggcacaccactgcgagtcgccggagcgtctggcggtgccacctgtacgaagacctcgccgtcgaagccgagggcggcgagacgttccgcttcgaccactctcgagagcgtctcgaccacgctcgcagcaccactcacctgcttgatctggcgacgctgcaagtgaccgatgaagtgccaccggacgtcgagatcgcggagcgcggcggccttctccgcgagctctgacgcgtagttctctccgagctcccgattacccgcctccacggcggcgcgcaccgtttcgaccggatgggtcttcgtcacgcagacgatgcgaggcggccggaccggagcgagcgtggccacctcggcctcgatggcgcgacgccgctcgcgaagctgctcgacgaggttcatcgacccggcccgacgaggagcgcttggcgcgcagacgtgcgatcccgccgccaggagtaccaccgctcctcgtggatggtacaggcctcgagatcgacgatctctccgacaccgacacgcccaagctggtcgcggatcgccgccgtgagatcgagcgtcggacctcgaaagtactgggggccaagggtggtctcgacctcgctgcgagcgggcccgacgaactcgtagcagcatgcccgggcgtgcgccccgatcaccgcgacccggacatcgccgccgagcccctccgctgccctctcgacgatccggccgaccacgcccggccaaccggcatggaccaccgcggcgtcgccgttgcgtgcggcgaggaccaccgggacgcagtcagccgatcgcacgcccgcaacgagctgatcgccgactcgccggatgatcccgtccgcgtcgacgccccgacccacctcttgcgcctcgacgaccgccgtgccgtggacctggtggacccacgcacacggcagctcccagccgaacgcactcgctcgtggccacagctccgcggcatccccgtcgccacgctcggtctggaccactcgcagacgcccatcgagcagactcagctcgatcacggtcgtctacctcagaaagaaaggaacgtccccgtcgtcgtcgtcgggatccggctccggctcggccacgacctcacgccgcggagtgaacgtgagcggtggcagctcggcgtcgtccacggcgacgcgacgcgtcgcgtcgctctccgaccaggtgttgaacccggccgcgatcaccgtcaccttgacctgatcttcgagggcgtcgtcgatgaccgacccgaagatgatgttggcctcgtccgaggcggcagcctgcacgatctgggccgccttcgtcacttcgtgcagcccgagatcttgcccgcctgcgatgttcatgaggatgcccttcgccccgtcgatcgaggtctcgagcagcggtgagttcatcgcctggcgcgctgcggtctcggcgcggccatcgccgcttgcctggccgatgcccatgatcgcggtacccgccgagcgcatgatggtccgcacgtcggcgaaatcggtgttgatcacaccgggagtcgtgatgagatcggtgatgccacgcacccccgacagcaagatgtcatcggccatgcgaaaggcctgcacgagcgaggtcttctcgttcgcgatcgtcaggagacgatcgttcggtatcacgatcagcgtgtcgacgtactcacgcagccgactgatcccatcctcggcctgctgggcacggcgacgaccctcgaacccgaagggtcgcgtgacgaccccgatggtgagcgcaccgagcccgcgagcgatctccgcgacaaccggcgcgccgccggtccccgtcccgccgccctcgccagcggtaatgaagaccatgtcggcccccttgagggcctcctcgatctcctcgcggtgctcctcggcggcctggcgcccgacctcggggtccgaccccgcgccgagccctcgcgtcagctgtcgaccgatgtcgagccgcacatcggcgtcgctcatcagcaacgcctgcgcgtccgtgttgatggcgatgaactccacgcctcgcaggcccgactggatcatgcggttgacggcgttgccgcctccaccaccgaccccgaccaccttgatcaaggcgatgtagttcgccttcgcgtccaccacgttcctcccgccgccgttggcccctcaatcccccctacgctaccgtgcccacacggaccgcttagccggaacgcacgccaaacgtgccggagggtccaagggcgagcacgttggccccgagggccacgcccacgcctccgcttcccaccaacgcgccacagctcacgagctccccggcgaccagagcgggggccggcccgagcacgcacgaggcaccggacgccaagaccgcgacgacccggccgccagcgctcaccacgcggcgcactccaccccgaaccccgacgacgaccgcacgtgcggcgaccgggccgacatcactgccgacggggggagggcacgcaccgcccgagcacagcgcaagatgaggctcgacggacgacgccaccgccggcacggccacgacccgtcccgacgcgagcagcgcacggccctcaccgagcgcgaccacgcccgttcgggcgcgcacgcgcacgatcacaccgtccggcaacacccgtcggaccgcgaccaccgccacgatcgggcgctcctcgcccagcatggcggcgtcgaccgccggcactccgagcacgagcggcgctccggcgagccgcgcgtcgagcgtccccgcgacggcgcggtccatcgcctgcccgagcccttcgacgcgaacccaccgaacccgcatccacggaccccacacgacgctcaccgcggcgccgacgcccagggcgagggccgtgagtccgatcaggactcggcgccggatgcgcctcgatcgttcgcgtcgtgcgtcgtcgagtcggtaaatccgacgagacgcacctccgtccgcagctcgactcccacccgacgagcgacttcggcgcggacgaattccatcaacgctcgcacgtcgtcggccgagccccccggatcggcctggatgaagttcgcgtgcttcggcgacacctcggcgctgccgaggcgataccctcgaagacccgcctcgtcgatcagcttggctgcgggagcctccggcgggttcacgaagaccgaccccgcgttgtgaccgcccggctgatgtgcgcgtcgccatcgcaccacctccttgatcatcgcctcttcgtgggcacgatccccgcccgccaactcgagctcggcctcgagcaccacctcggtgggaagcagcgcactgtggcggtagccgaactcgagcgcctcgcgactgcgtcgtctgatctggccgctcgcgacgtccgcgacgaccgccgagccgagcaccgccgccatgtctccgccgtggccccccgcgttcatgcgcaccgcgccgccgacactccctgggatgccgaccgcccaggccatacccgcgcgaccgaccgcggcgagtcgtcgggccgcgacgggcaggagcacggcacctccgaggatgaccggaccgtcgctcggggcctcgatctcggcgaatccggcgccgagctcgacgagcagcccgtcgaagcctcgatcggcgaccagcatgttcgatcccgcgccgaggacgaggatcggcaccttcgccgcacgaacgagcgcagcgatcgccgcgacatcctcgacccgctcgagcacgacgccccagcgagcgctccccccgacgcgataggtcgtccgcgcacccaagggaacctcacggtgcacctcgatgccgagctcgccgccgagacggacgagatcgctcacccgagcaagtcctcgagctcgctgtcgaccatggtcacgtcaccggctcccatggtcaggaccacgtcgcccgggcgcacgacggaggcgacgaaggcagccagcgcgccacgatcggcgacccagtgggcgcgctcccccagtcgctccgccgcggctcgccagacgacctcgccgctcacccctgggatcggctcttcaccggccgcatacacgtcggtcacgacgacctcgtccgcatcaccgagcgcccgaccgagctcgacaccgagcaacttggtccgactgtagcgatgaggctggaagacgaccacgatccgaccggagcccagctgacgcgccgcctgcagggtcgccgtgatctcacccggcagatgggcgtagtcgtcgatgatccgagcgccacggagctcgcgcttgaactggaagcgccgcgcgacgcccacgtagcggcgcagcgccaacgcgacggcgtcgaagggtgccccgacgctgagtgcagccgccaccgccgcggcgccgttgcgcacgttgtgcatcccgagcacgccgagctcgatactgccgaggcgccgatgatcgaggaagcactcgaacgccgaatgggtcggcgtgaggacgggattgcgaatctgcagccgcgctgcctcggcgacaccgtaggtcagggccccctccggggcgagagccgccagccgtggatcgtcgacacagatcaccggtgcgagcgcgctgccgccgacgaacgcctcgaacgaggcgaccagcgcgtcgaagctgccgtagtggtcgaggtgatcgggctcgaggttggtcgccacggcaaggtgacggtccaccgcgaggaaggtggcgtcgctctcatcggcctcgacgacgaacaacgacccgatccccgcgtgaccggacgctcccgcctcgttgagctcggcaccgatgacccagctcggtgcgaggtctgccgcctggagcgcctgggcgatcatggccgtcgtcgtggtcttgccgtgcgtacccgagacggcgacgacctgcttgcccgccgtcagcgccgcaaggagctccgcgcgcgacagcaccggcacgcctcgggcgcgcgcagcggcgagctcgacgttggacgacggaatcgcggtcgaggcggcgacgacgtcggcgccgtcgatccagcgcgcatcgtggccgagatggacctcgaccccgatcgcctccaaccgctcgacgagcggacctcgcttgagatcggacccgctcacgacgaatccccgacccaccagcacgctcgcgagcgcgctcatgccggctcccccgatgccgaccaggtgcacccgacgaatcccctcgagcgacgtcactccagccatcgcgccacctcctcgacgagacgttcggtcgccctttcggtcacgagcgctcgagccgccgctcccatggccgtgcgcagggatggatcaacggcgagctctgcgatggctcgccccagcctctcggcaagcccagggccctcctcgacgacctcgctggcaccagcggcaacgaagtactccgcgttggcccgctggtggtcacccggtgccttcggcaacggcacgagcacgctcgcgacgcccgcgatcgcgatctcggccagcgtcgacgaacccgcgcgcgcgacgacgacgtcgcccgccgcaatggcatcaccgagccggggatcgaaaccgacgaccggctggtagctcgccatcgggtctggcacctgcggtggaacattgcgctcgccgaggaaatgccagaccacgacgtcgtcgacgagaccgcgcccgacgacctcgaccatcgcggtgttcaaggcgagcgatcccagcgagccactcgtcgcgaccaccagcaccgcgtccggcgcgatcccgagacgcgacctggcctcggctcgcggtgggagttcgcgcgtgggtggacccacgatcaccgcacgatcgcgcaccaacctcggcacccgtgcgggccacgcgaggacgagctcgctcgcgaacggcgccatcagacgattcgctcgacccagcaccgcgttctgttcgacgaggacgatccgcgcgcgccgtgcggcggcgacggcgagcgcgagcacctgtggcgccccaccgagaccgaccgcgaccgacggttgcggtgcagccaggaggcggcgaacgttctcaccgaatgcgccgagcttcggagcgcggcgcgcgcggacgatcccagcctccgcaagacgcacgcgctcgatcgcgtgtcctcgcaacgtcgcatcctcgacgggacgatcgctggtcacgagcagcacccgggcgcgggcaccgagcgcggtcgcgacctcgaggcccgcgtggagatgaccagccgtcccgccagcggcgacccacacgacgcgatcgctcatcgacgccgctccccacggtggaccgaggcgagcacgaccccgagcgcgatcgcctcgacgaccaacgacgaacccccttgcgaaacgaacggcagaggaacgccggtcacgggcaagagccccaccacggcaccgagattgaggagtgtctgcgccgccagccacaccgccacgagcaccgccaccgcatgcgcacccgacatcggcgtccgctcggcgagcgccagtaggccgaggatgatcccgccgagcgcagcgatgaccccgagcgcaccgatgacgccaaagtcttggaccacgagcgtcatgacgaagtccgtgaccgcattgggcacgtagccccagttggcgagtcccgctcccaggcccgaccccgtgacgtgggcggtggcgaaggaaccgagcgcctggacctcctggtacgacaggcttgcacgatagcgccatgggtgcagaaacgacagcaggcgcgcacgccgatacgccgacgagaaggcagcgagcgtcgcgaggcctccgcccgtgagcgcgatgggagcgagtcggcgaagcgggaccctcgcgacgaccagcgcgccggctccgatcgccgccaccaccagtgcggtgcccatgtcgggttcgatgaagatcgcaccagcggtgaccgccgtgaccacgagcaccgggccgaggacgcgctcgctgggtcgtgacgtgacgagcttggcgaggtagagcaccagcgcaagcttggcgaactccgatggctggatctggaacgggccgacggggatccatcgctcggcgcccccgacggtcgtgccgagcccagggaccatgaccgcgcccagccccgccagcgccgccgcgaggagcaccggcgaccacgcgagcactcgctcgaggccggcacggcgtacgaccacgaagctcacccatcccatcgcggtggcgatcgccacccaggcgacgtcgtggagggcggcggacaccggcgaacgcccgaccgctgcctgtgcctccacggtcgcggccagtccgacgagcgtgccggcgagcgcgagcccgcccccaaggccgacgatccagccgacggccgagccacgcccccgacggcgcccagagggccgaacacgtgcgtcgatcaccgccacgcccatcacctcccaagcgccgcaacggcgcggacgaagtcctcacctcgttcctcgaaactccggtaccaatcccacgaggtcgccgccggcgcgagcagcaccaccgtgcccggcagcgctcgctcgctcgccaccgccaccgcctcgtccatcgagttcgcctccacgatccacggcaccgcgtcgccgaggtcggccaccactcggtgggcactctcgccgatggcgaccacgccagcgatccgctccgcgacgtcgcggagccgctcgaaccccgtgcccttggttcgaccgccggcgatgagcacgacacgatcgaagctcctcaccgcagccacagcagcttccggcgtcgtggctttcgagtcgtccacgtaggtgagcccaccacgaacggccacgacctggagccgatgagcaagcccccggaactcgcgcgcgactcgacgcgcgcgttcgagctccgcgccactcgcctccgcaagcgcccaggccgccagcatgttcgcgacgtcgtgtggtgcacgacgtcccaactcctcgacccggacgagcgtgcggccgtccggcccgacgagtgcaccatgctcgacccgatagtcggcgtcacgcgccgtcgcactgaaggtccgcacctcgaccccgcgagggatcgcgatggcgtccacggcaccctctccgacgggccacacggcgacatccccgggcgcgagccgctcgatgaggcgcgccttggccgcgcgataggcctcgaacgacccgtggtagtcgagatggttcggcgtgaggttcaacacggtcgcgacggaagctcgaaacgtcggggcccagacgagctggaaggaggagacctcgaccacgagtcgacgagcgccactgtccgccaccgccgagagtggcgtgccgagattgccggccgcgacggccccgtcgccgagcatgctcgcggtgagcgtcgtcaccgtggacttcccgttggtaccggtcaccgcggtgatgggggccgcggcgagaaggtagccgagttcgagctcgccgatcaccggaccgtcgagcccgagacgttccacccgttcggtgcgaatcccgggggacacgacgaccaggtcgaagcgcgcgccaacgatggcgtccggatccacgagctcacgcccctcggagcgcgccttgtcacgcagcgctcgagcgtcgtccgccacgatgacctcggcgcccaacgatcgcagcacccgttcggccgcgagaccggacacgctcgctccgagcacgagcacacgcccgcctgccacctgggcacgcagcgcatcggcgctcatcggacccctccgagcgacaggaagtcggcatagaacacgccgatcgcgagcgccgtgcagaccccggcgatgatccagaagcgaatcaacacggtggtctccggccacccgagcagctcgaagtggtggtggatcggcgacatgcgcaagatgcgccggtgccagacgcgaaaggtgaacacctgcgccacgaccgacaacgtctcgatgacgaacagccccccgagcaagacgagcagcagatcaatgtgcaggagcagggcaaggccaccgagggcggacccaaggccgagcgacccgacgtcacccatgaagatgcgcgcaggcggcgcgttccaccagaggaaccctgcgagcgcgccggtgactgccatggcgaataccgcgagatcgagcgcatcggggacgtggtagagcccgacatggcggaacatccaatacgccatcagcgcgagcgccccgaaggcaaagatcccagaacctgccgcgagaccgtcgaggccatcggtgaggttgacggcgttcgaggaaccgacgacgacgatgaccgcgagcacgatccacccgaccgacccgagttcgagctgggccccaccgacgcgaaccaccgcgagcaccggagggactccgacccaccatcgagccaggaccgcaaacgcaagcgcgaccgcgacctggagcgagaacttccccgccttggtcaacccgagcgagcgccgattgcgcaccttcaagagatcgtcgacgaccccgatgaggctggaagcgatcgtcaggccgacgacggcgataccgccgcggctcagctggacaccgagatgggcatgcgtgaccgcccagccaagggccgtcccgaccacgatggcaatgccacccatggtcggcgtcccggctttgaccaggtgccggctcgggccgtcctcacggacctgctgacccaccccccgcgcgcgctggcgctcgatgagccacggcgttccgaccacggcgacgaccagcgacaccaaggcgctcgcaaggatggcgatcacgcgagcagccccccgtcgtcttggagcgcagcgtgcaccacgtcgatgtcgtcgaacggcgtcgcaacgccgtcgatgacctgaactcgttcgtggcccttgcccgcgaccacgagcacgtcgccgggggccatcatcgccacggcctcctcgatggccgctcggcgatcgaggacgacccgcacgccacgacgatcgcgccaccccgcgacgatctgggccgcgatggcagcaggatcctcgctgcgaggattgtcgctggtgacgatggcaacgtcagccagctgctcggcaaccgctcccatgaggggccgcttggcctgatcacgctccccgcccgcaccgaagacgacgagcaggcgcccccgcggaccgaccaggagtcgagccgcccgcaacaccgccgccagcgcgtccggagagtgcgcatagtcgacgacgaccaggcctcgcgggccgaggatgcgctgcatgcggccccgtgggctctcgacctcgccgagcacccctcggaggaggtcggggtcgaagcccacctgctcgagcacggaaaccgccagcaggatattgcggagattgtgctcaccgacgagacgcgagcgataccagcgtccgttgcgacggaaccggatccctgccgcatcgatctcgatgtccgtcacggcgctgatgctcaccggtaccaccggcacccgcaccgacgccgcgagcctcgcgccccagggatcgtcgacgttgatcacgccgatcgccgtccgttcgggctcgaacagccgtgccttcgcggcgaagtagtcctccatcgacccgtggaaatcgaggtgatcttgcgacaggttggtgaacaccccgacccgtacgtgcagcccctcgatgcgctccatcgcgatcgcgatcgaggacacctccatcgccacccagcgccgccccgagtcgcgaaactcagcgaggcggcgggcgagctcgggagcctcgggcgtcgtgaggcgactccagagcgtgccgagcacaccgaccccttccccgaggcgctcgagcagctgggacacgaccgacaccgtcgtggtcttgccgttggtgccggtcacaccgatcaccgagaccgccgacgacgggtcgccgaagatgcgatgggcaacgcggccgaccgccgtacggagcgaggcgcgtggcaccacgagttggggcacaccgaccgcgaccggctggccggcggtgagcaccgcgacagccccgcgtcgcaccgcctccgcggcgaagtcacgcccgtccacgtgacgccccggaaccgcggcgaacaggtcacctgcgcggatctcgcggtggtcgatcgcgataccggtcaccgaggtcgcccggtcaccgacgatgcgcgcgtgctctacgagggccccgagggcgtcgagcgtgacgccaacctctggacccacctcgcagactcccctcccgcacggacccggaccatggtagccctgcagcacgggggcagcgttcacccctggaccccagcccctggatgcatgtcgacgctgctcaaaagggtcgacgtgacttgcccttcgggcgtcaccccgtagcgagccagcgcagcgcgcatgatctgggagaacacaggtgccgccgtcatcccaccgtagatgggcaccggctggtcgaccatcacgatcgcactgaggaccgggtgctgggccggcaccatcccgacgaacgtcccccagtacgccccaggctggtaaccaccgcgcgcatggtagggcttctgcgaggtgccggtcttgcccgcgacgaggtagccaggtatcgccgcatcaggagccgtggcgttcgaccccgtgacgtgcgagaagagccccagcagctcggaggcgatcgccgcaggcatcacccggtgacgaggtgcggccggcgccaggtggacggtcccatcggtgcccacggtgccagcaaccagggtcgggttcacgaggacgccgccgttggcgaccgcgttgtaggaatcgaggatctcgagcggcgtgacgagctggtcctgtccgatcggggtcgagccgatcgccgtcggtgaccactcggagggaggcttcaggtaccccgcggtcgcgcccgggaacgcgagccccggatcgacaccccacccaaggcgccggaaggagtcgtagatcgccgtcgggccgagccgctcggccagttcgatcgtgcccacgttcgaactctgggcgaggatttgcgacatggagaggacctcggtggggtgcgactcggcgtcatggaacaccgagccgtcgatcaccagctggtttggaacggtctccgtcgaggtcggggtgatgatgccccgctcaagggccgcagcgaacgtcgcgatcttcgcgaccgatcccggctcgtacgcgtaggccaccgggtcgttcaaccagctctccgtcggcagggcgcggggcacgtcgacgggctgactcccgccgaccgacgacgtgcccggcagcgccggcgccgcgagcgacgccatcgcgaggatctggcccgtgtggggatccatcaccaccgccgtcgcgccgagggctcgcgtcgtctcgatctccgacgccaaggcgttctcgacgtcgctctggaggacgggatcgatggtgagctcgatggacgtccctgggcgcggcgggtgttcggcaacgaggcctccgggtaccggcgcaccctgagcggtcaccctctcgagggcccaccccggtgctccggcaagcacgcgctggtaggcgtactccaggccaaacgtaccgacaccagccggactcacacgaccgatcaccggctcggcgagatcgccgagcgggtacacaggcagcgtcgtcggtgtgacggtgatgccgggcagcgcgccgtcgagggcgagctgctcgatacgcccaccgacgctcaagagggcatcgggatcgacgacgctgtagcctccgtgcacctcgagcgcgctcgtgaccgacgccacggacagcccgagcagccgcgccagtcgctcggcctcgggcgcaacgtcgtggatctgcaacggatcggcgatgatcgcgtcgcgctcgatggaggtcgcaaacgcgacgccgttgcgtgcgaagatggcgccgcgcggtgccgacagcacgacgcgtgtctcgctctcggacgtggccagctgcccataccgcggcgccgggcccacggtcagacggacgagctgcgcggcgatggcgccgagcgccaccaccgtgacggcacccacgatgcgcacgtgcctagccacgcgcgaccgttccggccggaaggggcgccgactcgcccgttggttgaccaagcgccgtcgtcgggacgggtgctccccgtccactagcaagctcctcccacgtcgggtggacgaaaccgtgtgccgccgcgaccgccgccgcgtggctcggtgcgctcagggtgctgagctcggcgacgaggtcgagatgatgcacctcggcggcttgcagcgcgagctcggtcgcctggacggtattggcgaggcgctgtgcaacgagccgcgcggcgatcacgcccaacgcggcgaccacgaccacaccgatcacgagcacacgccatggcaccgaccgacgacgtggtgcgcgcgtcagcacacgaagctcgggggaacgtaggcccgagcgacgaggcagtgcctccgctagcgcagcgcgagccattcgtgcacctccctctcccacgctggtgcgagatctgccaccgcgagcttgcgcgcgaccctcaggcgggcactcctggcacgagggttgcgcgccacttcgtcgtcgctcggcacgacgccccgccgggggcggcgctccagtacgctcgtccagctgccagccggtgtggtgcgcggagccccgccccgctcggccacctcgaagaagcgcttcacgaggcgatcctcgagcgagtgataggtgagcaccgcgagtacgccaccgacctcaagcgcctcgaacgccgcagggagcagggccgtcagctgaccgagctcgtcgttcaccgccaggcgcagagcctggaagacgagggtggcgggatggcgcctcgtcgtacgccgcgacggtggggttgcctcgacgacgacctcggccagctgctcggtcgtcgtcggcatggcggcgaggatcgcgcgggcgtagcgacgcgcaagcggaccgacctcgcctcgacgcagcagctcggtgagcccatcctcgtcgagcgaggcaagcaatgacgccgctgacgtcggcgcctcggggtccatgcgcatgtcgagtggcccggcgaggcggaacgagaatccccgctgcgcgtggtcgagttggagcgaggagacgccgagatcggcgatgaccgcatcgatccgacgcgcgccgacgacacgtgcgaggtcgcgaaacgtcccgcggaccggctcgaaccgatcaccgaacgcttcgagtcgccgcgccgcgagatggagtgcctccggatcccggtcgaggccgatcacgagcgcagcaccggcatcgaggagtgccgccgcatggccgcccaagcccacggtgacgtcgagcacccgtcgaccctgcggttcgaccgcgcgcacgacctctgccaccatcaccgggaggtggatcggctcagccacgatcgcctccccgatagcgctcccaggtcgctggatcccacagctccacggtgccgaaggcgccgtggacgcgaacgtcgtggtcgaggttggcataggcacgatggctcggcgggagcatcagtcgtccgaggcggtcgatctcggcctcgaaggcttcggaggcccacgaacgcagtcgccgacgctcctccggatcggcccagtgctcggcgcgcacctcgccgacgaacgcgttgaagtcctcgacgcgccacacgaccaggcaggggtcctcgtactgcgaaggcgtgacgaagcactgatcgccgaactgaccacgaaagcgcacagggagcgtcaagcgtcccttggcgtcgagcgcatgcgagaaggagccgaagaaccggccggtcggctcaccgagctgccacacctccccgcgcctcctcaccgtcacccagaagggtgccactcacgccatcggcacccacggcgccccactttagcccacgacaccccaccggggcgtgtgaatcgcgtccgttggctccacgatgcgcacgagaccgtgcgagcgacccacgccacgctcgcgcgagatcaataccgaggtcggcgtcagggtgctcaaggagggcgccgagttcgcttgagacgatcgcgacgggtccgcgtgtccgacaggcctccatggctgcagtgtgagccgggagccggctcacagcgagaaccgaggtggagttagcgagccaagatcgcccggcgcaccgtcgcgacgagcggatcgagctcgataccgagctgctcgagccccagggaggccatggtgccttccggtcgatcgcgcagggcgtcgacgagttctcgctgacgatcgcgccagagcacggcaacctggaagatcgcgccgcctcgacgacgtcgctgcgcgagacccgcgaccttgttgccgccgacggcgacctctccccagccccagccagcaaagcacacctgcgtcgagagcgggactcgctcggggacctcacgcaccaccgtcacgtcggccaccccgagggctccaagggcctcggcgacggcttccccgagccagaggaacgatctgccaagatgcggatcgagacgcgggtcagacgccggcacaaacacgtggaaccacgcctgctcgccgggagccacgacgaccgcaccgccaccggatcctcgccgaacgatgtcataacccttggctacgaggctcgcagcatcgatcgcgtccacgcgcgtggtcgagcccagcacgaccgtcggcgccgtgggctcagcactgagcagccacggtgatccctcgtccgctggccaccaacggtggatgaccgaggccggagcgcgcagccgcaacgtccgccacggctgcacacgacgatccatgcggccgatcttacggcgtcctcaggcgaggcgataggcgcgcgccactcggtgcctagcatgggggcggcgtcggaccgggaggcaaggcagggctgtggaggcgtacgtgctcattcagaccgagatcggtcaggtcgcgtccgtactggccgaactgcgcaagctcccgttggtggtacgcgccgacgacgtcacgggcccgtacgacatcatcgccctcctcgagggcgagaccctcgaggacatcggacgtcacgtggtcgagggcgtgcaggtcatcgacggggtgacacggacgctcacgtgcccgctcggtcacctcagactcgacgcctaccactccgtcagaacgcagagagcgtccgagcggccccagccctgacgacgccatggcggagttcttctacccgccgcagttggaccgacgacgacgtcgcgaggacctcggcgctcgtcacggcatctgcgagggcgagcacggtctggacacggtgcgtcgccgatgccacgagacccacggtgagcgcggtctgaccggtcacgagggtgcagtaggcggcgagcaccgcccgcggcccacccaccgtacgcaagaacccgacttcgatctcgcgcgggcgaatctcgaacccggtcgcgcgcgtgcacatgccggtcgccaccggcgcagcccacgccgtcccgcccaggacttcggccgcacggcgcccgctggggccgaacgcgacgagcggcgcagcaccgaggtcgatcccgggcggacccaggacgagttcatgctcggccctcgccgtcgtgcgacggagcgccgcaagctggatcgggatcgcgatcgccgccaccaccacgaaagccgccacgccacctgcgagccaccgccgacgccgtcgcatccgtcgatcgctccaggcgcgctcgccctcgagcgctcccggagcttcgtgatcaagcgagtccacgcttccacgctagcgctcaccgacgacccaccccggggagtccatcgatgccaagagcgctgagcaggcgccgacgtctgcgccagcggcgagcggtgaccctcggtgccgtcaccgtcgcgatcgtcgcgggaaccggcgtgatcgacgcggccctcaccctcgatccatcgattcgggtcacgccccgtcacgtgagcggcgtgcgtgccccgaccgcgcccccgatcaccttcaagcacggcgtgcagtccgcgacggtgatcccggcgcttggatcagggtctctcgaagcctcgccccacgagcgacccgtcccgatcgcgagcctcgcgaagctcatgaccgccctcatcgtcgtccgccgacacccactcggctcgaccgcatccggccccactctcaccatgaccccagccgacgtgatcctcagcgacgtcgacgtcgctgaggatcagtcgactgtaccgatcaccgccggcgaacgcctgaacgagcgccagctcctcgaggccctgctcgttcgctccgccaacaacatcgccaccatcctggcgacctgggttgcgggctcagaatctgccttcgtggccacgatgaacgcaaccgcacgcacgatggggctcaccggaacacactttgccgacgcgagtggcttcaacaaggccaccgtctccactgctcgtgacgtcgccatcgtgaccgctcgcgtcgaggacaatcccacgctcgccgcgatcgccagcgagcatgccgtcacgctccctggcgctggcaccctgcccaacatcatccaagcgatcggcaccggcgacgtcgtcggcgtgaagtccggcttcaccatctggtcgggaggctgcgcctcgatcgcggtgcggacgcccacccccgtcggtgagctcaccagcgtgggtgtcgtcatcggcgaacagggctacgcctccctcgcgcgtgcggcgcggcgcgcccaggcgctcgcgaccaccgctgctgcgcgcgtcgcgagcgagcgcatcatcgacacgcgcgagctggtcggatgggcgcgggcaccgtggcgagcggcgccgattccgatcgtcgcagctcggagcgttcgcgtcctcctgtggccagcgaccgaggcctcggtgcggatcgcgctgcgaccaccagcgctgccggcgccacgcgggcgcgccgtcggcgagatcgtcgtgaccacaccgaccacaaccatcaccgttcccgcgattctcaccgcgagcctcggaacgccgtccttcggctggcggctcacccacgcgctctaaggagcgtgcgcgtcgcacaggcctcctgcggcgcgagccttgctcgctcgatcgccgacgaaaccaccccggtgtggcgtcgccaacgacacggagcgccggttcgtccggcgctccgtgtcacactgatgattcgccacgcctgcgggtgcgatcttggctcctgccgtcagcgaagcgcgccagatcctcgcgctccaccctggcgccgacgctcctcgatcgcgaccacggcaagtccgccgacaccaacgctcgcgagcgcgacaccaccccaggtgagcgcggtgatcgaggacggggcgctacggggccccgtgaccagcttcaccgcggtcggctgggtcgcgaccgtcggagctgacgacgtggccggagcggtcggcgtcgtggatccactcgtcgtcggttggggtggcgtcgagcccgcggcggtactcggcggcgcgacgaccgtcacgctatccgttgccgactgcggagcggcatcggtcgagaccaccgtcgcggtgttcgagagcaccgtgcccgcggcatcggtcgcatccacctggaccgggacgatgatcgagggcaacgattgaccgggctggagggtctgggtcgacgcaaaggcatacgtacacgtcaccgtgggtggcgtcgaggagcttgccagcgtgcagctccagccgtcgttcgcgttggcattcgtcagggccgtctgcgacacggtcacacctgcggggagcgggtcagtcacggtgaacgcgaaggaactcgaactcgatgggctgttcgacagcgtcccggccgcgaacgtcgctcccgagctcggacccggctcggcggtcgccgagctcgtcgcaacgccagcggtgatctcccatgagaaactctcaccagggttcgcgacgtggttcacgttgtcgaccttcgtgatcgagaggatcggacccgtggagaagtaggcgggatcggacccaacgagcacgaagtcgtcggctcccaatgaaagattcgggggggtcgactcgtaggtgaggttgatttggccaggactactcttcgtcgaggccgagacgatgtcgttcgtcaggctcgacggattgacgtagccgaagtcgacgacgttacctgcgctggaggagccattcacgttgcccgacgcgacccagaggttgcccgtcgtcggatcgagcgtcatggactcagcctgcgacgcaccgttcggggcgttaacgatgttgtacactgcgccctgtccgctcggcacgttgctcgtcgaactggcgttgtcgatcgggaggctgggcaggctgacgtagccgacctgcgtgtcgaactcacggacgaaccacagctcattctggccagcgtcgagctggaagtctccaagccccgacgagcccgtcggcagcgaccagctgtaggcggccgtcgtcaccggcgacgatggaatcccgctgcccaggttgtacatcgcgatatctggcgagggactcgtctcgccgacgaatgcatagacggtgccgccgatcgtatcgacagcgagcgaacccgtcagcgacgcggtgaccaccgcgctcacggtgttcgtcgtcgtatcccaagcccagacgtggctgccaccggtccagtacaccgtcggccccaccgccgcaatggcgtagtgctgggtgctggagaactgcgtccccgcgggctccggcggacagctgatgcttcccggcaccgatcccgtgctccactcgtcatagctcggcgaggtcgccgaggccgtcgcgttctgcgatgtgaacgcctggaggttcacggcaatcactggacacgcgctgacgccagtgacgcccgtcgggatcatccccgtgacgttccggtagtacagcatgttgccgacggcgaccccgtcgccgagatactgaccgcccaggccgttcagctggatcgtcccgaccaccgcatgtggcgcggctcccgacacctcgatcaggtaattcggcgagttggagtcggtgtcgacgtagtagttgccgttctgagcctgaaccgtttgctcgagatggaccaagggggagatcaccccgttgtcgacgaggacaccgaggttgaacgccaccggctgatacgcaggtgccgtcgacgccgacagggcgctcggccccatccacgcgaccgcgaccagcgctcccgcaacacccgcactcgtggtccctcgcaggatccacgtcgatcgcctcgtcacaacgcccctcctcaacgtccctcccctacctggctcgacgcagtgcagctgcgatcggcgtcagtactctagcactcactgtgtctcaattccacacgtcttgtgaactctcacggaatgcattcttcatactactcattgtggttatccgacctcgtcgacgtcgaactcctgtcgcgacgcaccgttctcggcagctcgcaatgagcccgaagaatgcctcgcaccgtccaatacggctgcaccaggcgtccatcaggatcggggcgcgacacacacgccaccgcacgcgctcccacgctggtcgaggtcaacgctccgcacgcaggtgggcccggtgggattcgaacccacgaccaagggattatgagtcccctgctctcaccgctgagctacgggcccttggttgcccacgcggccatcgacgctctctcaacccgtcagagcgcgggcgacgaccctcgctcacgccagattcgaagctccgggggagagactcgaactctcaaccgcacggttaacagccgcgtgctctgccaattgagctaccccggaaagcgacgtcagtctaggggtcacgatcacgctcgcccacctccgacgctcgttcgacgcgactccaccagccacgcgaacggtgtccgcgtgagcaggaagtcatcgaacgccgtcaacagacctaccgcgggccgccagccgacccagacgacgacgcccccgagcaccaatcccgccaacacgtcgcccgggtagtgcaccccgacgtagacccgcccgaacgcgaggaggaggcccgcgatcgtcgcgatccaggccatgaggcgatcacgcgcgagccagaggccaacgatcaccgcaccggcgacggtcgcgtgaccgctcgggaacgagtagcccccgctgcgcgcaagcagcacctcgacgtggtgcagcgtgacgtagggccggcgttcacccacgagcggtttcaggacatagtgcgcgatcacccaggcgaggacggtcccaccagcggcccagagaacccccgcaaccgcacgtggcgcctgtcgacgcgagcgagcgcgccaccacgcgaccagcagcaccacggcgagcacgccgacgccgacgaagtgcgcatactgcgccatcgcgccgtgggcccaccccgtctcacgcgcgatgcgattgacgtcgagataggcctcgtcgttgagatgctcgagctcgcccacgtcacacgcctccaccagtgttggcgatcgagcctaacgcacgcatgcgaaccggtgcgccagggccgcagccgaccctcagcaccgctcggctagtcctcgagcacacgccgcagcaccggcgcgagatccccgcggcgcaaccgtgcgatcgcgcgagcctcgatctggcgaatccgctcgcgcgcgatgccaaagtacgccgccgcatcctcgaggctgtggggctcgttgccctccagaccgaagcggaaggcgagcacctcacgttcgcgtggctcgagatgggccagtgcgcctgcgatgaccgtgcgaagatcagcgtgctcgatggtctcctcgatcggttctgcgtcgcggtcgggcacgatgtcagccagcgtcacgtcgcgctcctcgcctaccgcctgatcgagcgagagcaccgaacgcgcgtaaccctggagttcgcgcacgcgcagctcatcgatcccactcgcggcggcgagctccgccatcgatggctgccgcccaagggcttgctcgagctcgcgccgctgaacctccacacgagcaagttcggcggcgatcccccgaggcaagaccacatcgcggcgcgtccgcgtgagcgcctgcgcgatcgcctggcgaatccaccaggttgcgtacgtggagaaacgaaatcctcgccgcccgtcgtagagatcgatggcacgcaagaggccgatcgtgccctcctgcacgaggtcatcgagcgagatccccggttgcacgtagcgtcgagcgatgctcacgacgaggcccatgttgccctcgacgaagcgctccctcgccgcttggaccaccgccgcgacgtcgggcggcacgtcttcggcttcctgggcttcctggagcacgatggagagggcgacctcctcgtcgggcagcaggcgaccccgcctcccgcgcgccagcaccgcccgagcgccgtccagcgcctccggcgacaccccactcacgagccgctcccgagcgcgacgtccgaccgcgcctcgacgaggtaggcgagcagcgcaccggctgcatcgagatctcgaggttccgtacgaaggcgatgcagggtcatgatgtgatccgtccagcgacgctggcgctcctcgcgctcaggtccagagaggccggcaaggccgcgcgcctcacgctcgagttcgacacccgcctcgcgcaacacgagcaccaccagggcatcgtcgaagctcccttcggagtcgctggcagcgatgcgatggtagagctcgcggacgtcatcgccgacgccctcgagcgcggccgcgaccggcgcctctcctcgcgagccgagggctgcagcgagtgcacgataggtcgggtcgcgaaacagtgcgggtaccacgaggtccccgagcccaggatcgctggcgagggcgatgagcaccgacgccgcagggcgatcgaggcctgacgcctcgctcgtacgcagacgtcgcggtcggagggcgctcggaagccgcgccgcaagctcggcctcgcgaaatccggtccgatccgccagcatggcgatgtactcagaccgcacgagcgggtcgccgaccgaggcgagcaccgcagcgacgtcggccactgcacgcgcccgcccctccaccgatcgaagatcggcacgggcgaggactcgttcaaggcggaaccgagccaccggcacggggctcgcgagagcctgtcgaagcgaatcgggatcctcggcgaaggcctcggcaggatcacgtcctcccggcaaggtggccacgagaagctccacgcctgctgcctcggcgaggggggcgacctgctccgccgctcgctggcctgcgtcgtcaccgtcgaacaggaccacgacctggggagcgaagcgacgcaggatgcgcaggtggtcgtcggtgagcgccgtgccgcaggtcgcgaccgcagcgacgccagcggcatcgagtgcgatcacgtccgtgtagccctcgcacaccaacgcgcgccgctcgcgcaggaacgtcgaccgcgctcgatcgaggttgtagaggacctgacgcttgtggtagtaggccgtgtcctgcgtgttccgatacttcgggacgccatctctggccggaggcacgacccgaccgccgaacgcgatgacctgacccgcgacctcgcggatcgggaacacgatgcgtccgctcatcgggtcatgcagcgacccgtcctggccgcgcacgcggatcccgacctcgagcgcgatcgccgccgatgctccgagttcggcgaggctcgccgctcgcgacggcggtgcatagccgatgcggaacttcgcgatctggtcctcgctgatccctcgagccgcgagatactctcgagcgcgctcacctgccggtccagcgagctggtccgcgtaccaggtggtctgggcttcgagcacggtaagtgcctcgcgacgcgtggacgctcgcggctcaccggcagcctcgtgctcgatgcgaagaccggctcgtcgggcaagctgctcgacggcttcagtgaagtcgaggccctgcacctcacggacgaaggtgatcgcatcacctcgggcgtgacagccgaaacagtagtacaccccgagctctgggttcacactgaacgacggcgagcgctcgtcgtggaacggacacagaccgacccaacgcctcccgacccggcgcagcgcgaccgtctcggagacgagcgcgacgaggtccgtcgcatcgcgtacgcgccgcacatcggcgtcggctatggccactcgctcaaggctacgccgtctcggcggcgtccttcgcgcgcatcaacgactgtgcgacggcgaggcgcgcgatcggcacccggaacggtgacgcgctcacgtaatcgagaccggcctcgacgaactgcgcgatggaggccggatcgccaccatgttccccgcacacaccgaccttgagtccgggacgctctcgccgccccgcctcgaccgcctgccgcacgaggcgcatgaccccgcgtgggtcgaccgtcttgaacggattggccgcgaggagctcgctcgccagataggcgggcatgagcttggcctcgacgtcgtcgcgcgagaagccgaaggtcatctgggtgaggtcgttcgtaccgaaggagaagaagtcggcctcgcgagcgagttcgtcggcgatcagcgcagcccggggcgtctcgatcatcgtcccgaagcgcacttcgaatcgcgcgtccgaggccgcgcgcgcctcgtcgaaccattgcctggcgagcgcgagctcctccctgctcaccgtgagcgggatcatgacctccacgatgggctcaccaccggctcgtgcgacgtcctcggccgccgcaaggagggcgcgcacctgcatcccgtagaggccaggcttgacgacgccgaggcgaacgccacggatccccagcatcgggttctgctcatgccacgcacgtgccgcagcgagcaggcgctcgccctcgtcgtcgagaccccccgctgcctcggcacgctcaagcgcggtcacgtcggggaggaactcgtgcaggggtgggtccaagaggcgaaccgtcaccggcagcccactcatgacctcgaggatcccccgaaagtcacgccgctgggcctcgaagagctcctcgagcgcgctcgcttcctcctcggggctctcggccaggatcatccgccggacgatcgggagtcgatccggctggaggaacatgtgctcagtgcggcacaggccaatgcccttggccccgaagcgccgcgcacgctcggcgtcgtcggcggtgtcggcgttggcgcgcacgcccaccttcccaaaggcgatctcgtcagcccatccgagcacgatctcgaactcctccggcggtgcggactcggcaagcggcatccgtccggcgacgacgacgccactcgtgccgtcgatcgaaatccagtctccgacaccgacctgcctgccaccgacgcgaaaaccgccctcctcgatcacgatcgcgtccgcccccacgacggccggcttgccccagccacgcgcgacgaccgccgcgtgcgacaccagcccaccgcgggtcgtcaagatgccctcggccgcgagcatgccgcggacgtcctccgggctcgtctccttgcgaacgaggatgaccggctcgcctgccgcgtgtgcttcgaccgcactcgcggcgtcgagatacaccctcccgacggccgcacccggcgaggcaccgagcccccgggtcagtacgtcgacgacttcggcggcaaagcgcgggtggagcacctggtcgaggtggtcgggagtgatccgggcaaccgcctcctccttggtgagggcgatggcgggatccttggtcatctgcaccgccatgcggagtgcggcgacaccggttcgcttgccgactcgcgtctggagcagccagagcttgccctgttcgatcgtgaactcgacgtcgcacatgtcgcgaaaatgccgctccagccgtgcgaagacatccatgagctccgcaaagacctcggggaactgatcctggagggcagacagcggctcggtaatgcgaatgccggcgacgacgtcctctccttgggcgttgacaaggaagtctccataggcaccctgctccccggtcgcggggtcgcgagtgaagccgacgccggtacccgagcggtcatcgcggttgccgaagaccatggcctggacgttcaccgccgtccccaggtcgtcagggatgccttcgcgctcgcggtatgcgtgcgcgcgctcgccgttccacgaccgaaacacggcctcgatcgcgccacgcagctgatcgcgagggtgctgtgggaacgggctccctgcgagctcaccgacgagctcgaggtaggcaccggccagccgacgcaactcgcttgggggcagctcgccgtcgttctccgtgccgactcgttgcttcgcctcgacgagcaagcgctcgaacggctccggatcgagcccgagcacgatgcgcgcgtacatcgcgatgaatcggcgatacgagtcgtacgcgaagcgctcgtcattcgtctgacgagtgagaccttcgaccgacgagtcgttcagccccaggttgaggaccgtgtccatcatgcctggcatcgagaactgcgcgcccgagcgtaccgacacgagcagcggatcggatgggtcaccgagccgccgacccatgcgatcctcgagcgccccgacgtgacggtcgagctcctcgtcgagcccgtcgggccacccgttgcccaagtaggcacgacaggcgtccgtcgaaatcgtgaagccgggtggcaccggcagaccgagcacgctcgtcatctccgcgaggttggcacccttgccaccgaggagcgccttgagctccttcggcgcgactgggtgcgcatggtcgaatgggtagatgaacggcacgaaggaccctccacagctcaccgctcgtgcgcacggggcgcgcacgaggcatccgacgccgggcgtcgttgcccacaaggtgatgggagtctagcgttgatggaacgttaatgtccgagcacgcggcctcggcgtggccgccaagcgctcacgaacgtgggcgaccaggtctgcgaccggaatgcgtacctgctcgagcgtgtcccgatcgcgcaccgtcacggcgcgatcctccagcgagtcgaagtcgacggtgacgcaccacggggtgccgatctcatcctggcgccggtagcgcctcccgatcgactgggtctcgtcgtagtcgacgtccacgatcgtcgcgagatcggcgaagatctcgtgcgcgagctcgacgagggccggcttgcgcgagagcggcaagaccgccacggtgtagggcgcgagatgaggcgagagccgcagcacggtccgcgactccccgttgacctcgtcgacatggtaggccgcgaggaggaacgccatcgctgcgcgtgtgacgcctccggctggctcgatggtcgaggggtagtaacgctcctcggtcaccggatcgagcacggagagatcctcccccgaggcggcggcgtgggctcgcaggtcgaagtcggtccggtttgcgatcccctcgagctcaccgtagccccagggaaagcggaactcgatgtcgacggtgcgtgacgagtagtgcgagagctcgtcggcgtcgtgctctcgcaggcgcagccaatcaccctcgaggccgagctcttgataccagcgcagtcgctccgcgatccagaagtcgtgggcctcggcggccaccgacggatgcacgaagtactccatctccatctgctcgaactcgcgcgtgcgaaagacgaagttgcccggggtgatctcgttgcgaaaggacttgccgatctgcgcgataccaaaaggcggacgcagccgcatcgcgcgcgcgacgctctgtgcgtccacgaacatcccctgagccgtctcgggtcggaggtaggcctcggctccctccccctcgaccggaccgacgaaggtgcgaaacatgagattgaaggcccgtgccggggtgaggtcgcgagacccgcacttcggacacacgccatcgatctggtctgccctccagcgctcgtggcaggaccgacagtcgaccagcggatccgtgaagtgctcgaggtgacccgaggctcgccagatggccggaggcgtcaggatcgacgcctcgaggccgaccacctctcggcgctctcggaccatgtaggaccaccaggcctcgcggatcttgcggagcagaaggacgccaagcggcccgaagtcgtacgccgagcgaaatccgccgtagagctcggcggacggaaagatgaagccccgacgcttcgtgaggctgacgacggcgtccaaggtatcgggctcaggcatggcgccagtgtaggagcaacgaccctgctcatggcgcgacgggccggcttgggcgaggctcgggcgcgacgtgggcgagaccgcgcaagcgacgaccgaggaccgcctcggcgatccgggtcgcgagctcctcgaagcgccgcgcagccacggcatccacggcgcgcagtccgtcgcgcgtacgcccctcgagcaccagccgagcggcccgcatcgccggaaccccgatcgcgaccccgccgcaggcgtcacagcgcgcctgctgggaggcggggtcgatccgagtcagctccccctcagcgccgcacgaaccacaccgatcgaggctcggaccaaaacctgcgagctggaccgcccgcagcgtcaacgcggcgaagagctctcgagaaggggcctccacgagtagcccgagtccgcgcgcgaggagcgcgaacagcgcgtcgtcgccgtgcccgtcctcgctcagaccatcggcgagatcgagcagctcgtaacaccaaccgacggtgtccggatcgaggtccccacgtccggcgaggttcgccgcgacgagctgggcttgggccacgccgtcgagctcgcgcccccgccagcactccacgtcgagcaccgcggacggctgcacgatccctctgaggcggctcctcgcggcccgcgccccccgaacggtggcacggaccttgccgtgctcccgggtgagcagcaacgccaggcgatctcgctccccgagcggccaggtccgcagcacgaccgcaaggtcgcggtaccttccgctcacggcgcgcgacgtcggaagcgacgacgacgccccccgacgatgagcaaggcgacgaagatgaccccgacgagcaccatggctccgatcccggccgcaccccctccgatcgcaccggccgcgagggcacccatgaccgccaccacgagggcgagcaagaaccacccggccgctcgctgcagttgacccgagccgctcatcggcccaccccgccaaagcgccgatcgcgcccctggtactcggcgatggcctcgaagagatgctcgcgccgtacgtccggccagagggtgtccagaaacaccagctcggcataggcgagctgccagagcaggaaattggagatccgatactcgcccgacgtgcgcaccacgaggtcagggtcgggcatatccggaaagtacaagtgggaggccaccgtcgactcgtcgatcgctcgagccggcacgccttcggcaacgatccgtcgaagggcatcgacgatctcggctctgccaccgtaattgaaggccatcgtgagcgtcaggcgatcgttgtgcgcggtcagctcagccgcgagatccatctcgcgcgtcaccgacggcggcacgcgccgactgcgtcgccccaggaaccgaatccgcacgccacgatcgttgagctcatcgcgccggcggcggagcaggctccgattgaagttcatgaggaagcgcacctcgtcgggcgggcgtcgccagttctcggtggagaaggcatagacggtcagccaccgaaccccgacctcgagcgccccctcgaccacgtcgaacagcgccgtctcgccagcggcgtgcccctgggtgcgcggcagtccatagcgctgagcccaacgtccattgccgtccatcacgaacgccacgtgcagcggcacgcgcgtcgtatcgatgcgctcgagcgccgatggcacctcgctgggcctagccacggcgcaggcgtgactccaagtgctggtgcatgccccgctccatggcgtccatccagagctccgtcatgagctcatccccgcgcaacgtgaagcgacgctgcaccgcatccactcgcttggcgctcggcgtcgtcgcgacgacgagtgaggtcaaggagatgacgacaccaccctcggcttcctcggcaccgccctcgaggacctcgacgatgcccgttggctgcgccacgacgagctcgagccgaccgttcgcgacgaagcgcagataccccacctcggtgtggagcggcgatccgtccggacccgtcgtgtgctgttccatgcggaggaacggccgaccattgctctcgaagcgcaggcgctcttggtagctgaactcggcaacctcgggatagctgccgatcccgctcccggtccaggttccctcgagcatctctcgaatcgtcatcgcccctcccccggccagccctcagcctagcgaggtcggcgtcggcgcgtccgggcgtccggacctcacagccccagctcgtcgagcatccgtgcggatcggcgccagtcgcgctgcaccttgacccggagcgtgagcggcgggtacgcgcgcagccggcgctgggcctgacgtcgcacggcggccagcacccgtccctcgtggccgagcacgatcgcacgctggctcggccgttcgacgtagacgacgacctccacaccgtcgtcgctccacgactccacctggcacgcgagcgcctgtgggagctcgtcgcgcagatggtggaggaactcctcgcgcaccacctcggccacgtaggtcgcgcgtgggagatcgagcgcgacccctgcctcgtagagggcaggaccctccggcaacgaagaggccaggtaggagcgcagctcttcgatcccttccccggttcgcaccgaagccacgaagtactccgcgagcggcacctgagcgagctcggcaaggaccgcgagcgtgcgagcacgacggacgcgatcgatgcgtgcgacgacggcgacgtcgctcggcttcagacggctcgcgagttctcgctcacgagcacccacaccacgctcggcatccacgaccagcagcgcccggtccgcgccgtcccactcgtcatcgacccagcgtcgcaggcgcgccgagagttcgtcgtgcgccgctgcgatgccgggggtgtcgacgaggacgagctccgcatcgcccacgcgactgatgacccgcacggagcgccgggtcgtgttcggatgtcgagacacgatggtcgcgcgctcgcctgcgagcgcattgaccagcgacgacttgcccacgttcgtgcggccgatcaccgcaacgaaccctgatcggcgaatgggaggcgcgtcgtcaggatccatcgagacctcccgggtggcgctcgacgagcacggacgcgacccggtgacgcgccacttggcgtacctggagtcgcaccccatcaacgtcgacttcctcaccgacgcgcggcagatgaccgagcagccccatgatcagccccccaaccgagtcccactcgccctcgggcagctcctcgccgatacgctccgagaggtcgtcgatgctcaccgagccccgcacctcccagcgaccctcccccagctccaccacaccctcaccaccggcgtcgaactcgtcgtggatctcgcccacgagctcctcgatgaggtcctcgagggtcacgatgcccgcggtcgagccgtactcgtcgacgaccacggcgaggtggaacttcccgtcgcgcatctccttgagcaggtccgccaccggcttggtctccggtacgaagtggatcggtcgcatgtgctggccgaccggcacgtctcgaaggccagtgtgctcgagtgcgagcagatccttcgcaaggacgatgccaaggacgttgtcgagcgagctctcatagaccggcaatcgagagcgaccaacctcgatgacgacctcgatcgcgcccgcgaccgtcgtctccgctgggacggcgacgacgtccgggcgcggaaccatgacctcccgcgcgatcgtgtcgccgaaggagatcaccgagtggatgagttcacgctcgtcggtctcgatcacgtcaccctgctcggccgcgtccgccatggcgagcaactcggcctcactcacggtggcgccgggcgcgcgccacggcgtgagcagtgccgacaacgaggcgacgccaccggccaacacgcgaatcggccagaagcgcaccaagacggcgacgatcggagcgagacgcagcgcaaccccttcggggtgcaccgccgcgacgttcttggggatcgcctcgcccaccacgaagatcacgaggatctcgaccgccgttgcgacgacgaccccgagcgtgccgaagacatggtcggcgacgaccccgaccagcgtggccgcgatgagctgactgacgagcgttaggagcaacaccgtcgacaggtacgtcgagggagcttcgacgagcgaggccaaggcgcgagcgccccgccgtcgctgatcgacgagcgcttgggccttgactcggctcgtgcgtgtcaggccagtctcggccgcagacaggatcgccgataccccgacgagcagcacgaccgcgacgagggaccaccaatcagcggtgctcaccgctcgctcgccacctcagcaccaacctcgccacgaagcgcgcggtagcgctccagcagcgccgcctcctccgcctccatgcgctcggcgtcctcgtcggcctcgtggtcccaacctcggatgtgcaagatcccgtggatgagcagcaaggccacctcgtcacccacgctcccgtcgtggccacgatcgccgcggtgctcaggcgcgttcgtacgggcaacctcaggacagatcacgacgtcgccgaggagggtcggcaatcccgatgcggtcgagggacggtgctcgctggcgtcgtcgccgacgtcgtcgatcgcgaaggagaggacgtccgtcggcccgacgcggcctcgatagcgagcgttcaggctcgcgatggtctccgcatcgacgaagaccaccgacagctcgctgaccccgtgcacgccgagggcggtgagcacctcggtcgcgaggcgcgccaccatcgcttcgtggatctcgacggcggactgctcgttcgcgacgaccaccgtggccgcgggaggcgcaggatcagccacgggaccctgccgcggtggggtcgtcgtcgtaggcctcgaggatcgcgcgcaccacggggtggcgaacgatatcgcgccggtcgaggcgcacgatcgacacgtcggggatgttggcgagacgcccgatggcatctaggagcccggacgtccctccatcgagatcgatctgggtcgcgtcaccggtgacgacggcggtggatccgaagccgatccgcgtgaggaacatcttcatctgacccgtggtcgtgttctgagcctcgtcgaggataatgaagctctggttcagcgtacggccacgcatgaacgcgagcggagcgacctcgatcagccctcgctcgagcagtcggagcactgcttcgggctcgaggagatcgtagagcgcgtcgtagagcggacggagataggggtcgaccttggccgccacatcgccaggcaagaatccgagccgttcgcccgcctcgaccgccgggcgtgtgagcacgatgcgttgcacccgcttggcacgcagtgctgcagtcgccgccgccaccgcgagataggacttgcccgtgccggccggaccgacgccgaaggtcacggtcgagcgttggatggcttcgacgtagcgacgctggccggccgttcgcggccgcaggctgcgaccgtcgcgggtacgcaacagctcgagatcgctcacggccgacgggctctgctcgtgacgcaacatctcgaccacccgatgcacgaccgcagcttcgaccgcgtcgcctcgggcagcaagcgcgagcaactccccaaggacgcgcgccgcgaggtccgcatcggcgcccgagatcatcaccccgccgtcgcgcacgacgacgcgcgcctgtccgaccgcctcctcgagcacccggagcagctcgtcgtgggcgccgaagacgatcgccaacagctcaggccgatcaacgtcgacccgcgtcgccgcgagcggcggggtcaggcctgacgagaccgcgctcatcgatgccacccgcccagcacatggctcaagtgcccagaccgacgcgccgagacgagccccgtggacgagcgagcacacgaacccacgacacggggtgcctctcccgaccgcgtgatcgacctcgcggacgtgctcgcacggaccgagcgcgccgaggttcgcctcgtcgacggccgaacgtccaccggcttcgtcgatgcctggtcgtcgaggtgcgtacgcctgatccacccgggcggatcgacgtcgctcatccccaccgacgcggtggccgtgctcgccatctcgacctcacgcgcccctcgcgcgccaacgctcggctccttcgccgtcgagctcgaacgagcgggtctcggggcgaactggaccctgtggttgcgagacggctcgagcctcgcgacgagacgcatcgacgcactcggagaggacatcgcgctcatcgtgagcaccgagggcagatccctcgtcgttgcactccgctccctcgtccttgctcgccgctacgaccgcacggcaccacagtgacggctgttcgcgctgacaccacgcctctggcgccaccacgtttcgaccgtacggcacccctagcttagcaggctctgactcgtcatcgaggaagctccgtgcacgcgtcgactgccgagcgcccctggccgaacccgggccgactcgaggaacgcatcgaggtccgagcgtcggatccgcaagttccggccgatctggtacgccacgatggccccatcgtcgatcaaccgatacagcgttcgcagggagatgccgagctcttcggcggcctcccgagtaccgagccacccgttctccatggacacctccgtcgtcaacgcccatggtagacacacagcgcgatgaatcggcacgaacggcactagctgacattccagcacgaccacgacggttccatccatcgcttgcgcacgaggcgaggtggcgctaacatcgcgggcgcacggaagcaccactgatcaaggagtgatcatgcgcagcacgacgctgctgcgtggcgcgcgccggacctgggatcggccagccgtccggtggccctcgttgggttcctcggcgctacgcatcgtcggatccatcgtcctcgcgggcgtgtcgctggccctgctagtggcatcatggctgggtggcgttcgcaacgccggagcagcggttggcgtggtcgtcacgcgcccgatacctgctggcgcgaccatcgaacgcgccgacctcggcctcgcctcgatcaccgttccccaggcggtacgcgccacgctccttgcggtcgacgacgcggtgggccgcaccgcagccgtgaccatcgcacccggtaccctcttggagcgctcgatggtgctcgggccacgaccacggacgccagtgcgctcgatcaccattgccgtcccgtcgacctcggtcgcctcaggcgtcatcgaacctggtgatcgcgtcgacgtgctcgcaaccacccagagcgcatcgagccccgcaaccctcacgatcgcgacgcagctcctcgtcctcgacgtccaggcttcctcgggcgacgaactcgtgaccgtcgcgaccgacagcctcgaccaagctctcgccatcgcccaagccctcgctaccgccaaggtcgatctcgtgaacgccacgggcgtacccggagacacggtgctatcggtgtacccaccctcgatcgcagggctcgcgacccatggatgagcgtccagtcgtcgtccttcagctcgcgcacgccaacgcggtgcgcgcgctcgccgagctcgcacccgtggcacacgacctgcggttgcgatgggacccgaccggcgacgcgctcgacccggcgaccgtgtcggtgatcgtcacggatcgctccgcggccgtggcgcccggggtccggctcgttcgaacgaccgaccccaactgggtggtctcgcttcgcgaggccgtggccgcacaacggccgcgctcggacatgtgtggcagcgacgtcgaacccaaccgcccccacccactctcacgcgacgagcgcccccggtggtcaggtctcgaccactcggacgacaccgacgtcggcgagcaccaccacgtggcggcggcatccgcctcagacgatgccgtgggcacggcgcccgagcacgacctcgaggtgcgtcgagcgcgtctcgtggtcatcgtcgatctcggctcggcgagctccgtcgccatcgcactcgcagcctgcgccggtcggggcacgctcctcgtcgatgtgcgcgatcggccgacgctctggttcctccatgacctcgccccagagctcacgacgacggcccgcatgccggagcggccctacgagctcgcacccccgcatgggaccctcgccaacgagctcgtcctggcagatccgctcagcgagcgccgaacgcttcgagccgccacccgaagcttcgacctcatcgtggtcgtgaccgatgcccgcgaccacgccgccggcgatgaacgatcgacggcgctgcgatcgctgtggcgcgacgcccaggcgaccgtactggccggagcctgcaggctggaggaccgctaccgcatcctcaccacggccgtcgcactctccgcgctgcgccgtgacctcacggtcgcctgtgtcggcgcacgtggggcctcggcgcacagccacgcgaccgcgatcgtgcgcgcactcagcgagcgtgtcccgcgatcggtcagggtcgacgggttcggtctcgaagagctcggcgaccagatccacgagcgacgccacccgatcccggaccgcctggtgcgccccctccgtcccgtcgtccaagaggctcgctcgaggccaccgttcgacccgggagatccagacctcccgctggcaccgctcgaggggctcagatggctcgtccccgaggcgctcgaggcgatctaccacacctcgtcggacggcaaggaggcgtggtgagggccctccgtcgcgacgagcgctcgcgcccgctcggcgagctccggcgcctcgtgatcgcccagccacacgagcgtcgcgagcgtctgacgcaccgccgcctcggtgacgatgggatcaccgaggtcgccatagatcgtccgcaccagttcgccgaggtcgaggccttcgccgagcgcctcacgcacctgatcgatgcgagtacgtcgatgctcttccaggaacgtcaggaccgccccgatgtgcgcaccttcgaccacaggcccatggccgggcagcaggcggcgcggttcgagcgaggcgacgaccgtgagcgacgcgaagtatgcctcgagggagccctccgggtagatgatcgccgaggtgccccggcccagtacgtggtcaccggtcagcagctgtcgatcgggcgtgacgaaccccacgtggtcggctgcgtgacccggaagcgcgacgacgaccacgtccatcgcctcgagcagcgcttcggcgccgcggccggatgcatggacatcgcagccgagcagcgccgccaagggctccgctgcttcggcgtggtcagggtgggcgtgggtggtgagcacaccccgctgcctcgcgcccgcacgatcgatggcatcggcgatggccccgagatgcgcgtcgatcatggggccgggatcgaccaccacggcgtgggtctgcgtcgagaggatgtaggtgttggtgccctcgagggtcatcggggaagggttcggcgcgaggatccgctcgatgcgcaccggtccgtgccgcgacggccccacgtcagcatcgcgggcgtctcggtgtgcatcggcctcgaccacgactcccacgttaggggacgacgcggtggctgagtacccctggctcgaccgctacctgtcgctgtgcgctcgcctcgagcacgcggtgcgcgccgagctcgatcccgccgccctgcccaccgacgcagcagcgctcgaccagctcgctcgccgccacgccctcgacatcgacgaccttgcggcctcggaacaactcctcggcgccgtcgtacgctacgtcatcttctcgatgcgcgcgctcggtcccctggagccgttgctcgcggaccccgacgtcgaggagatctcgatcaatgccccgagggaggtgtgggtacggcgccgggggcgcttcgcgcgcgcaccgctcggtttctacgaccacgagcacgtgcgacgagcgctcgaacgcctcaccacgaccgctcgcggcgcccaacgccagctcgatccaggccagggcatccaagacttcacgctcgccgatggctctcgcgtccacgtcgtccatcccgaactcaccccgcacggcacctggctcgtgaacatccggcgcccgctggcgaccatcgggcacgccatggccgaggtaccgcccctcctggcgagcgccgtgcgcgtcggcgccacgatcctgatcgcgggcctacctggcgtcggcaagaccacactggcacgagcgctgctcgatggcctcgacgacgccgtgcgagtcgtcgtcgccgaggaggtcggagagactcggctcgcgcgtgggaacgttgcgcacctgcaaacccgccgccaacggccgggggtcgaggcgatctcgctccgtgcgctcgttgcggcgtcgcttcgcatgacgcccgagcgactggtcatcggcgaggtccgagacgaggaggccctgcccttcgtcgtggcggtcgcgagcggcatcccaggactctcgacgatccatgcccgcgagccccgcgcggcgctcgagcgactcgcgacgctcgccgccatcgcaccagaggcgccaggcaccgcgacgctccgccatctcgtggccgacgcgatcgacctcgtcgtgcagctcgcctggcacgacggaccacgagtgaccggactcgtcgccgtcgagggactcagcacccccgatggcatgggccccttcgtcgtcaccaacctgctcgctccggccgctacgcggacctcacgcctcttcagcagattcccacagctcctcgaggcacgcacggagctcgtcggatgagtgcacacttgcgcgacgcgatcgccgggctcttggcactcggcgccatcgctgtgctcgccctacccgcccttgcccggttgcacgcccgtagctccgcaggacgccgaccacgacctgcgaccgtcgcgctcgggcttgccggtgcggcgatgatcacgctgtggcgtctgccggcgatcgccgatctcatcgcggcagcggcgctcggactcgccgtggtggggactcgtcgccgcgacgctcgccgcgagctcaccgcgctcgacgcatggcaccgatggctcagcgagttggcactgcgcgtcggcacgctcggcgaggcgctgtcggaggcgttctgggtcgccgtggagccgatcccaccggatcttgcccttgcgatcgcacgggccagatcgcactttcgcgtcgctcgggacttcgccgcagcgatcggcctcctgggtgagcaggcctcggatgcgacgaccgccaccgtatgccgagcgctgaccaccctcgatggcctcgcgacccacgaggtcactcgcagtctcgaggcgctcgctcgcgacctcgatgcgcaacgagcggtggcccacgaactcgatgcgcggctcgcgggcgcgcggctggcccgcgggctcgtcctcgccgtccccgcactcctcgtcgtcgtcgggatggcgatcgccggaccgagtgcctatgccaccccgctcgccgaacgtatcgaggcggtgagcctggttaccctgctcggctgctggctgtgggcgtcgcacctgctcgtgccggtggttgccgttcgcggccagaaggaggtgccgtgagttccttgatcggccttggtggtgtcgcgctcctcctcgcctcggcgtggttggcgacgaccgtgcgcgagatcgtcccggctcggctcctccgccacctcgagctcccgcccccgtcacgtccggtcgcgcggtgggtcgcacgtcgctccgacgactggctgctggccacaggggtgcagcccgcgaccgatctcgctcgcttcgccgatccggccctcggagcctcaggattggtcggcgccgttggcatcgtgggccacagcgctcccgccgtgtcgggcgccctgatggcaccggtcgtcgtcgtcgcgctccgcgtcgccatggtcatggccaccgcacggcgcgtccgcgagcgcctgcgcgcgacgtggtccagcgagctcggtgagatccgtcatctcgtggccgctggcgcaagcctccccggggccctcacgactcgtcgggacgccgacaccccatggtcgacgcagtggcacggtgccctcgccgagatgggcgagggcaccgacctcgaggtggcgctcgcgcacgtggcggaacgcctgcgcgatgcgaacgtcggggcagcgctacgcctgctggggagctcgtgggcggtcggcgccgtgacccctgcgctcggcgagctcgaacgcgacgcgctcgcacgccgacgcgccgacgcactgcgtctcgccagccgacgtgagcagctcgtctggatccccgtcgcggtcagcgccctcgtacccggcgtcacgttggtcgtcgtcccgctcgccgcgggccttcagaagctcgtcggcctctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtaaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagcccatcgatggcacgggcacgtgacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatttcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagctcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctaggcacgctcaccgagacgagccgagtttcttgcctctttagtcattgtatggtatcctatgatcatccacggaaggaggtcacaatgccgacacggacgttggctccatcgacgcgcgactggttccgccgaaccctcgagcgacgacgacggatcgctcggagtctcgagaggctggtcatcgccatcgtgacacggaacgatcccctccacgaggctggcgagggcgtcgtgtcgaccgcgatcatcgtcgtgatcatggcgttcctcgcggtggggttgtggttcgcgttcaagaccatcatggccaatgccacgacgaccgtctcgaatcaggtcgcgcagctcgggagctgaggatggctcctcactcctggcgagcctcctggccgcggctgggacggtgtggatcctcgcactcgtcgccgccgtcggcagcaccgcgctcgcccaactccagctcaacgagtggtcccaggaggcggtggccgctgccgcggcgacactcgccagcggcccgacggccgcactggccgcaggcgaccaggtcctgcgcgccggaccgaccgtggtccgcgacgcgcacgcgacgtggaccatcacgtcgaccaccgtcgcgatcgacctcacgacccatgccccgagcgcactcgtcggttcggtcacgctcgacgctgcggcctcgcagcgaggaccgtgaacgcggctcgatcgatctcgtcgcactgatcgctgcgctcgccgtcgtcgcatgggtcctcggtccatggctggtggcgatcctgcgcacactcagcgccgaggcgacactgtcacagatcgcgtggtcgctggcgcgcggggccgagaccaccgggcagccaccgccccaggccgtcgcggttcccggcatcggaacggtcacggtgagctggagtggcagtctcggtcgctgcggcatcgcgacggtcacgacgcatgcgaccctcgctgccccacgctttggcgttctcgggccaggcgcgatctcgctcgccgagcgagcgaccgtctcgggcgacgccttcgtcggcggcacgatcgtcggggcgtgtggtgggacgtgagcgagccgaggcgggctcggcgctcgtgctcatcccgatcctcgcactcgcgacctcgatcatgctcctcgtcatcggtgcgatcggtgcgctcggtgtccgccacgcccaactgcgcaacctggccgcgagctgcgcgttgtacgcatcgcgtgccgtgtcgacgacggcctgggaagcgactggccagctcgccatcgacccgacgacggcacgcctggacgcggcgagttgccttggcgcaagcggtgtcgccctgtcgggttggtcgttgaccgtcacgcccccgatgaccgtcaccgtggcgctcgaggaacgcctcgcgatcccagtcgtgagctggctcaccggctcgcccgcactggtgcaggcaaccgcaagcgccacccagtcgtcctccggccccggataggctcgctgtgtgcacgcccttgccgtcgacgcgaccttcgtgcgagccgcatcggtcctcgtcgtcgcacgcgatcgcgtccccggtgccttcgcgagcgcctttcgcccctggggcgacggctcgctcctcgccatcgcgtaccaaggagacgagcccgccccgctcgtgcgcctcgtcgaggacgggaccaccctcgagatcgcgacacgccgtgttcgcctcgatggcgccaccaacttccgcgatgctgggggactccagacgcctcgaggaccgctgccttggcgccgtcgcttccgctccgagaatctcgcacgcctgagcacacgcgactgggacgtcctcgaagcgctcgggatccgcctcgtcatcgacctgcgcgcaccctcggaagccgccatggccccgacgcgagcaccgtcgttcgtcgagcttcgaccgatgccgctcgcagcgccactcgcgggcgccgaggacgccaccgaggccatcctcacgggcaggctccagagagtgacccccgatgacctcatcgtccactacgagcgactcgtcaagcaccacgcgtcggtcctccacgcagccgccgacgtcctcgacaccgcacccgacccgctggtcgtgcactgcaccgccggcaaggaccgcaccggactcgtggtggcgctctggcagctcggcgcgggtgccgacctcaccagcgtgatcgaggatttcgcactctcgaacctcctccgaaccgtgccacgcttcgtcgaactccgagatcgcatcgccgcaaccggcacagatccacgggccgtccagccctacctgagtgccgtcgtccccgcactgctgcacgcgctgtcactgctcggcgtggtcaccgcctgacaccgcgcaccgtccgcgacgaacgtccgggcagcgcaggtgcctcgaaggctcggtgcacgatcgcggaaccatcgtggctcgaaggccggaatgcttgcaggtgcgcgtgcaacaagctactgtcgggtttggccaccacgcaccgtgggggcatggcactcgtcgacacgtcacaagcgccaccagcacagacacgcggacgaaggagggggcatggccgatccaacgatcgaggcgctctacgaagagagcaggctcttccctccaccaccgaacgtgctcgaaggcgcagaggtcacctcgcgcgagatctacgagcgcggccgagatcccatcgcctactgggagcaggaggcatcgcacatccagtggcgcacgccctggacgagcgtgctcgattggtcgaacccgccctttgcgcggtggttcgtcgacgcaacgctcaacgtgaccgagagctgtctcgatcgtcacgccgaggccacgcccgacaaggtcgcctactacttcgagggcgaagagggcgacaccagggtcatcacctatcgccagctcctcgaggatgtctgccgcttggccaacggtcttgcgcagctcggcgtcagcaagggcgaccgcgtcgcgatctacatgggtatgatccccgagttcccgatggcgctgctcgcctgcgctcgcctgggcgcggtccactcggtggtcttcggcggcttctccgccgacgcgctcgccgatcggatcaacgacgcccaagcaagcgtggtcatcacctgcgaccagtcccgtcgcaagggccagaccatcgacctcaagcgcatcaccgaccaggccctcgaacgatgccccagtgtccaccatgtcgtggtcgtcgaacgcacgggcgccgacgttcccatgacgaccggccgagacgtgcgctaccacgacctcgtcgccgaccagccggccgagcggcccgccacggagacctcgagtgaggacccgctctacatcctgtatacctccgggaccaccggcaagcccaagggcatcgtgcacacgacgggtggctacctggtcggggtgtcgagcacgcatcgactggtgttcgatctgcggcccgacgacgtctactggtgcaccgccgacatcggctgggtgaccggccactcctacatcgtctatggcccgctcgccaacgggaccacgagcgtcctctacgagggtgtgccggactaccccgatcgcgaccgctactgggcgatcatcgagaagtaccgcgtgacccagctctacaccgcacccacttcgattcggacgttcatgaagtggggggacgagtaccccggtcgccatgacctgagctcgctccgcgtgatcggcacggtcggcgaaccgatcaaccccgaggcgtggatgtggtaccgcgaggtcatcggccagaatcgttgcccagtggtcgacacctggtggcagaccgagaccggtgcgatggtgatcgcaccgatcccgacggtgacgcccacgaagccaggatcggcgaccatccctctccccggctaccaagccgacatcgtcgacgacaacggcgagtccgtcccgctcggtggcggtggctacctcgtgctcacacacccgtggccgtcgatggcgcgaacgatcttcggcgatccccagcgctacatcgacacctactgggcgcgcttctccgatcgcgagcacaacgtgtggcgctacttcgctggcgacggcgccaagcgcgacaacgacggctacttctggctgctcgggcgggtcgacgacgtgatgaacgtctccggacaccgcatctcgaccctcgaggtcgagtcggcgctcgtcgaccatcccgcggttgccgaggccgcggtgatcggaagggccgaccccatcactggccaagcgatcgcggccttcgtgacgctgcgcgccggcatcgtcggtgacgacgccctcctcgcggccctccgagaccacgtcgccgagcgcatcggcaagatcgcccgaccggcctccatcgtcttcaccgacgagctgccaaagacgcgctccggcaagatcatgcgcaggctcctgcgcgacatctccgagcaacgccagctcggcgacgtgaccaccctggccaatgcggacgtcgtcgccgagatcgctgcgcgcgcccaggcacagcagacaccttccgacgatcgttgagacggaggcacccgatggggtgccacgagcagcacgaaagagcagcagcacccacgtgggtgctgcgaccaatcgcccgacacggccacagcgcccgcacggacgtgtcggggtcagccgcgccacccgcgcgggcagccagcatcgttggctgcagcatcacagggggaaaggaaaccataccgatgaccatgactgacgcccacaccgaggtggaggtctcgtccgtcaaggcgaccgcggacccgggcccgctcgggctcgctggcttcgcactcacgacattcgtactcagcacgatcaacgccgggatcgtatcgggcaccctcgtcggtgtcgttctgcccctcgcgttgttctacggcggtctcgcccaactcctggcggggatgtgggagttcaagcgagcgaacggcttcggcgcggttgcgttcaccacgtacggtgcgttctggatgtcgttcgctgcgtacgcctactacatcttgccgaagctgccagcggcgacggcctaccaagcgaccgggctctacctgctcgcatggaccatcatcacggtgatcctgttcgtcgcgacgctcgggctgacgcccttcttgaagatcctcttcgcactgctggccctgacgttcctcgcgctgaccatcggggcgcttggccagtcgacgtcgatgaccaagatcggcggttacctcggcatcatcaccgcgatcatcgcctggtacggcgtgctcgccaacctcacgaaccaggccttcaagcgccgggttctgccccagtagtaccgcgcgctcgctgagcctgaaacatcgccgccaacggggacggtccgaggacctccccaatggcggcgatggcgcgttcacggcccgccccatcgccagctgccaccgcgtcggcgagctcctcgagcagcgcaggcagcgcgtcgagctcgacgagctgattgagcgtgcggatctggcgagcctcacggcgtaagcccgtcgcatcgtccgctccaagggccaccgctgcgcgctcgatcgcgctcaccaccgtccgctgcttccgtccgtccatcgctcatcctcccgagtgcgagacgacgctccgacgaggccaccctcgccgcgagcctcccgcgccctcgcgcggcccacccatccgtcgccgggtggagcgcttcactgcccacgcgaaccggtgctcgagacgcgctctggccgagcccccgtggtgattccgtcggctgcgcgcttcgatggcgcgctgccacctcgggccaccgtccgcctgagcgccccgacccacgaggtgagcctacgtgggcggatggccgtcgcgacgcgacgatgactcgaggatcgcagcgacgacgagcgcgacctcgcgcacctcgatcgcgaacgccgcgagatcagccaccgaccccgagtggtgtcgtaacgcatcggccaccgcctcacgcatcaccggatcgaggtgacgctcgagcacgtcgaggaggcgttcggtgacggccccctcgtcgtcgagcaccaagccgagcgcttccgcgtcgcgcttcgtcaggcggcccaccgtgcgtaggctagcgctcgtcccagcgagccacgatctcgtcggcgagcagacgaccgcgcaccgtgaggcgacgtcgtccgggcgcgccttcctcgaagaacgcagccgcccaggccgggacggcctcctcgtcgatcccgtcgcgctgacggagggcgaggtaacgagcctcgaggacacgggcgctcgatgaaagcacctcgagcccctccgtcggcacgagacccgcccgcacccgctcacgccacctcggccagctcgccacgttccacgagcgcacaggatcacgaaacgaatgcgcgctcggtccgagcccgagataggcgccaccaccccagtaggtctggttgtgtcgcgactcctggccggggcgggcccagttcgagatctcgtaccacgcataaccagccgccccgaggacggcatcggcgacctcgtagcggcgagcctgtgtctcatcgtcgacccggagcgaccgaaagcgcgtgcccggctcgacggtgagggcgtaggtcgagacgtgcccaatgccgaggtcgacgacgccggccaaggtgcgtcgccacgacgcgtcatcctccagcgggtcaccgaagatgagatcgacgctcaccctgaggtctgcgaacgcctcgacgaccgcacggatccgtccgagcgcatctgctgcgttgtgtccacggccgaggtgggcgagcacgcggtcgtcgagcgactgcagcccaaccgagatgcgcccgacaccggcctcccgccacctcgcaacccgccccacggagagatcctcgggattgacctcgatggtgacctcggcgccggagacggggcgcgcgagccgaatcagcctcgcgaccgcgccgtcatcgaggtaggagggcgtccccccaccgagaaagaccgaggtggcgcagaagcgttcgtcgacgaggccctcctcgacgcggttggcaagctcgcgttcgacgtcgtcgacgaagtcgcggtcgggctcgcgaatcgcgaccgagaagtcgcagtaggcacagcgtcgccgacagaacgggacgtggacgtagagcgccgcctcccggaggggctcgtcgcgaccgtcgacgctcagcgtggctccggcagggccctcagacccaagcggtcgatgtgctcgatcatgccctcgagactcaagccgagcagtgcaccgatgatccgcagatcctcgcggcgcaccgtcatgacgcgaccgttgaagtcctggcgttgcacctggatcatgccgaggtagcgctcgaggagctcacgctcgggcccctcgaggctccgcagccgctggagatcgatggtgcacttctcggtcgtcggcgccgccaccgatgccgcccgctccatctccgcgagatcgatggtgacgcgatcgtcgtcgaggatccgcgcggcacgctccgtggtgctgaccgctggcgtcagctcactcgtcggcctcgggagcagctgctcgacgtcgacccgatagaacgctgccaagcgccgcagccgcggcaccgaaatggacctttccccccgctcgtaggcgccgagcaccgaggccttgaactccttggccgagagcgcctcgaccgcctggaggctgtagcgctgctgcttgcgcaccagccgcaagcggcgaccgacctcacgtgcatacgcgcgctctgcgctgtccatcgcgatcctcctgtccgcaccatggtgagcgcgccctcgctccgctcaacctcaagcgtagccgcccgcacacgcagggtccacaatattgccaccaagggcgacgagcagtgcacccgcgaccacagccgccgtctccacacggaggatcccgcctggcaaacgcacgcgccgcacgtcggcgaggccatcgatccggccggactcaggaccgatgacgatgcagcgtacgtcgcgtcccacgaggccacctcccgccggatctgccacgacgacgccgtctcgcgggagctcgtcgagtgtgccgacgtcgtggatccgcaccacccagggcacctctgcctgctgggccgcttcccgcgcgatgcgctcgagccgaccgagctcgtgcgctgagagcggttcgccaccgcgacggtcgtggggagcgcgcaggagccacagatcggcgatgccgagctcggcgagcttggcgaccatccacgccaggcgctctctcgagggcgcatacgacgcgatcgatacctccggcgtgcgtcgtggctgcgccacgatctccccgcacgcctcgatccgagccgtccgacgccccacctccgcgagcgtcgcggcccgtacgcgaccccgaccgtctccgatccagatcgatgcccgaggcccgagtcggcgagcgcgcaggtgggcagccaaggcatcgtcgacgaccggggcctcgagatcgtcgacgatgaagaacggttcgaggcgtccggttgccccgttggcgtcgcgacccacgcctacttgaaggcggaacgcagcttcgagagcagcgactggtcgtgatgctcgctgaccagctcaccacgcagggcagcgaggcgccgccacagctcgtcctcctcggccgtgagctcgctcgggatcgtcacctggacctcgacgatgaggtcgccgcgcccgcgacgacccgacagcgcaggcacacctctcccccgaacgcgcgtcgcccacccaggctgcgtgccggcggggatctcgatgacctcgagcccatcgagcgtctcgagttcgagcttggtaccgagcaccgcctgcggcgccgagatctggacacgggtgatgagatcgttgccgcgccgctcaaaccgctccgacggctccaccagcacgtggacgtacagcgttcccggctgaccaccacggggcgctgccggccccttgccggagagcttgaggaccaacccattgtcggcaccaggtgggacatcgaccacgaagcggcgctcctgcgtgcgtcgaccctcgcctcggcagtcggggcacgggtcggcgatcaccgttccctcgcctcgacagacgtcgcaggtcgccgtggtcaccatgcgcccgaggaacgactgggtgatccgcctgaccgcaccggttccctggcactgcgagcacacacgcggctgggtgcccggccgggcgcccgagccttggcaggtgccacacaccgcgggcatgcgcagggagatctccttctgcgccccgaagacggcctcttcgaaggtgagccgcacctcggtctcgatgtcctcgccgcgacgctgggccccttggggctgctgcgtgaacccgccgaagacgctctggaacaggtcggagaagtccggcccgaacggcccgccgccgaaggggtctccgggcccgaacggtccgccctgaaccgatcccgtccggtcgtaggttcgacgcttgtccgggtcgctcaggacgtcgtaggcctcggtcacgagcttgaagcgctcctcggcgcctcgatcgccgccgttcacatctgggtgcagctgacgagcgaggcgccgatacgcgcgcttgatctcctcactggaggcgttccgagacacccccaggacttcgtagtagtcgaccacgtcactcctcatcgtcgacgccgcacgcggcgttacccgaccgcctctgccacgccctcgcgcagcgcctcgaccaccaccgacgccccaccgtagtccatgcgcaccggccccaacagaccgatcgacccgacgatggtcccgtcgacctcgcacggagcgacgacgagggagcagtcgtccagagcggcgaccccgctctcgttcccgatcgagaccggctcaccttcgtcgatgaggcggcgcagcacctcgacgagcgacagtcgttgctcgatcgtttcgagcacaccggcgaccttcgagagctgatcgagtgcgctcgcggtcttggcgacctctcgaacccgaagttccggccgctcgcgcacgcggctctcgtcgatcgcggcgagggccgcgaagacgaccgcgtccatctccgcattcccgctcgggaggacggctagtcgctccgacattcggtgcccgcgcaaccgagacgcgaggaagttccctgccgcgacgacgaccgactccggcggggtcggctcgatctcgaacatcgcacgctcgagcgcaccccgcgagccgacgacgaccccaaggatcgtcggtggatccaagggcacgagatggacggcacgcaccacctcgacctccgaggaccacaccgcgatcacggccgtgtactgcgagtgctcgaccgcgagatccagcgtcagctcgaggacgtcgtcccactcaccacgggcagcacgcaggcgacccacaatctctcggcgcagccgctcgatgagcgtcgtatcgacacgcatgagacgatcgacgaagtatcggtagcccttcacgagtgggatccgccccgacgagacgtggggctgtgccaggaagccctcctgctcgagctgggccatctgcgcgcgcacggacgccggcgagagaccgaggtgggtcacatcgagcacgtgcttgctcccgaccgggacaccggtccggacgtactcggccacgaccgccatcaagatggcttcttggcgcggactcagctgctcttcgaccacgatgtgcgcgaacctcccgtgaggatgctcgccctcagtctagccgcgcacgcgcccacgctgggattgcgcccttcggcctggtctcgaggcccaggtcgctcagcctcagtggctaggcctcggtggcgctgcgctctcgattgacggctcgcatgaggcgcgacttgcgacgcgcagcctggttcggatggatgatgcccttcttcgcggccttgtcgagtcgctggatcgcggcacggagatactgctcgccgtcgtccgcggtggcgttctggagcgcacgcttgacgcgcgtcttcaactcgctccgaaccgccttgttccgctcgcgccggcgctcgtcttggcggatgcgcttcagttgtcccttgatgttggccatgactccctctcggcgacgacgctctcgaatccctgcttcgaaatcctgcttcgaatccctgcgctcgcggcgttcccgcgacaccaacccacgagcacacccgcgtacgctcgagagcggtgcagcgcaagccgcagcactcggacgacgaagtctagccgtgaggccagcgcatcctcgcacctaggctggagcgaccatggtggacccggcctcgatccgcaacatctcgatcatcgcacacatcgaccacggcaagtcgacgctctccgatcgcatcctcgaactcaccggcgcggtggacgcccgcaacatgcgcgagcagttcctcgactccctcgagatcgagcgcgagcgtggcatcacgatcaaggctcagaacgtgcgagttcgatggggtggaaccaccatccatctgatcgacacgcccggccacgtcgacttcggctacgaggtgtcgcgttcgctcgccgcctgcgagggggtcgtgctgctcgtggacgcctcgcaaggcatcgaggcacagacgctccacaactgctaccttgcccttgagcacgacctcaccatcgtcgccgccctcaacaagatcgacctgcccgcagccgaccccgatcgaacggccctcgagatcgagacggtgctcggcattcccgcctccgagatcctgcgcatctccgccaagaccggcgaaggcgtccctgcgctcctcgacgccgtcgtggagcgcgtcccagcaccgacgggggacccggatgccccgcttgccgccctcatcttcgactcggtctacgaccaatatcgaggggtcgtcagctcgttgcgggtcgtcaacggcaccgcgcgcgcgggcgcccagattcgcctcatgcaggccggcaccgtgcacaccgccgaggagatcggggtgcggctgcccgcctcgacaccggtcgccgatctcgggccgggcgaggtcggctacctgatcgctgggatcaaggacgtcggcgaggcacgctcgggcgagacggtgacccaggcggatcgtccagccgatgcacccctgccgggctacgagcatcccaagccgatggtgttctgtggtctctacccggtcgacggcgacgacttcgaggacctgcgcgactccctcgagaaactccggctcaacgacgcgagcttcacctacgagccggagacctcggccgctctcggcttcggctttcgctgtggcttcctcggcctcttgcacatggagatcgtgcgagagcggctcgaacgcgagttcgggctcagcctcatcgcaaccgcgcccagcgtgaactaccgcatcaccttgacctccgctacgacgatcgagatcgcaagccccgcagccatgccgccaccgaaccaggtcgctgagatcgccgagccgatgctgcgcatctcgatcatctctcccagcgagtacatcggcacgctcatggatctcgcgtcgacgcgtcgagggtcgctcgtcacgatgacgtacctctctcccgagcgcgtcgagctcatctaccgcattccgctcgccgaggtcgtgatcgacttctacgaccagttgaagagccggacgcgcggctatgcctccctcgactacgagcccgacggctaccaggtcgccgacctcgtcaagctggacatcctcatcaaccaagagcccgtcgacgccttcaccgcgatcgtccaccgcgaccacgcctacgactacggtcgccagctggtgacccgcctccgcgagctcatcccccgtcagctgtttgacgtcccgatccaagcagcgattgggtcgcgcatcatcgcccgcgagacggtcaaggctcgtcgcaaggacgtactcgccaagtgctacgggggtgacatcacgcgcaagcgcaaactcctcgagaagcagaaggaaggaaagaagcgcatgaagcagatcggccgcgtcgaggtaccccaagaggccttcatctccgccctgcgcatcgaccgctaaggcgacacccttcgcccaggtgcgcgagcgtcgctgcatgaggaggggcacgcgcaccatcgccatcgccgcggtcgtcgtgctcgtcggtggagggaccgcattggccatcggcgtgcggagcagccctcccacggtgccccggtcgcgctcccatccctcggcgagcaccgcggcggcgcggacgactcagggggtagcgatcactggcgcgccgacaccggaccacgtctcgacggtgcaagacgtcatctgttcgggggcgacctgcgtcgccgtcggcagctcaccctccggcgaccccctcatgtggtggtcgagcgacggcggcgccaccttccagcccagcgaggccacaatccccgccgacgtcaccctcaacggcgtcacgtgccaagaacagacctgcgtcgcgaccggcctcgcgagcgccccgccccccgcggggacgccggtggcgttcgcctcgaccgatggggggcgctccttcacacccaccacgctgcccgagggcgcgggaggggacgggctcgcctgctcgcgctccctctgcgtgctcgccgagctaccgctcgggacgggcggcgtggggtcagtcctcgtcgcgtcgcatcccctcggaccctggacgcagctctacctgtcgttcgcccctgccgcatcacccacagcaccgaccacgaacatcctgcggtcgagcggcctcgccgcctgtgccgaggacggcccctgcctcgtcgccaacgaggtcaccacgatcatggcccttcgtacgtccccaccgtgtggacactgactggaccacgttcggcacgcgtcgtcgtcgcgacaccctctgccccgctcggcggtggagggctctggtcagggatcacgacctgcgcgatcctcgcgcctcgctcgggcaccacgtactccctcgtcgtcgcgacgacgagggcgagcacgcgcgacgtcgtcaccgatccctcgggatccgcatcctcggaccaggacccattcctcgatccccgcgtcctcacctgcatcaatcgctcctgcatcatcgcatccccgtcgaagttcgcgcccgcagccctgtgggccgagcgcgacgggcgtctcacgaggcttcctaactccctccccgcctggatccagctcggcctctccgggaccgccgagccctcgcgaggcacgctcctcgtccccgcaccggcccacgacggctccatggacgcgacgctcctgcgactctcggtctcgccgacgggcgtcacgcccaagggattcgtcacgctccctccgtcgtagtgggtcagcgtgctgtcgcgccgtacgaagccgagccaaccacgacgaggaccgcggctcacaatgcctcgatgccgatcacacccgcatgaaccgccagccccgaagcaggcatgcacggtgacggtacgcgaggaccgaagctcgccacctctccccgtcatgccgaagcgagcacctcgatcgcaccaccccaacgacgctcgccgccgcgtgtgaccacgtaccaccccaccccggggatggccgagagcgccgccgcgagcgcctcacctgcgacgaggagggccgtcgccaaaccgtcggcgagccacagggtgggcgcgcacacggtggcttggctgagcgcgagctgacccccgggggcacgcacgtgatcgcctcgctccagcgtgccggacgttgcgacgccgccatcttcgacccgaagcacggccacgagggcacctcggacctggggatgtgccaccccgacccgatgatccccgcggagccagacgtccccgcctgccgccaccgaaactcgtgcaccgggcgcgagatcggcgaacgcctcgagcgcggcacgctcgacgatccaccccttggccacgccgtcgagatcgaggccgagcgggccgtggggatcgaacgcaccgtgagtgagcacccgaaggacctcagcgagtgcctcgacctcgcgcagcgccggatcgtcgaccacctcgccgcggcgccgccgtaggagtgccgagtcgtcccgccaggccgacagggatcgctcgagtgcctcgacacgggcgacgagccgctcgcaccgactctccgccgatccatcctccacgccttcgatggcgacgctcacgaccgttcccatcgcctcgaaggtgacctggctcacgtccgagcgcgctcccggtcgagcgcagcctgcaccgaggtcgcgtaggcctccgaggtgtaggtcgcgccggtgacgacctcgatcgggaggccttgtgccgcgagcacctcgtggtcgaggatgccgacggccgcttgctcaagcgcggctgagtagctatcggcggcgacgaagtggatcacttgaatcgattcgagccggtgccgtgcgaacgtcacggcggtctggagttcgccgtagccgtagttgatggtggcgccatcgaccgtggtgggagcgacgggcgcatacgtcgcaacggcgcggtgggccttcgtcgacgacgacgccgtgtgagcggcggcagaggagccgaagacgtcggccgcgagcgcatggagcgatcggagtccaccaccggcaccgacgacgatggcaaagctcgcgaccgccgaggtcaccgagagcgcagctcgccgcatcgcacctcctcagatcgtgtaggggtcaccatggatggcccgtcgcctcgcaccacgctggagtgccaccgcaccgacggcggtgacgaaggcaggcggccccgcgatccacacgtcggcgctccgcagctcgcccaccccctcgaagatggcagacaaaggcacctcgcgtcgcgagcccaccagcacccgcacgctgccgtggcgctcggccaccaacctgcggatctcgtcgccgagcacgagatccgcctcgtcgctcacgcgcacgatgacctgggggcgtgccgctgcatcgaggtcagccaacagggcgagggtcgccgtctgacccgcgcccccggcgacgaggatggcgcgtcgctcgctgcgctcggcgacggtgaacgacccgtagggaccctcgatcctgacacggctcccgaggcccacgttggcgaggtcgtcggtgaagtccccgatccgacgcgcaacgaggcgaagcccaccgggctcacgcccgtgaaggaccgtgaagggatgggcctcgagacgacgcccgggcacatcgagcctccagaggcagtactgaccgccacggaacgagagcggcctcgcgacggcgacctcgacctcgacgtagcgaccgtctccgagggtgcgcacacctgcgactcgcaggtcgagcgcgcgcgagaggcgccacggcttgatgagtcgaaacacgatcacgccgagcgccgcgaggacccacgcaacgatccagacggcacgggccaggggatggcggatgaaggtgggtccgagcgcaagttcgtgggcgacggcgagcacgagcgcgccatagagcgcgagatgcaccgcccaccagcgctctcgggggatccgagagcgcacccacggcacggagatcgcaccgaccacgacgagcaccacggcggcgatggtggcctcgacgaggcccacggacgaggtcaccacctggcccgtcgctccgaagaacgacgtgtgggtcgcgaccgcggccgcaccgatcgcgaggatgacgtgggctgtgatgagtccgatcgcccacggcgccacctggcggtgccagcgcatgacccgaggctgcccgatggcctggtcgagccatggcatccgcgacgcgagcaccaccatgatccaggcgagaaccgaccccacgagtccggtcagcgtggacgctgcaagcagcgaccctccaggggcgtgcacctccgcgagggtcccatcgaccaccggggccgcaagggcgacgccgacggccacaccaaagacgacggcaagcacgtcagcgccggcacgccgaggacgctcacttgcccaggtcgacgactccaccgcagcgctcacgcccacctccttgctgaggagcctacgggcgcgcggctcgcgatggctcgccggcgacggcgagcgatgctgggctagcctcagctccgtgcgcgtgctctggctccgaggcgacctacgctcctacgaccacgccggctggtctgagctcggcatcggcgacgcagcggtcttcgtcctcgacccgggccttgcccgacatgcgtcgcccattcgccgcgcatggctcgccggtgcgctcggcgagatcgacgactggaccgaccaccgactctcgctcctccacgcgcgccacggcgacgagctcgctgcgatctttgccgcgtggggcgcgacggaggtcctcacccatcaaggcgtcgcgccggggatccgccgtcggatcgacgccacccgccgctcgcttgaggcacggggaatcgcactgcgcgtcgtcgacagcgcctacgccgttgcgcccgggtccctgacgcgacccgagggtggcgcctggagggtcttcggcgccttctggcgccagtggcgcccggccgtccacggcctcggccccttcgaggcgaccgcaccgccttcgctcgcggtgaccgagcgccacttcgaacccgccgacctgcgaccccccgatcagccgctgctcaccccgcaacgcacggccctcgagcggctcgagcgcttcgtcgactcgcgacttgcgcactatgccgccgaccgcgaccgacccgccgtggcagccaccagcgagctctctcctgcccttcacatcggcgcgatccatccgcgcaccatcctcgccgccctcggcgacctcgatcgcgcggaccggttcgtccgcgaactcgcctggcgcgagttctacgcgcacgcgctgtggcaccatcccgacctcgtcgatctcgagctggacccgaccctgcgccagatcgcctgggacgagggcgacgaggccgacgctcgattccgggcctggtgcgacggtcgcaccgggttccccatcgtcgacgccgggatgcgcgaactcgccgccaccggctggctccacaaccgcgtccgcatgatcgtcgcctcgctcctggtcaaggacctccacctcgactggcgtcgaggggcggcgtggttcgaagccacgctcgccgacgcggacatcgcttccaatcgtggcaattggcagtgggtggccggcaccggtctcgacgcagctccctacttccgcgtcttcaacccgacactccagggcaagaagttcgaccccgacggccactacgtccgccggtgggtccccgagctccgtgcgtgcccgaccagcctcatccacgagccgtggcgctgggtgggacgagagaacgcgggctaccccctccctatcgtcgaccacgaccgggagcgacgcgaggccctggcgcgctacgacgctgcgcgcgcctcggcaccaggctcgccgcgcgcgcgacgagcaacctgagggtcgtctcgtcgggggcaacggagtcacctcgaagatcgcgtgcagcggtggcgacgagacgcacgagccgacccgcgcgctctggaccgatggcggcagcgagctcgcccagcgctcgcgcggcaaagtctgggcgcggtcgcaggcctgcttcccgcagcgctgcgttcacgccagcaccgtcgcgcgcgcccgtccccgcaaccgcgaagagctcgagaacacgccgctcgatgagcgtgagcagcagcaccgtgggcatctgcgcagcgagcatggcgtcgaggacctcgagcgctcgcgggagatcgccagcctcgatcgcgtcggtgagctcccagggcggacgggcgccgacctcgagcgcgaccgcacccagcgcctcctcgtcgacgcgaccgccctcaccaacgaccccgacgagcgaacgggcgatggatccggctcgcgagacctcctctccgagcgcccaggcgagctgatcgacgaccgctggttctgcactcagaccgacctcacgaaaggcgtcctcgatcgccgcacgccttcgatcactgcgcaggcggcgccgatcttcgacgtggttgtcgacgtgcgcgacgaccgacttcgccggctcccccacgacgacgaagacgacttcgttgggtccaggagcctcgctcgcggccttcacgagctctccggcctcgcgtgccgcgagcgcgccaagcccggtgacgacgatgcgccgacgatcggcgaacatcggcagctgcgagaacgacgttgcgagctcatggacggctgccgcatcgaccatggcgtgcaggaactccacctctgccgccacgccgcgctcgcgttcgacgacccgctggacttcgacctcgtcatcgcaggccacgaggcgaacggaggccatcgctaggcgctcgccgagatcgccgccaatgtgtcgagcgcacgacgcgctccacgcacgtcgtgcatccggaacaggcgcgcgccccgtaggtaggcgatcgcggctgcagcgatggacgcctcgcgtcgctccccgacctcgagcccaagtgtctcgccgacgaagcccttgttcgaggtggcgaccagcaccggatagccgagctcgacgaggcgatcggtggcggcgaggagggcgagcgactgcgacgtggtcttgccgaggtcgaaaccagcgtcgaggatcacctgggatgggccgaggcccgcggcgagcgcccgctccgcccgctcggcaaggaacccaacgaccgtctcgacgagatcgtcgtagtgcggatcggggtcgtcgacgcgtggggcgagacgaatgtgagtcgcgacgacggcggcatcgcccgccgcagcgacttcgagataggcagggtcgccaaagccagagatgtcgttgccgatgtgggcgcccgcctcgagtgacgcccggagcacctcactgtgccacgtgtcgacggagatggtcacgtcaaaacgacgagccacggcctccaccgcaggtaccacccgatcgagttcctcggagaggctcacctcggggccagcgcccgccttgactccaccgatgtccacgatgtccgccccggcctcgacgagcccctccacgtgggcgaggaagcgatcgaaggcgaagtaggacccgtggtcgaagaacgagtcaggggtgcgattggcgatccccatcacgaggggacggctcgcatcgagcacgcgaccgcgtgccacgagcgacggcgccggggcgacggtcatgcctagaacagcgctgaggtcagtcgccggcgccaggtcgagacccgtgggtccccctccggcaagagccggagcaggtcgaggaactcctggcgcgcctcctcgtcgcccttcacacgcccgagcaggtcttcgaggcgcgactcgatggtcgcctcgtcgagggcagcctcgccacgagccgcgagacgcgcccgagccttgagcgcagcgatcggctcggtatcggggaagcgcgcgaggatcgcttcggcctcctcgagctcgccgcggacgagcagcagctccacgagtccgaccgcagcacgctcgttcccgggctcgagctcgagcgcctgacgcagcgagggttcggtaccctcggcgatcagcacgtcgacgaccgtttcggccggggcgagcttcgtcacgaagtcgcgcacggcctgctccggataggcgccgacgaaggagtccacgaccttgccgtcacggatggcgaacaccgccggaatgccctgcacgcgaaaggcctgcgcgatcccggggttctcgtcgacgttgaccttggcgagcaccactcgcccctcggtctcggccaccaccttctcgatgatcgggctcagcgtgcgacacgggccacaccagggcgcccacaggtcgacgaccacaggccgctccttcgacgcctcgagcacgtcgcgttcgaacgtcgcatcggtgacatccatgcactccagtctaggagccacgcccagagggctcgtgagcccaagccctcggcacgaatggcctaggctaccggcatggaacagcgcatgttgggccgcaccggccacgcgtccagcgtggcgatcctcggatgctgcgccttcggcgacggcgacgtcgacgccaccggccactccctcgaggccgcactcgccgctggcgtcaaccacctcgacatcgcaccgtcgtatgggcaggcggaactcgccgtcggggcacacctcccctcgttccgcgaccaggtcttcctcgccgccaagaccatggagcgcaccgccgacggcgcgcgccgcgaactcgagcgcacgctcgagcgcctacgcaccgaccacctcgacctctaccagttccacgccgtgaccagcgacgaggagctcgaccagatcacggctcctggcggggcgctcgagacgttcctcgccgcgcgcgacgagggcacgacgcgcttcctcggcatcaccggccacttcctcgacgccccacgcgtcttccgacgtgccctcgatcgcatgcccctggacaccgtcatgctgcccctcggcatcgcacacttcgtcgacccggcctatcgccgcgacgccgaggccctcctcgaggcggcaaccgagcgcggcgtcggggtcatggccatcaaggcgctcgcacgccgcccgtggcccaagtccacccacgcctacgagacctggtacgagccgttggacgagccctcgcgcgtgcaggtcgccgtcgacttcaccctcagcttgccggtcaccgggttcgcgaccccgtgtgaccgacgcctgctgtccctggcgctgcgtgccgccgaggcctcccagcccctcgacgaggccgagcgggaggcggtcctactcagccaggatctcgcgccgctcggacgggatgcgggcctgtgagcacgacgagccgtcacgtcgagctgcgcgggccgagcgacgcgccggccatcgtcctcttgccctccctcggcacgcaggccgccctctgggacctggtggcgaccgtgctcgaggagcggtggcgcctcgtgctcatcgagcacccggggcatcgacccggcgccggcccgacgccggtcgcggcctcggtggaggcctacggccgcgaggtgctcgaggttctcgacgcactcgggatcgaacgcgcccacgtcgtcggggtctcgatcggtggcgccatcgccctcgccctcgcacgtgaccaccccgaacgcatccggcgcctcggcgtggtcggcgcaccgcgccgcttcggctcggccgaggcctggcacgagcgcgcagctgccgtccgcgccaacggcacagcgagtctcgtcgacggtctgctcgagcgctgggtgccaacgggctggtcggatgccaatccgagcgagcgtgaccaggtcgccgactgggtccgcgcgtgcgacgacgaggcctacgcacgccactgcgaggcgctcgccaagttcttgttcgcccccgaccgtaccgtcgaaacgcccacccttctcgtgacggggcgcgacgatccggtcgcaccgcccgcagccgtgctcgatctcgcggcctcgttcgccgccgccacggtggtcgtgctcgggcgatcacgacacctgccgtgcctgagtgagcctcgcgccctggcgaccctcctcgacgaccacctgagcggccggctcgacgactaggtcgccagagggtgcctcagcgcggcacgcaacctctcgcggccaagtccgaggtcgccgcgcaccaatgggcggttcggctcggcgaggagcggccgcagcaacgcccgcgcctcggccctcgcgaccgcctcgaagccaagcaaggctaggtgggccgtcatccactgtccatcgatgacgccgtagcccgcgtccttggcagcgacgacgagccccaggaacgccactttcgatgcgttcggcaccagcgagaccatggactcaccgacgaagcagcgtccgagcccgagtccgaacaagccgccgacgagacgacctcccagccagcactcgaccgagtgcgcgaggcctcgtgcgtgcagctcgcggtagaagcgccgaaaggtggcgtcgatccacgcacctggtcgagccggatccgcgcacgcctcgagcacggcatcgaaggcggtgtcgatgcgcacggatgcccgatcgacctcgcggagcaccgagcggtgggcaatgcgcgagagatctccctcgaggcgaagaagcgcgcgccacctgggctcgaaccagccgagcaccccttcgtccagccacatgggaaaccgagcgttgcggtagccctcgaggaccctgtccggttcgaagccgaactggacgtccacgaggtcgtcctcgtggggcccgaccacctcggcgagcgtcggcacgcgccctcgctcaggcgaggccgggcccgtcgtcgcgagcgaccaggcgacggaccgacacgggcaccgcgacaccgaacgcgagatccggggcgggctccgcccagcgcgtcggcgccccgacgtggatcacccctgcccatgcgttgcccgtgaggtcatcgggctcgtcgctcggccaaccagcggacaccttgagcgaccactccacgatcggcacgcggagcaccatggtggcgaggagctctcgacggaggggacgacgaacttccgccgttcgaccggggaggagcttgtcggtgatccgatcgagcgcgcgctctcgctccttgccctcgagcaccgtccccgtaccgaagagcaccgcggaacggtagcgaaggctcgagtggaacgcactgcgcgccacgatgagcccgtcgaggtgcgcgacactgatcgcgagcgccccgcccgccttggcatgtcgcatccaccccgacccgaccgacccgtggagcacgagcgcgtcaccgtcgcgagcgaacgccgtcggcaccacgaccggtccgtggtcgcgaacgacggcaacgtgtgcgatcagctcctcgtcgaggagctgatcgagggcggctcgatcgtcggagcgccgatcgcgttcacgggtgaggtcggtacgcaccacgcgctcacgctaccaaggtgcggccagaacgcagcgagactcaaccagccgtcgtcggctcgcccgagggcccgcgctgtccgtcggcgcgctcggcaaccgtgccatggtcgatgacgagcctgcgccgagcgcgaccggcgacggtcgagtcgtgcgtcaccacgatcagcgtgatccctcgatcccgccacaggccctccaagagcgcgacgatgtcgtcgcgcgtctgctcgtcgaggttgccggtcggctcgtcagcgagcagcacctcggggtccttgacaagcgcacgcgcgatcgccacgcgctgctgttggccacccgagagctccgtaggcaggtgctgagcccgatcagcgagtcccagctcttcgagtacccgtgctgcccgcttgtgccgttcctcggtctcgacgtgcagcggcacgagcgccgtctcgacgttctcctgcgccgtcagtgtcggtatgaggttgaaggtctggaagacgaacccgagcgcggtagcgcggagctcggcaagctcggcttcgccgaggtgcgcgagatcgcggccctcgaagcgcaactcaccggcgtctggccgatcgagtgctcccagcagcgtcaagagcgtggtcttgccctggccggtcgggccctgaatggccacgaactccccgcgctcgatcacgagatcgacaccgtcgagtgcgttgacgacggcgccgtggcgtcgaaacgacttacgaacaccacgtagctcgtacagcggctccatgtctcgaatctgtccttcggtcatgctcgactccttctcgtcctgacgcacgcttactgcacactccgaagcgcgtccgccggccggagcgaggaagctcgccaggcaccaaggccaccggccaccagcccgccgatgatggccaggccgaccgcaagtgcaatggtgtcagcctgcaagggggcactcagatgcacgaggacggttcgtacgcccgctgcctggcgcagcccagctcgcacacccgcgaagccgccgccgaagccaccaccgccaaaaccaccaccgaaggccaccgatcgaccgacggtcgctcgaagtgtcggtgacgccgccgagagagcttcggccccagcgatgccgagaacaaggccagcgatgccgccaccgacgccaaggacgagtccttcgctcatgacctgggcaacgatccggcgcgttcgccacccaatcgccttcaaggtgccgaactcacgggtgcgcctcgacacggcagccatcatcaacaaccctgcgaccagcaccgccatcaccagcgccgcgacggagatccacttcccgagacttgagagcagactgctcgtactggccagcgaccccgagacgtcgctggcaagactcgccgaggtcgacaccgtcacacctgggaggatcttggccacctcgcttgcgagcgtgctgacgttgctcgcgctctgcgcgctcacgtagatcgtcgagatgttgcccgcctcgcccgagagctgctgcgcggtggcgagcggcaggaacacgtcggccgtgctcgttggcgtcgtcgcgatgccgatgaccttcaccgacgcgcctccgacgtcgagggtcgagccgacggagagctgctgggacgtcgcatacccgctgctcacgatggcgacgtccttggtggcgtccgccgcggtgaagtacgcgcccttcgtgacctcggaaggagtgagagggccgacgccgctcgacgagatctggactccatccacgctgaaggagttgatactgaacgaaccgccgccaccactgccaaaggtcggaacagtccccgagaacgacgtgtccgtgagctggagaccgccggtcgcacccgcgacgccgcgcaaccgagcaaccttcgagacgtcagcggccggcaacgcggcctgaccacgagtcagatgcaatcggttacctgcgagacgcgcactcctcgcagctcgggggttgaaggctcccgatccaaagccaaagcgctcacccccgaagctcccgggcgttgcggtcttcgagacgatcatgtccgtaccgacgccgtacaagctgtggagcacctcgccatcggccgaacgcacgccagccgttgcagccgagaccgtcacaacgaggccgattcctacagcaagcccggccgacacgaggacggcctgtcgactgcgccgacgcagttcacgcctcacgtaggttgtgatcatcgagagctcctcgtaaccaagcgatcggtgtcaatgctgctggagcgtacggagcatggttggggcacgtctgaggaactggtgtgagcaggcttccgcttcgccggatgccgtgacacatcgctcacatctgcaacgaatcgccctcgaagcccccacgacgacccgttggcgtggcaaaggcccatttcgacgcccggttgcgcccggggattggtggagtggacagtgcccttcccccattcgaggttgacacctgcttgaggaggaagggatgagtcagacaccacgcctacccccggccgccgggaccgaatgacaacacgcagccgcgatcacctcccaccgagcggtgtcactgcactgcctggctggcctcagcccaccacgcaaggctcttcctcggcgggcgaggccagcacgcgagcagcgcggaggggccgagacgtcttcgaggtgcccgccgtgtgtcgtcactcgtggcagtttcgagctcgaccatggactcctctgacaggtcgtgtggctcgaagacgccccatgtgccgtgctggccgagcacgacagcggtgatgaggcgcacgaagccacttcgcgcccgaagaccccgacacgtggtgcgccgctcgatctcatgatgggcccgaccagagcgggttcgtgacgagatcgtgcgcgaggagctctcgggaagctgtgcagacctcctctgtggcctcggcgaccatggcgcgagccgctgggagcctcgtgggtaagcgagtcgatgacctcgtcgtactgggtcgggagtgctgccggggaggcttcgagcaaagatcgtgcggatcttgagccaggaccatctccgtagctccccttctgcgatgcgagcgagcacgtcgcgcatgctgcacgcagcagcgctcacgagttcgcccgacgaaggagctggcgatggcttggtgagcccgccctcgcccatcggagttgcacaggtgcacaccaccgagacacacgatcgctgggctccctcgagcactcgccccgcaaactctcgctctgcccatcgccgacacagcacttccgaagacctcgcacaccccggcgctgtggatgcccgtgatggccacccggatactagagatgacctggtgctcgaggcggcccatgacgccaggtggcatgggcgaagggggagcagaactcgagcgatggcccagcctgtggtgatggaaccttgccatctcctcgtcgagggatgcgacgatgcgggagacctcgccctttgcgatctccgtccgaccgcaggccgcgatgaggtcatcgacgcttcgggtgctgagcccccgagacgttggcctccagaaccacgcacgtgagagagcacgatcgacccggcggcggcgctcgccgatggctgggacgagctccccacacggagctgtgcggattgcggagctccacgtgccgcccttggtgacgagcagacggtcgcgctaaccgttgcgcttcgcgtctggcgtctctcgcctcgttcgtctcggcaagcgccgatgaccgctgctgtctcttccccgatgagggcttggaggatgagctggccccctctcgggagaagtcgatgtctccgcctgctctgatggcgccagggcacgccgggagcgtcggagggggtcagggccacctgagtggctcctctggccatctgttgtctgacacgccagagatcgctcagtggcccgccctcctcgcgtgcaggccgcccggcaatgacaccacgtggtgggatggcactgcgtccagcgcgtcgagcgcgatcctcgcgagcgggatcgaacggcggctccgctgcgtcttgacggcccctcgatgatgtgagaacctgcgacgtggcgcgaagtgcggacgtggagcgtgtcgccctcgacgtcccccagcgcagcccgagcagttcagctcggcgtagtcccgtcacgagcgcgagcacgaacaggtttccgagccgttcggacttcgcctcagcgaggaacctggctacctgctcgggggacagcgggggcagctcgacgcgaggcgcagagcgaatgggttccaccccttgcgtcggatcgttcgcgaggagccctcttgccatgccccagcgcgcagcttggccgagcacgtccctgaagagcttcagggtgcgcggggagaggttggggttgtgcgcgaggagcttttcgacgtggcggaagttcagcccgtcgagcctcacgtggccgatgatgggtgagatcgcgcccacggcgtagggatactgcgcaagcgttgcctcgcgaacgttgcgggaagcgagccaggcatcgagcaagtcggcaaccgtcttgatgcctcgctcgggggcaagcatgcgatcccgctcggctcggaacgcagcgagggtggcttcagcttcgtagcaagtgtcgcagagcttcgaccggtacacctggcggccgtcgagcgtggagcacaacgccgctcggtgcttcccatacgcgggtgtgatggtcccgtaccctcgcgtccgtcgccgtgccatgtcgtccgacgtcgcacgctcgagacgataggtcgcacgataagggcaaaaataaagcccccgagcctctgcactcggtcgtatatggcctctgagctgggcttttggagtggaggtgatgggactcgaacccacgaacctcttgactgccagtcaagcgctctaccagctgagctacacccccgtgctgtcggtagtgtagtgggtggcgtcatgccgctcgtcgatggcccgctgccggtgacggttgctgtcgtggccagcagggcgactgcgatgggggaggcgatggatctctgggtggcgaacacggatcgaaggtggttcgactttctgcgccaggcgggactcgaggaggtgaacttctggtcaccctcaccgtcccctccgagttcggcgatcgcggtcggaaccccgtggatcttccgcctgaagaagcctgattacgcacttgccggattcggatacttcgctcgcttcgagcaactttcggccaggttggcatgggatcggttcggacagggaaacggtttcgcctcgttcgaggagttcctcgatcaggtcgtacggctccgacgcctgctgaggacttcgtatcccgatcgcgacaccaagatcggctgcacgacgctcgtcggcgcctgcttcctcgaggaggatcgttggcttgcgccagtccctgggttcgagcccaatgtcgtgaggggcaagggttactacgtcaactccagtgaaggtgatgcgatctccgaatggctcgcccaacagcaggcggctgcagcactgccggagtcggttgccgcactgcccgtggctgggtacagggaggcgctgactcgcgtgcggctgggtcagtatggcttccaggcgctcgtgcgctcggcttacggggggcgctgcgccatcaccggagaatcgaccgctatcgcgctggaggccgcccacatcgttcccttcgcgctcgagcagcgccacgacgtgcggaatgggttgttgctccgagccgacttccaccgactcttcgacgccgggctcatcggggtggatcccagcgaatggacggttcgcgttagccctgcgatcgcggacccggacgagaatggccagctctacccgacctaccaaggacaactggccttcccccctccaggttgacacctgctataggaggaagggatgagccagacaccgaacccaccaccgggcgacggccccgctggacgacgacgcggccgctacccgagccagttccgcaaggacgcggcagcgttggttctcgaccagcgccgcaccatcgctgacgtcgcccgtgagcttggcatcaacgagcagacccttggtaactgggtccgtcaggaacgcatcgaccgaggtgagcgagagggcctgacgagcgccgagcgcgaggagctgacacggctgcgccgccaggtcaagcagctcaccgtggaacgcgagctgctcaagcgagcgatggccttctgggtgaaggaggggggacagtgagccgctaccactggatctcccgccaggaggccaagggcttctctgtagcggcagcagcacgagtcatcggggtctctcgccaggcctactacgcctggcgacaccgtcgggaccgaggcgaggatcccgagcacctggtgctcgcgagcgagcttcgcgccatctggcacgagagcgacggcacctacggcagcccccgcatcacccacgagctgcgacggcgcgggttctgcgtgaaccacaagcgggtggaacgcctgatgcgcgagctcgagatggcagcgggcccacgccggcgcttcgtagtcacgacgaggcggggagaggacgcagcgctcccggacctcgtccgtcaggacttcgctcctggtgagccgaagcgcaggtatgtgagcgacatcacctacgtccgcaccgatgaggggttctgctatctcgccacggtggcagatcttggctcgaggcgcatcgtgggctggtcacttgggcgtcacatgcccgatgacctggtggtcgaggcgatccgcgaagcactcgggactcggggcagcctggctggggcgatctttcacagcgatcgcggcagccagtacctctcccggaaggtacggagcctgctcgcgacccttggcattcgccagtcggtggggagggtcgcgacctgctacgacaacgccgtggccgagtccttcttcgggagcttgaagcgcgagctggtggctcgctaccgcttcgcgaacctctcaggggctcgctctgccatcgctagctggattcaccgttacaacacggtccgcctgcactcaagcctcgggtacctaccgcccgtcgagtacgagctctcctgggcctgccgggaggtggccgtggcctaaattcagactgtcaagcaaatggggggaagcccaaacctctgaaagtcgttcctcgcgaccggcagtaccagcctgacccggagcgactccgctggcacctctcgcacgtcttcaagggctagcggccctccccgagactcagggccgagatagacgcctcctgcgacacttcgacgcggacggtcgacttcatgtggccttcccccatttgcttagcagtctgaatgtaggccgcggccacctcctcgcatgcccaggagagctcgtactcgacgggcggtaggtacccgaggctcgagtgcagccggaccgtgttgtgacggtggatgtaggcagcgatggctgagcgagcctcagcggattcaacgacatctacggcctcatccaggccgtggaggacggcgcgacggtgcgggtctactacgaggcgaggcttgcgaaggtcgagctgcccgacgaagcacggggagcgctcgatgcggagttcgacgaggtcgccgaggcaatggagacggagtccagggagcgtctcaagacccgttgggcgcgcatcgaggccatcgtgggcgccgagaagcgcatcgccgccgtcgcggccgacatcgtcgagcactgggagaagcgccgcgccgccttgaccggcaagggactcatcgtgtgggcttccccccatttgcttgacagtctgaatttaggccacggccgcctcctcccgggcccaggtgagctcgtactcgattggcggtcggtacccgaggctcgagtgcagccggacggtgttgtagcgatggatccaggctgcgatggctgagcgggcctcggcgaggttcgcgaagcggtagcgagccaccagctcgcgcttcaggctcccgaagaaagactcggccacggcgttgtcgtagcaagtagccaccctgcccaccgactggcgaacgccgagggtcgcgagcaggctccgaaccttccgggagaggtactgattggcgcgatcgctgtggaagatggccccagcgaggctgccccgagtccgctgggctccctcaatcgcctcgatcacctgttttcctggcatgcgacgctggatcgaccagcccacgatgcgcctcgagccaaggtctgccaccgtggcgagggagcagaagccctcgtcggttcggacataggtgatgtcgctcacgtaccggcgcgctggctcacgaggagcgaagtcctgacagacgagatctgggagcggtgtgtcttccccacgcctcgtggtacgcacgaagcgccggggtgggcacgctgccagccccagctcgcgcatcatgcgctccacccgcttgtggttcacgcagtaaccacgtcgtcgcagctcgtgggttactctggggctgccgtaggtgctgtcgctcgcctgccagatggtgcgaagctcgctcgcgagcaccaggtgctctgggtcagggcctcggtcccgacggtgtcgccaggcgtagtaggcctggcgggagaccccgatgactcgcgctggcaccgccacgggcaagccgttggcctcctggctggcaacccagtggtagcggctcactggttgccctccttcaccgagtgggccatcgctcgctttgccagctcgcgttccatcgtgagctgcttgacctgccgacgcagccgggtcagctcctcgcgctcggcgctggtgagaccttcgcgctcgccgcggtcgatgcgttcggagcgcacccagttgccaagggtctgctcgatgaaggcgagctcgcgggcgacgtcggcgatggttcgccgctgatcgaggaccaacgctgcggcgtccttacggaactggctcgggtagcgacctcgtcgacgtcgagctggcccgtcggccggtggtgggttcggtgtctggctcatcccttcctcctatagcaggtgtcaacctggaggggggaaggccagtgtgcatgagtcgccgtatctgcgtagagctctacgaccagatcgtcaagctccgcgccgactggcatgccgacgatgacgccgccggcacgatcaaggtcgtcatcacgggttctgcctcggacggtcctgagctcaactaccacgtgcggagcaaggagcggctcgcagcactcaagcagcgcgcgaaggatcctgacgatcccctcgagctcgtcatcgtgcgcgacatgtggctcacggggttcgactcgccatcgctccacgcgatatacggcgacaagccgatgcgcggagccggtctcatgcaggccatcgctcgcgtcaaccggacctttcgcgacaagcccggagggctcgtcgtcgactacatcggcatcaccgagagcctccgggcggcccttgcggagtacaccgagcgcgatcgagctcgccaggaggtcggcgcacccatcgacgaggccctggccgttcttgaagagcaccacgaggtctgctgcgagctgctctttgggtgcccgtggcgagaggcgctcgagtccgggagcgacaaggcgcgcatcgaggcgatcatggcagctctcgaacacctcctcgccggcgctgacatggagctaccggagcgcttcctgcgccacgtccgcgcagccactcagagcttcgccattgccgtagcctctcccgaggcggcccgctaccgcggcgaccttgccttcttccaagcggtggccgtcgagctgcggcgagcgcgggctgaggagcgggcaaagagcgatgaggtcgagctcgagacggcaatccgtcaggtcgtctccgacgccgtgacggcctccggcgtcatcgacatctacgccgcctctggtttcggcctccgcaccccggctgatgtccactatgacgtgctgaggggctccgagcacgccgggccgaggcgctggaagctgcctggcgtgctcaccccgagcgcttcgtgcgcatgcggcccgaaccaccccggctccctacagccgtctggatcaacccaccggaggaggtgagcacgacgacacagtggaactgaaccggacgtgtcactcagaggttgacaggctccgagaacgccgaagggatcaccaccgagcgcctcgaggatgcgtgccaggtcgtcatcggggatcgccttaccggttgcccgctccccgcgagctggacgggacgcagccgcgacgttgcgctcgacgagccgcgaggtctccacgtaggcaagcatggctcgcaacgtggtgcgcacgaggcgaaccgacgacgtgctgagcccctcgagcgaggcgaggaacctatcgacgtcaggggtcgtgacggcggcgagctcgcgccctccgagcgcctcgacgatccgctccgtggcccatcggtactgcgcgagcgtcgaggggcgcacctcggtcgccttgagcgtgagccaggcttccgcgagctgacccagggtacggatcgtctggcgcgacgcgagcccagcttgggccgtcttgcgaagccccgcgagggcgagcacagcttcggccttggtgtcggccactcgcgagacgtagcgcaagcgcccgttcgggagacgttcggggagcgggtacctcgccatccaccgatccccgtagcggtgaaccgcgccctcacccttggccctgcgcgccttgcccgtccgcacgtgtccaggcaagttcgccaaacccatagccgcaacgatggacgcgatcttagggggttatagtggcgtgcatactgatgcacagatatctaccaggggttttgagtggaggtgatgggactcaaacccacgaacctcttgactgccatcaagcgccctaccagctgagctacacccccatgctgggtcctcatactggggcgcgcccgagtcccgcaggacgccgagcgccctcaaggcgcgccgtaggctggtgggcatggccgaggagtacgacccacccgcgctggagcgctcttggcaggagcgctgggacaacgacgagacctactacgtctccgccgacgatccgcgtcccaagtcgtacgtcctgtgcatgtatccgtacccgtcaggatctgctcatcaaggacacgtacgcaactacgccttcggcgacctcaacgtccgctaccgcaccatgcgcgggcatgcggtgctctctcccttcgggttcgactccttcggactccccgctgagaacgccgcgatcaagactggggtccaccctcgcctgttcacagaggaacggatcgctgaactcaaggcctccgtcaagcgactcggtaccgcctacgactggcgccgcgagatcaagagccatgaccccagctacatccgatggacgcagtatctgttcctgaagctctacgaagctggactcgcctaccaggccgatgcaccagtgaactggtgcccgggttgtcagaccgtgctcgccaacgagcaggtgctccccgacgggacatgcgagcgcagcggtgacgtcgtcgtcaggcgcaatctccgtcagtggttcttcgcgatcacgcgctacgccaatgagctgctcgacaccctcgacgaactggcctggccggaacgtgtcaaggtcatgcagcgcaactggatcggcagaagcgagggggccgagatcgacttcccactcgcggacgatcccacgcgctccatcacggtcttcaccacacgaccggacaccattttcggggtgacctttctcgttctcgcgcccgaacatcccctcgtcgagtcgatcacaccaccagagcgtcgcgacgaggtcgaagcgttccgagccgacgtggcgacacgctccgaactcgaacgccagagcgatgtcgcaagcctcgacaagcgcggactcgcactcggcatctcggtgcgcaaccccatcaccggtgacgaagtgcccgtcttccttgccgactacgtcctcgctcactacgggacgggcgccgtcatgggcgttcccggcgaagacgaacgcgacttccgcttcgccaccgcatacggactgccggtcgtcgaaacggtgacgcgcccgagcgaccatcccggcggcgcatggtcgggtgatggcaccaagatcaactcgggacccttcgatggcctgagcgtagcggcggccaagcgggccgtcatcgaagcgctggagcagcaaggggcgggccggagtcgaaccgtctaccgccttcgcgactggctgatttcccgtcagcgctactggggctgtccaatcccgatcgttcactgctcggcgtgtgggaccgtcccagtacccgaggaccagctacccgtcctcgctcccgacgacgtcgagttcctccccaccggcgagtcgccgcttgctcgccacgcgggcttcgtgaacaccacctgcccacaatgcggcggcccggcacgccgcgagaccgacaccatggacaccttcgtcgactcctcgtggtacttcctgcggttctgcgaccccttcagtgaagatcgcccgttcgatatcgccgcggtcgaagcgtggatgcccgtcgatcagtacatcggaggcatcgagcacgcgatcctccacctgctctacgcacgcttcttcaccaaggccctcagcgatctcggcctcatccccgcgacgcttcgagagcccttccgacagctcttcacccaaggcatgatccgcttccatggctcgaagatgtccaagtcgaagggcaacctcgtcacgccgcagcagtacttcgacaccgtcggtgccgatgcgctccggctgtatcacttcttcgtcggtccgcctgcggacgacgtcgactggaccgaccagaccgacgagatcatcgagggctgcgcccgatacctccaacgcgtctggcggctggccgagcgcattggggtcacggacacaccgacgagcgccccggtggcaaacgacctcgccatcgccatcgagcgcctcacccaacgggtcacggatgcgatcgagcgctggtcctacaacgccgcggtcgcagcgctcatggagctcgcgaacctcctcggcgacgagcgcctcctcgcccagcccgacctcgccgacttcggccttgcgcgcctcctcacgatgctggcgccgttcacaccgcacatcacagcagagctcttcgagcgccgctatgggcgcaacgtgcatcgcgagccctggccaaccgtggatcacgaactcctcgcgagcgcccggactaccctggcggtccaggtgaacggcaagctccgcggcaccatcgaggtcgacccttccatcgaggagtccgaagccatcgacctcgctcgcgccctcccgtccgtcgacgcagcgctcgcaggtcgcgagcccgagcgctgcatcgtacgactccctcgaatcgtcaacttcgtggtccgctaggagtcccctgaacaactcctccacgtagggcggctacgggaagcgcttccctccgcctgtcaagcgccatttgcccagctcagctagactttttgcatgctgggcaccgaatcagaccaggcacacctcaccgcgacggaggccttctgctcctcgctcatcgagccagggtccatctacgccttcctcgccgagcaccgcagagagctcttccccgacgagcgcttccgccatctctacccctccacgaccggcagaccctccatccccgcctcgagggtgctcgcggtcatggtgctccaggtgctcgaggggctctcggacaccgaggcgacagagcaggtccgctacaacctccgctggaagtacgcccttggtcttgatctcgaggacccaggctttcaccccacggtgctcacctactggcgcaggcgcatcgccacctccgagaccccaagactcatcggcgagctcgtggccgaggtgatcggtgccacgggggtgctcaagggcaagacgaagcgcgtcgtcgactccaccgtgctcgccgatgcggttgccacccaagacaccatgacccaacttgtcgcccagatcaaccgggtacgcaggctgatccccgaactacgcgacattcctctgtcaccagcgatcgactacacccgcgcaaagcctgccatcgactatcgggacgaagaggcagtggtgcgcacggtgagtgccctcgtcgccgatgccactgcccacctcgcccatgcagagaagctcgcatccctcaccgagccacagaccgaagcccttggtctccttgggctcgtggcgggccaagacgtggagtgtgtcgatgccaaggaaggtcgctggcgcatcgcgaggcgggtagccacagacagggtcatctccaccgtggaccctgacgctcgccacgtccacaagtcccgtgcccgtgccatcgatggctacaagggccacgtggccgtcgagccagacagtggcatcgtcaccgctgcgaccatcacgaagggcaccgtgccggacgcagcagtggcgagcgagctccttcgtgacgaggacggcccgcgcacggtctatggcgacagcgcctatgccacgagcgaggtctccaacgagctcgccgctcgtggccacgacgaggtgatcaagcctcggccccttgccatggcggtccctggtggctttaccatcgatgacttcgtcgtcgaggagggatgggtcagctgtccccaaggacaccgagtacccatctccgccaagggtcgtgcttcctttgtcaagcactgcaccggctgtccgctccgggatcgctgcacgcgctcgaagcgaggacgggtcctcaccttcacccctgccacctggcacgcaatcagccagcgggcgcactttggggaccctgccgttcgtctcgactatcagcgcacccgaccgaacgtcgagcggatccacgcacagctcaaacgcaagctctccggcgcgaggctgcgctacctggggctcgtgcgcaaccgactccacttcgagctgctctgtgccacctggaacctgaaggtgctccttcgcctggggctcacccgggtgggtggtggctgggtgcttgccacctgagaggcgctcgggtcctctcctcctcgccccacaggaggggcgaggaggagagggtgaggagcgagatgggaacgggtcagctgggctcgttcccgggctgggtgggcgtgctcagccaccaccagggaggggcttgttcagagggctcctagcgcgacccgctctgctcgtgtcgccgaggtgcactcggcttgcgttccggcgtcgatgctgcgctgcgtagacgtcatacgcgcgagcggcccgatccggaggtcatgccacgacggagctgggccgggccgagacgagcggatctccgagcgatccggcaccccgacccaccccggtggcgtgccgtcggggagcacacgaccacggcgctcaccggtctggagcgagcaggccacaccaagcgagcggcctgcctggcccgtgagccgcaggccccaccgctatactgggaggcccgcgcgcctctagctcaacggcagagcaacggactcttaatccgcaggttctgggttcgaatcccagggggcgcaccggccggttgcacgcacgagaggcgtctcgtggccgcgccacacgtgtgctgggctcagctgtgccgagatctcagctgtgccgagatctcagatgtgccgagatctcagatgtgccgagatctcagatgtgccgagatcaagtgtgcagaactcaagtgtgcagagctcggtccgcaccgtgaggcggcctcctccattcgggttccacactcccccgtcggatgtgcccgtccgctgcagtctcggcccagctccccaggcgtcaagggctcggagcgtcactcgccgtgccatcgtcagcggtcgatcacgccgtagcgagcctcacccgcaccggtcatgagtccccagtactgatccccccacgaccagtgccaccactccgtcgggtagttgacgagccccaccgccacgagcaccgagcgcagcacgctccgcatgcgtcgtgcctctcggccaatggtctcggcgtcgaagaagcatcgacctgcgctctcctccggactcgcgttcaccgccgatcccatgtccacttccgcgccgtcggctccgacgagcgtcaggtcgacagccgccccgcagcaatgcggcgggaatccgtccggaggcgctacatagcggctcgccagcagacgagtccgctcgggatctgctccccgattcgcctccaggagctctgcgtagtactcctcgaagtagcgccgctgcagctcgcgggaccggaagccttcgacgaccgcgaggcgcagtccctcgggcagtgcacgcgccgcacgcaccaggcgctccgccaatccctcgcgcacgaaccgatggttgccggtcccatcgtcgagccgatcgtcgatcacgatgagatcgcgctcgccgaggtccaccagcggctcgccgcactcactgacgggaacttgctgcaccgcctggtcgccgatcaagaccacaccaggtggcacgaggctcatcgcacccacctcgagaggacttcttcgtcgtctcccagcaccgtgtgcatcgtggccaccctcatgcgtgatcctcaggcatcggcaggtccgcgaccggcgcgcctccaagcgtgctcgcaccccgacgcgccagtgtgacgacaaccccgacgaccacgatgaccgccgtgatgatgaggtcgcccttcgactgctgactcaacgcgagcacgacgcccccgatcgcaacgacagcaggaactggccacagaggcatacggaagacgccactcgagcgccgctcgcgcaccctggcgacgagtgccgacaccgcaaccagcaggtagatcgtcacgatgatcacgccggtgaaggtgatgaggttgttgagcgacgtgaagatcgcaaggatgccgttgccgacgaagagcaccagaaacccccaagtcggaaccttggtgcgcggtgagacgtgggcaaagaagcggttcagcgccgcaagcggccacatctcgtcacgtccagaggcgtagtagatgcgcgcataggcaaggttacccgcgagaccagtatcgaacatggcgatgatcaccccgacgagcaggatcttcgcccccgtcggacccatgacgcgatcggcaatcaacgagagtggtgacgcgctctgtgccgtgtgcgccagaccgtggatggccaaggtagcagccaccaccgcggcgagttcgaagagcacgctgatgcccacggcaagcagcacggctcgaggcagggcgcgacgatccgtggtctcctcggcaaagtagagcggccagtcatagccgttgtaagcgaacagggccggaacgacggcgatcagcacggcagagagcccgaccgttccgagcacgcccttcgaaccgatcggaacgacgggatggacgagcaggcgccccgggagcgccgggtgcgcaaaggccgcgatcgcaaagacggtgatcaccgcgagctcgagcaccagcatggcggccgtcatccagctggtcggtgagattcgatcgagcgacaagagggtgatgatcgccatcatggcgaacgccgtccagttcaccggcagcgccggtgccaacgattgaagatacgtcgccgcagcaacgaggatcgacgcggtgacgacaaccccgagcacgaggaagagcacgttgaccacgccgccgccgatcgggccgagggctcggcgaacgatcgtgtaggcgccccccgcagagggaaacagcgagcctacctccgcatagcacaacgccatcgcgatggcgatgaccgcgccgatggcgaacgccgcgaccacgccggtacccgcagtcgcgataccggctccgaacaccaagaacaccgacgtcgtcggcgagatcgccgccaccgcgatggcaagcacgttcatgggacgcagtgcacctcgagccaagccctgcccgccccccgtgcgctccctcgtcatcactccccctccttcgtggcacgtgggacgatggtagcaaagcgatggcagaatggtctgacctttcgtccattgttcacgctgccgtgatctgtcaggtgccacgagggcgccgcccgatacgatgatgcgacgtgggccgagagcatcagggggcggttcctcccatcgccgacgtccggggccacctcgatctctcgcgaatcctgcgacctcagagcgcaccagaccagatcgccgatcggatcctcgccgccatcgccgtcggcattctctaccccggcgaccggttgccgcccgaacgcgagctcacctcgcgcctcggcgtctcgcgggccacgctgcgcgaagccatcggccgcctcgccgccttcggtgttctcgagacccgacgagggcgcgggggcgggaccttcgtgactggcgtgcatcgcgagagcgaggaacgcgcagcgctcgaacgagccctcgcgccgatcaagtcaacgctcgaggcactcctcgattaccgcaacgtcgtcgagcaggcgctggcccgtgccgctgccgagcggcgcaccgatgacgatgtggctgcgatgcgcagcgccctcgccgcgtacgaggacgcagcgagcgcccaggcttctcgcgcagccgatcgcgcgctgcacgaggccatcgctcgagcgacccacaaccctctcctcgaacgcgccaacgcagaactgttcgaggggacgaacctgggctttgactcccatccgtactcgccacagctccatgcgaaggctcgccagcaacatcgcgccatcgtggacgcgatcgcacgacgcgacgtcatcgcggcgggcaccctgacacacgagcacttcctcgtgaccggaacgtacccgctcatcgatccggacgagcccgatcacaccgctgcgcgagcctcgacggcctgaggcgctcacctcggggcgcggccaaccccacgctcgcgcgacagccttcccgcgcggcaccgccagcacgggccgtcacgaaggccaacgcgcaccgatcgccccgcgccaacgcgcgcgcgtcacggacacgaccgcgatcgcgcccgagcgcgacgaaggccggctcacccgatggcggcagcgctcgcgggatcgaagaagtagaggcgctcaggatcgatgccgatcccgacctgctgaccgctcttcaccgactggtcggcatcgatcctcgcaatggcctccgcccctccaccgacgagacccgccgcgggttcgagatcttcctcgtcgacctcgaggcgatagggggtcgcgtctacccgaacgtgcacgagctgttcgttcccgagctcctcgaccagctcgaccgttgccgcgagtgagttcggctcgccgacgctgccgaaacggccgagcgcgtcgggtcgcaccccgacgatcaccgcaccaccgacgtgcgccgcgatggccggatgggcggcgagaaaccgttcgtcgaggccgatgcgctgcgaaccgagcatgagagcgacaccgtcgtcacggacgagggatccctgaaagaggttcatcgcgggcgagccgatgaagcccgcgacgaacaggttcgccgggcgctggtagagggtttggggatccgcgtactgctggagctggccgcggtgcaagaccgcgacccgatcgcccatcgtcatcgcctccacctggtcgtgggtgacatagagcgcggcgacaccgatcctgcgctggatgcgaaggacctcggcgcgcatctggacgcgaagcttcgcatccaggttggagagcggctcgtccatgaggaacacattcggctcacgcacgatcgctcgccccatcgcgacgcgctggcgctgaccgcccgacagctgcgacggcttgcggtcgagcaacggctcgagtccgaggacatgcgcggcctcgcgcactcgccgctcacgctcgccgctcggaaccttggccagcttcagtgcgaagccgatgttctcctccaccgtcatatggggatagagcgcgtagttctggaagaccatggcgacatcgcgctccttcggcgacagatcgttgacgacccgatcgccgaagcggatggtgcccgaactcacctcctcgaggcccgccaccatgcgcagcgtcgtggtcttgccacaccccgaggggccgacgagcaccacgaactcgccgtcctcgatcgccagtgacagatcatcgaccgccacgacaccgttcgcatagcgcttcgtgacaccgtcgatcgtgatgcttgccatggaccctcctacgacgcggacgactcgtccagatcgaccacaaccacctcgctcgaggcgagctggagcgtgccccccacgcgctcgctcccgcgtcgccgagttccaacgagcacacgcccgccatccacgtcgacggtccggtcgccgtcggcaaggttgacgtagacctccgtctgcgttcctcgtcgaaagcgaaggacaccctcgggcgcatcgaggaaacgaatcccgccaacgacgaggtcctcacgtgcacgccgcgacgcgatgatcgccttcgtgcgcgcaagcaccgaggtcggatcggcgagctgctcctcgacgctcggatcgtcaccgaagggcagccacggctcgaccgagggcgccgtgaacccggcgccaggtcctggttgccatcggataggggtgcggcaagggtcgcgcgagacgttgccaccatcggcatgctggcccatggggtcgcggacgcgctcgggcggcaccgagccatcgcgcatgccaagttcgtcaccggcgtagagcaacgccgcgcccggcaggaggaggatcagggcgaccagcgcgagcgctcgctctcggtcgccatgagcccagcgggttgcgagcctggagacgtcgtgattcgaacccgtccagagcgggatcgctcccaccggcagcgcggcgatcgtcgtctcgatcacccgacgcagcgaagatgcatctggctcggacgccatgaaccccacgttcaggcacagatcgagttcgggcgcctccgccgagccgtagtagcgagcgagttcgatgggatcgaggacccaggtttcgccgagcaacacgcgggccggttcccacttggccaccagctcatgccaccgacggtagatctcgtgcacctccgggcgattggccgagtagcgcttcagcttccctgcccaggcgatccacggatgcgtgccgggaggggccggaggatcgtcgcgccccaaggcgtccttcacgagcccgtgcgccacgtcgatgcgaaacccgccgacgcctcgctccagccactcctcgaggatcgcttcgaaggcggcgcgtacctcggggttccaccagttgagatcgggctgggtcgggaggaagttgtggaggtagtactggccagaggcgggatcgagcgtccacgcggacgaccctgtggcatcgacccagttgttcggcggcccaccatcggcgcgcggctcggcgaacacgtaccacgcacgtctcgggctcgacggatcagcaagcgcctcttggaaccacggatgctgatcgctggtgtggttcggcacgagatcgatgagcacccgcagacctcctgcctcggcatcggccatgagtccccgaaaggccgcctcaccgccgagtgccgggtcgaccacgtcgtagtcggcgacgtcgtagccccagtcggtccgtgggctcggcatgatcggtgacagccagatcgcatcgaccccgagcgtccggaggtagtcgagtcgctggcgtagaccgccgaggtctccgagaccgtcgccgtcgctgtcggcaaacgaccacacgtacacctgatagagcaggcccccggcccaccagcgtcctccggcccgcgctgccgcgagcgtcgcaccaagttcgtccaccgagtccattcgcgccgatgcctcctaacccttcaccgcgccagccgtcaaccctgagaccacccacttacgaaagacgaacacgaggatcccgatcggtacgatcgccacgacagcggccgcgaagatcgtaccgaagggaatcaccgtcggcgatccgaagagcgcgatgcccaccggaatggtccgatagctgttggagctatcgaaggtgagcgccatgaggaactccgtccagcaggccgtgaaggtgaagatccctgcggtgaagacccctgggagcgcctgcggcaggatcaccgaccagacggtgcgcagcgtggatgcgccgtcgacccgggcagcctcttccatctcatgggggatgccgaggaagtagttccgcaagatccacaccgcaaagggaaggttgaacgccgtgtaggggacgatgagggcctgatagctgttcagccaattgagctggcgcagcaccagatacagcggcggcaccaccgcgatctcggggaagaccgagatcatgagcaggaccacgagcaccaccgcgaccccgcgcatgggcagccgaccgaacgcgtagcccgcgagcgtcccgagcaccagcacgagcgcggtggctcccagcgtgacgatgaccgaattgagcacgtaacgcccgaagccgtagtggacgaacgcactctggtagttcgccagcgagatcggattcgggatgtactgcgtaggcgaagccccgatgttcacgggggtcttcaacgacgatgcgagcagccagtacagcggtgccgcgatcaagaccacgacgagtgccacggtagcccaccgcccgacccgggcgaggggacgttggcgacgagcacccatcacgcctccttcgccgcgccgacttgggcgcggaagactcgcaggaacacgatgcaaccagccagcacgagcgcggtcgtcgtggtcgcaatggccgcacccggtccgaaactcacatcctcgaacatcaccttgtagccgagcagcgcgagcgacgtcgtcgacgtcccaggtcccccgccggtcagcacgaagggaaggtcgaacagcccgaaggcctggagtatacgaaacagcgtcgcgatcgcgagcgtcggccgcaggagcgggaaggtgatgcgccagaacgtcgtccagcccgaagcgccgtcgatctgggccgcctcgaagacgtcctccggcagcatcacgagacccgcgagcacgatgatcccgacgaacggcgtcgtcttccagatgtccgccaccatcatcgagatgatcgcaggagtcggcgtcccgaggaacagcggatggccaagcccgaccgcctggaacaaggcgtcggccacgccgtaagtcccctggtagatgtagccccacagctcggccgagatcaccgtgatcatcgaccagggcaggagcaagagggccatgaagagccctcggcccttcgtcaaccgcgccgccacgagtgcgatcagcgtgccgagcacgacctcgacgaagaccgtgatcacggtgtagccgaccgtgaactcgagggcgtagcgccatacggcagcgtggacgatctcgctgtagttggcgcccgtcgcgccgccgagctggaagcccgcgccggtcacgttgacgttggagagactgagcacgatggagaacacgatcgggaagaccgtgaccgcgccgatgacgacgagcgccggagcagacagccaccaccctgctcgagccaggcctcgacgagcacgatggtcgtccgaccgttgtgcgggtgcggtccgaggcgggaccgcgataccagcgaccatagaactacctccccggcggcaccgatggccgacgatcgacctcacaaacctcgacagcctggcgtcggatgcgccagcgcggatggagctcgcccgggaggcccgagcaacgggaccctcccgggcgaggagcgacgactagatgccgccagcgagcgccgtgttgatctgcgacgccgcagtcttcaaggcagcgctcgggctcatcgaccccgccagggccgcgttcacgttggtgtaaatcgccgaggacacctgcgggtagttcggcgtgcccgcgggccgcggcacgagccgcgtctcggcagccaccttgatcgggggtgcgatcgacgggtccttcgcgagcgcgagccgcaccgactcgaccgtcgggatctccgagtaggtcttgccgaggatgtcctgagcctgtgtcgaggacatccacttgatgaagaccaggtcggcggcgaggttcttcgagtgcgggttgatgtagaggttccagccgccgatgttcgagtacccgggataggactcgccctggaaggtcggcaacggggcgacacccacatcaccgacgaccttcgagtccgatggggtctgggagttggcccacgcatagtcccagttgcgcaggaaggccgcctgacccgagtcgaagaccgccatcgcctgaggctcttcgaaggtcgtgacggccgcaggcgacgcgcccgaggtgatcaagctgcgcatgaacgtgagcgcgcgcaacgccgccggcgagtcgatggtggccttcgtataggagctgttcacgacgctgccgccagcgctcgtgaggtactccatgaagtcacaggtcaacccctcgtagctgttgccctcccagacgaagccgtacttgaccgcgttgtcatggaccagcgtcacagcatcgctctcgagctgctcccaggtcttcgggaccgggagatgatacttggcgagcaggtccttgcggtagtagaggaagccctcgtcctcgaacagtggcgatccgtacaccttgcccttgtaggtcgcgccttgcacgagaccgggggcgaacttcgcccagtagctcgacggcaaatagttcgacagtgggacggcgaagccatgcgccccgaactcggccggccagatgacgtcacccatgaacacgtcgggcgtcgacgcaccaccggaaatggtgttgacgagatccgcacggttggtgtcggtgttggtgggtgcactcaccaagttgacgtgaatcttgggataggccttctcgaaggcgcggatcagcgcggcgcggattcctacctgcgcaatggggctcgcccaccaggtgatcgtgccgtgcgcactggatagattgacgccagacgtcgtcgacgaggtcgacgaggtcgtcgacgacgacccgcaggcagcgagcagcgccatcgaccctgcgagaacgacaccgacggcaccggagcgccgcagtcgccgccgactccgtgtcgtctgctggccctcggtcgccctcgcgaactcgtgtcggttggttccgtgactcatacgtatccccctgtctcactcccggcgcgcggtcgtggccgcgcgccatcctgacacgtcttcctacgtcctcgaaccgctcgtcaccgctcgacgcggcgcggtctgcacacctgcacctcctctccgattgccgttgcgatcgccccggacccgacgatccgcgctcaaccccgacgactcgtcaggcgacacctggcgtcgtactggccccgtcgttccgcgaacgatgacctcgagcggcagccatacacggccgccgtcgacgggctcgccatggagccatgcggcaagtacccctgctgcccaggcaccactcccctcgagcggctgacgaaccgtcgtgagtccgatcacctcggcgagctcgatgtcgtcgaaacccacgatggagaggtcgtcgggcacgcgcaggccgagctccgccgccgtacgaaggacccccatcgcctggacgtccgaggcaaccgagaccgccgtcggcggcgagccgctcgcgagcagcgaccgcacgctcgccgcagcttcggcgacgccgaagggaggatggcgaacccaagcacgccgcaaggtcaagcccgcctcattgaggacctgccgcacgcctcgctcgcgctccgcgctcgcagagaagcccatgccgacggccggccgatccccgacgaagccgatgcgctcgtgaccgagcgagacgaggtgcgaggcagcgagtcgtccaccgagcacgttgtcgatgacgaccgacggccaaccaggggcatcgtggtcgacgctcacgacgagtccaccgcgctcacgcagtcgcgatgaccacgcatcaggcacctcgatcgagatcgccacgatcgcgtcggcgacaccctctccgaccaggaccgcaagggcgcgttcgcgctggtgaggatcggcaacgtccacgaggacggggtcgaggccgagcggtgcgagcgccttgatgaggccacgcacacgctcgacgaccgatgcctgggtcacgccgctcaccagcacgcccacgacgttcgactcacggcgccgcagcgaacgagcggctcgactgggccgaaacccgaggtcacggatcgcgtcctcgacgtggcgacgggtgacgtcggccaccgggccggaaccgttgaccacgcgtgagaccgtcgcgatgccaacgcccgcctgacgggcgacatcgcgaatggtcacgcgatgattccgcgccccgagacgcccaccgcgagcggtggaaccgtttccacgcacacccagattgtgcgtcgcagccatcgcgccgtcaaggaattgcctggctccgcctcaggctgtgctcaggaatcgagccaggcacctgcctcgttcgcccacgcgcccaagtccacggatctgggcgcgcgctgcgcgacaccgaggcgcgaggcctcatccggcctcgccgccaccagagctcgcgacgacgcatgccccacgcgctgcacgacgagtggtgctcgcgcgccgtcgcgcatcggccctctcgacgcaccgggtgcgcgagcacagccgaaccgctttcgcagccgccgatgccccgaccgacgatcaacgatcggccgacaggcccgagatgacgctacccccggtacctcgtggtagcgggggtagccatgcatccgagagggaatggagaaggactagcgccggaagaatccccggccgccggaggaggagccgcattggcaccgatcttccggcggaatgtgtccgagaacctgctcaacatgctggccgcagccagaccaggtcggacgcttgcactgtggacaggtcaccgctctgcacatacccaatagggtatcacgtcttcgaggacatccggccccgataccgcacgattcgcccgcgcggtcgtctcggcgtcagcgcccctcgagcttggccagcacgcgacgcgcacgctcgcgtgccccgatcgagctcacgaccgcgacggacgcgacgagcaccatcacgaccccgagcacgacgaacgcgatgctcggccagcgagcaaggatcacgccggccgcaaccagcacggtgcccacagcagcgccgaaaggcacgggttgcgcgacgacgcgataggcctgctcacgcaccaggggctcgagctcgcgcggcacgggcccacggcgcagcgcaaggagcacggcagctcgctgcgagcggtcgagttgacggaacgactgcagcgccgtccgcagacgcagatcgcggcgagatgtcgtccggagccggacgagatcgacgacgatgcctgcgaagccgacgatggtgaggaccagcccaacgaaaccgacgacccccgtcgccgcgcgagcgaccgctgcgaccatgagcacctcccgttgcgcgaggctagcgctgcggatcgccgcagcactcctacactcacggcgtggcccgggcgaggagaccgtgacgaccgcagcgaccgcactggtcgtcctcgatcttgctcaactcatcgccatctccgtcgtggccgtcaccgcgcgtcccctcggcaacgtgggccgacgggctctcatgctctggcgtgggttcgcctggatcgccctcgccgccgccaccgccatcgccacggcttcactcctcgcgtcgcaccatcgagcagccccgatcggcgtcccgacgctcgccgtcgacgagacgttcgtcgccgcggcgctcgtcgccaccgcaactggtctcgcgccgaaccttcgacggagcgcgacctggctcgccgcactcggagcggctgcaagcgcgggcggcatcctcgccctcgtccctatcccgctacttgtcatctggccggtcgtcaccttcccggtcgccgtcgcgatcgccgcgctctggcgtcttccgcgccgctggccccgaccgctccggggagcgctcgtcgccgtggcggcgatcggcctcgtggtcagcttcctcctgcatccgccccccgtctccctcgagatcgccggaacgccccaacacaccttcacgatcgccgcacccgctgcgcaacgtgcctccatcgagacgctgtcgagcggggtgctgaccgacaccgagcacaccgcccagcgatcggtgacgctgtcgctcgcgggcgtcttcgacgcttctcgaccgaacttccaccaggtcgtgaacgtcgctatccgactcgtcggccgacccgccctgcatctcgtcgtcgacgcagcgggcatcccccaacccaacggcgcactcgcgctcgtgcactcgcgcatctcgctccagaccgggcgccggttcctccgcggcgtcggacacctcacgaccttcgcccccgatgccctcatcggcacactcggcatcgatcatcatgcctggtcgatactcgtcagcctggatcccatcggcgacggtaccactcgagcaaccgtgacgctgtggccctcggtcggcctgcacctctcctgagcgccgccaggtaggctatcgcccactcggtgaccgtagctcagctggttagagcgccagattgtggctctggaggtcgggggttcgaatcccctcggtcaccccatctcgcccgccgacacgatcccccaggacctgcgacgactcacggcgacgtggtcgcgtcgcgcatgccgcaaccgcgggacggcgctcctgcacggggggcgctggtgtgaggcgtcgtctactcccagagcatgtcgctcccagaggatattgttcccagcggatattgttcccagcggatattgttcccagcggatattgttcccagcggatattgttcccagcggatattgttcccagcggatattgttcccagcggatattgttcccagcggatattgttcccagcggatattgcccccagaacgtagggccccgaggcgatgtagcagtcggaccgtgccgcgtgagacaactattgggccgacgttggagcctctctgtgccgatgtccccgaaccgacgaccctcacaagtcgctgcacggtcgcgagcactctcgcgacaccgacctcacccgcgttctggccgcatcgtcctcgggcgctcacgccacacgatctcgagggcgtcagggagctgcgccagctcgaggggacgagctcaaatggagaagtcgatgacgctctcggactgctcggcgagtcccgggagcaccgtgatggtaccctcgggggtcgttccctcgatcgtggaacacaggcgggggtcgcgacggacgacccgcgccggcgcaccgacgacgacggcgtgtgacggcatcgactcgaggaccacggcgtttgcaccgacgtgggtgtcgtggccgatctcgaccggcccgaggatcttcgcgcccgcaccgacgaccacgcgatcgcccagggtcggatgacgcttgccgtgctcgagactacgacccccgagcgtcacaccgtgatacagcgtgacgtcctcgccgacctcggccgtctccccgatgacgacaccggtcgcgtgatcgatgaagaggcctgcaccgatgcgagctgcagggtgaatctcgacacctgtgcgccgccgcagccagtaggacaaccaccgggctccgaaccgatggccgcgctcccagagtcgatgggccaggcgatacccccacaccgcatggacgcctggatagagcaacgcgacttcgatgcgcgaacgagccgcagggtcccggtggagcgccgcgtcgaggtcgcggcgcatctcgttcagcatcacgcgtccgccaagtcggcgaagagcggcgtcgagaggtaccgctccccgaaggacgggatgatgacggcgatgagcttgcccgccgactcgggccgctgtgctacgcgccgcgccgcagccacggctgcgccggacgagatcccgacgagcaggccctcttcgcgcgccatccgccgagccatctcgaaggcctcatcgttcgtcacctggacgacttcgtcgacgaccgttgcgtcataggtcccggggacaaaaccggccccgatcccctggatcgggtgcggtcccttctggccacccgagagcacgggagaagccgcgggttcgacggcgatcagctgcagcgagggtcgccgtggcttgagcgcctgaccgatgccggagatcgttccacccgtgccaacgcccccgaccaccacgtcgatcgcgccgtcagtgtcccgccagagctcctcggcggtcgtggctcgatggatcgcgggattcgccggattctcgaattgctggagcatgacgtagtcagggtgctccttgacgagctgttccgccctggcgatggcgccgcccataccttcgggacccggcgtgagcaccagttcggcgccgaaggcacgcagcagcatcctgcgctcgcgactcatcgtctcgggcatggtcaagatgcaccggtaaccgcgtgcggcggcgaccatggcgagcgcgataccggtattgccactcgtcggctcgacgatggtcgacccgggcttgaggcgcccctcgcgctcggccgcgtcgatcatggccacgccgatgcgatctttcacgctgttggcagggttgtagaactcgagctttgcgacgacggtggcccccgccccgtcgatcacgcggttgagtcgtacgagcggagtattgccgaccagcttggtgacgtcctcagcgatacgcacgcgtccctcctatcgcagagcctgcacatgctctaacgccaagcctagccaataattccgatctgttctatcgactttgtgcgcggtgggtcagcgaggtcgctccgggacccaccaccgttcctgtccgtcggtctcgacgaggccatcggcacgcagccctcgcagcgccgcttcgaggcgatggtcgtcgacacccgagtgtcgctcgaggtcgcgcaggctctggggaccggcgaggagtgctcgcaggacacgggcccgggcctcacgaagcgaaccgacatacggaccctgccgatgccgcgacacccacggatcagtgagtccctctcggtgggttcgacacgaccggcgtagctcgcacgcatcgcactgtggcgccgctcggcaccgcaacgcgccgacgtcgaagactgcctgcgtcagccgatcggcgtcgcatccgttcaccagctcgcacccgacctgctcgaggatcgagtcggatgcgggcgcgccgaggagcgcgcgcaccaggacccgacgcgcgttcgtgtcgatcgggagagcggcgagcccaccgcactgaaccgcaacggcgcgggcgacgtagcgccccaccccaggcaacgcccgcagcgcgtcctctccgacggggcaggcgccggcccacgtctccacgatcaccacggcggcgcgccacaggcgctcggcccgccggtagtagccaagtcgtccccacgactcgagcgcagcgacgagtccgccgtctgcaagcgcgcgtggcgtcgggaagcgctcgatgaaggcgacgaaggtctcttcgaccctcgcaacttgggtctgcaccaacatggtctccgcaaccaagacgtgccacggatcgcacggtcgcgcccgccagggcagcgggcgcaggtcgacctgcccgaggtcccgacgcagggcttcgagccgtgactcgtcgaggctgtctccaggcacaccaaccacggtagaagaagcacggacccgacacgagctcgcacgcgcccgctgacgggtcctcgaggcgcgccgtgtcgctacccgcacggcaggcgtgcctggtgtcctcgatgcacgacgaccgggcctcgtgatggacccgaccccgaaccgagcgacgacgggggcagttcgtcgatccgtcgccggccccgccccaggcccaatccactgcacgctgacagagggcgcgcgtttgggagctcctcgatggcacaacgccccccgcaccgagatttcgcaaggaatctttcgcaaattttgttgcgcaaggattccttcgtaactagcatgggagccatgaccgatgccgccgcgaccccacgacacctccgcgacccacgcgcgttgcgcgcactcgcacacccgttgcgcatcaagctcctcgaagccctggtcacccatggcacgctcaccgcgacgcaagccagtgagctgttctcgacgacgcctgcgagctgctcgttccaccttcgtgaactcgcacgcttcggcttcgtcgagcgcgctgacggtggtcacggacgagaacggccctggagggccgtcgccgcccccctgcacttcgacccccacgccgacgacccggacgaagccatcgcggcgagcgagcttgctcgcgtcctccagggccgctggatcgagcgtttcgaaggctggtcgcaggtggcccacacgtatgcagcaccgtggcgccacgcgctctcgacatctcagttcgtcgtctggctcacccccactgagaccaccgacctgctcgccgaactcgctcgcctgatccaggagcgctacccagaccggctcagcgatccctcgacccgtccccctgacgccatggctgtcgagatcatcctcgatgcgcaccccttcgacctcgaggctggcggagcccagcaccaatgagaccggcggttcccccggcccttcgcgagccgggctttcggctcctcgtcgccggacaactcgcatccacgctcggcgacctcgcctacgcagtcgctctgccttggtacgtcctggcccagcacgacggtccaatcctccttgcggcggtcctcgccgcctacggggtgcctcgcaccgcgttcgtcgcggtgggcggcttcatcgccgaccgagtgcggccctggaccgccatgctcatcgcagacggcacgagaaccgcagccgccgggctgcttgccgccgtcgcactccacggaccggcacaaccagccgtgctcatccccatcgccctcgtcctcggcgcctgcgaggggatctttctcccggcgtccttctcgatcatcccagcgctcatcgcagccgaccaactccaaggagccaacgcgacttcaaccgcggccacccagctcgccacgctgcttggcccggcgttcggcggcctcatcgtggggatcgcaggcccaggtaccggcttcggcatcgatgctgcgacctttgccgtctcggcaggatcgctcgcgctcatcgctcaccatcgcaccgacgacgcggtccactcacacggtccggcctcgacgagcacacggcaagcgggccccgccccctctcctccactcacgcttcggcgcctcctcgtgcacgagccggtgctgctcctcatgatcgcaaccacggtggctgccaatctcggcctcggcggcctcagcgaggtcgctctgcccgtctttgcgcgcaccacgctccacgccgatgccactggctacggcgtcatccttgccagcttcggcgccgggggcctcgtcggtgcgctcgcggcagcgcgcctccctcggctacaccgaccgctcgtcgtcggcggcaccctcctcacaagcgcgaccgtgctcctgcttctcatgcccgcaaccgcatcgctccccatcgccgcgatcgaccttgcgggcttcagcgctctcctcgccgttgcgaacatcgtcatggtgacggccgttcaactctgggccgatccgcgcctgctcgggcgcatcatgagcatgatggtgctcgcctcggtggggctctttccagtctcagttgccatcgccggtttcgcggtacgcgccatcggcgcgtcacgcttcgtcgacgtggccgggctcgccttgctcctcgctgcgctcgccgtgctcgcaacaccagcctcgcgtcgcttcgcttcaccaccagcggcgcccgcgcctgagcttgcggagcccgccgactagcgcgccttggttcacgcgcgccgccacgcctttcccccgcacgcagcctcgacctcagcgcgttccacgcgagcgaacgcgacccgtcgtggcgcctggcaacagcgcctgtccgacacgcgtagctgccacagtctgcactggcgccacggaaacccccgagacggcgagttgcgcctcagaagactgcggcgagacctagcagacgtgacccgcgggcgcgctgcaaccagcaagcacctcgaggtgggcggcggactcgaacgcactcggcgtgccgacgggttcgcctaccacgagccaggagaagtgaccggccaaggggtcgccgaagaaacgaccctcgtagatcagatagtcgcccgctggcaccaccccgccgacgaggtctgtcggctggatcaaccagtagcccttcgcatcgactaccggccacacccgcactggatccggtcggccgccgggaacggccgcttcggccacctgggccgacgctgggaactgaccctgctgggcttgaccgttcaaggcagtcaggtcgggttctgcgcttccaagagcgaagtactccgcggcgaccgccggcatcgaggcaccccagaccagccacggacgccaaaggggactcgtcggcaagctcacctcctcggccacggaaccgtgtctcgtcgtcaccgttacgttgacgccggccgaggagaaggcctcggcctctgcgctactcgtgtacggcaccgagaacacgatgtgctgatcagaccactgtcgcagcgtgccgccgctcgtcgccccgccgaggatcgccgacgcaagatcttgtccgttggctcgagcaaccgtgaacgagtccgcgttcggcgtgtctcccagcctgctcccctcgaccgacaccaccacccccgtcggcaagctcccgtccgggctcggaacgaaggagagctcgatccccgcgatgtccggcggagcagcgctactacttgccgacggtgtcggagttacgacaggagtggtcgtcgagtggctcgcacgctgcggtgcagaggcgtgatgaccgcttgagacgaccgcaccgcacccggccattcccacccccgcgagcacgagcaaggaagaccatcgcgaacgttcgaaccgcactgtcatgcctgccccctctcactcgacccacacgcccacgaccggacggcaggtcttcgggtccacaaccccggtcatctccaacctgcgcgcatcgtgcgacgctgtcaagcgctgcccagggtaggcaccggccttcttgtgacccggggtcagcggtcagagccgacccgcttgcggcacagctgtcgacggtgccggtagagtcatgacactcggcgtcacctcgaccgagcacctgctcgctgacgccgagctcgcgggcgaactcggcgatgttgcggtgctggccgaggacgagcacggccgcgtctctacggaactggtcgaggtcgtggcctcttcccaggcgagcgggtccgttagcgagggctggtggcggtgtccagttcatcccttcccccgtaacaagtgtcaacccatttgggaaggcaatcctcgccggatgcgtggtcgtgccgtacgtcgcccggtcaggcaaacggaggaaagctcgcgcgtcccttgtctggccctgggagacgggtcaataaccgagccgctactcccctgagcaccggggcgtcctctcgagcgacggtccacacgcgctcgacgtttacgtcggcgtaggcgtgaatgaggacgttacgaagggccttgaggcggccccaagggatctcggtgttgctgcggcggaaggcttcgctcagccgacccgccgcctccccgatgatctccaactgtcggatgaccgcactttgcttctcgtcattcgcaaggaaggcgtcgtacgacactccagccaagtaccggtcaatccggtcgcaagcgaccacgatgtggtcaagatacacgctgtctgtgtggcgtgacatagatcgtgcgccgatcggccagcacttgttcccggatgaatcggtgcagcaggtgaggttccacgagatcgacacgccggcgcaacagcgccccgagttcctgctggacctcgatcaggtcgagcaggctccgcaccgggctgtcgggctcgaacgtcacgagcatgtccacgtcgctcgttggcatgaagtcgtcgcgcagcaccgacccgaacagagccagttcttcgatgccgaagcgatcggccaaggccgccaacgcggcgtcgtcgacgctcagcctgggatgctcgcgaatgatcacgctccgcgcctcctgatgcaaggctaccacggcgcgaccgcctcgcctcgaaggcgacaccagctcgtaacgcgatgaccggctccttgtccccgcgcgaaggggccagccagcctcttggcgtcgcttggtggcgcacgcacgacaaggggccttgccgagcacgtcgacccaccgcagctgagcacggtaaccgtcgcgatagcgggtggtcgaacccatccctctggtaggccgcgtgccaacctacccaagagcgtcccacctcagtgggttgggccataggttgctttctaggtagcaggagcacccaagtctgaactatgcagcttcgcacctagcgcctcagtgaggagtgatgctggtcgggctggccggatttgaaccggcgacctcttgacccccagtcaagcgcgctaaccaagctgcgccacagcccgttgccagcgagtctaccgagcgagagtccgggggcctcctagccttggcggccgtcgtcgagaccaaagcgacgagcggcgctcacgacctcacggcgatcagggcgttctcgatcaagcccatgagagcggacgatgtcgtggagccggccggagatctctccgacggcctcttgctgctgatcggtggccgttgcgatctcacccacgcgaccttgcaccgatgcgagcccgtccacgatccccgccacggcagcccgagccgaacccccaagttcgacgctgcgctccgactcttcgagaccttcgctgatcactcgcacggcctcgctgacgccatcgcgcacttcagcgatgccgaccccaatctggtgcgctagctcgcccgcacgacctgccagctgtcgaacctcgtcggcgacgaccgcaaacccccgtcccgcagtccccgcacgagatgcctcgatggcggcgttcagggcgagcagattggtctggtccgcgatccccccgatggccccggcaacggcatcgagcgaacgggtgcgctcggcaagggcggtcagcgcctcggaggtgctccggattcgctccgacaggaccccgaccgcgtcgatcactcgaccgaccgtggcgtccccgtcgcgagcagcctccgatgcgctcgtcgcgagctgtcgcaggtcccctgatgcgcgcgcaacctcggccgcagaggcgcgcagctcctcgaccgcggccgcgatctgggcgacgcccgacgagagctcaccgaacctcgcctcggcacgaaccgcctcctcgcgcgccagttgttcgatcgccgtccggtcgaaccagtgagccaggtaacccacgagccgaccccgatcgtgcaccggacgtacgtgggtctcgaggatgcgatcaccaatccgaatctgggcgctgtgactcccgccgcgcgcccgcagttctccgagcacgcgtcggacgcgctccggatcgcggtggaaccgatggatgctccccccgaatgcatggcgcacgtcggcgccttgcaagccggcgttcagctcgacagcgtgctcggcgaagagggcctcggctgccgggttgacgtagacgatggtctgctctccctccggttcggcgatcatcaccgggatctcgaccgcgtccagtgcagcagcccggagctcgagagaacgaagtgtggacggagcgacgacgcgaagagccatgcacgaggtatcggcccgagatctgattccagttgaggacggggtcacgaccctctgtcgtcctgctcaggcgtggcaggtcagcgggcgtccgccgttgtaggcgatcatatcgccgaaggcagcgagcacatcgacctcgcgcccatcgagctcggcgatcgctcgatgcacgttgccgacgaggcgctctgggtccaaccacgcagcgaactcgccgagatcgacggagcgcgccgcctcgagcgggggcaccccggcctcgtgtgcttcgtgcgcgaggtgccacacgaagcggagatagcgctcgacggcgtcgagatcagccgtcgtcgcaagtgggccgtgccccggcacgatgacgtcggcgtcgaaggttcggagccacgcgatgacctcgatccagccctgcaccgacccgcccagcgcaaagggggtgccgccgacgaacaggaggtcgccagcgaagagcacgcggctctcgggcaaccagaccaccgcgtcgcctcgtgtgtgcgcaggccgacccgccgccctcacctcgatctcgtgatcgtcgaaccgcagggtaagaccgtcgtcgaagagcacgtccggcatgcgcacgtcgatctccccccactccaccggcgtgaacacgcccggcggcggcacgacgatcccggtcgcgagctcctcgggcaccgagcgctgagcgatcatcacctcaggatcgagggttgcggtgccgttcgtgtgatcgccatggtggtgcgtcgccaccagcaggcggcgcgatggtgctccgacgcgtcgagctgcctcgaggagcgcctgggtacgacgcacggttgcggtggtatcgacgtggacgctacgctccccagcgagcacgattcctgcgttcgacaggaaccaggagccatcgggttggaggtaggcgaacacccccggggccagctcctcgagtacgccgtctcgacgcggcgtccatgacgacgagctagacgagctagaggacatggtgcagccacatgatgagctggatgaggcgataggtcaggtagatcaccgtcgcgaccagcagcagcttgaagtgccacggggttcgcttcggcggtgcgatgacggtaccacagctcgggcagtgcccttccttgtccagctccgtggcatcctggaagcgctcgcagctctcgcaccagggcatgcctcaagcctagtggcagcgctcaccgaagtgcggtgctacaccggtggtaccccgtgtcgacgctccgagaaatggcgatccttgaccgccgcacggctgagtcgagcgatcagctccgagcggaggtcctcgggttggacgatggcatccacgacgaggtctgcggcgagccgaacgaggtcgacgtcgcgctcgtactcctcacgacgagcggcgacgaagcgctcacgctcggccggatcgtcgatctcctggatcttgcgatagtaaaccgcgttcactgcaggctctgggcccatgaccgcgatcgacgcccctggcagggcgatcgtcgcctcggggtcaaaggctggaccgcacatcgcatagagccccgcaccgtaggccttgcgaacgatcacgctcaccttcggcaccgtcgcctcggcgaccgcagtgatcatcttggcgccgtgacggatgatcccctggcgctcgacctcggagccgatcatgaaccccggcacgtccgcgaggaacacgagcgggatattgaacgcatcgcagagccaaatgaagcgagcagccttgtccgcggagtccacgaagaggacgccccccttgaccgcagggttgttcgccacgatcccgatgctctggccgtcgaggcgtgcgaagccgatcacgagctccggggcgaacagcggcttgagctcgaagaagctccccgcgtccaccagaccctcgatcacgcgatggatgtcgtagccttgctgtggagcgtctgggatcagtgaccgcacgagcggcacgagcggctctcgaggctcctcacggggaggatcgccctcgaagtcgctcggcagatacgacaggaatgctcgagccgcctcgatcgccccacgatcgtcgacgacgaggttgtccccgcatccagagatcgtcgcgtgcatgcgcgcgccgcccatctcctcgagcgtcacgcgctcaccgatcaccacctctgccatgcggggagagccgaggtacatcgaggcgtgtccctccaccatgaagaccacgtcgcagaaggccgggatgtaggcccctcccgccgccgatgggccaaacagacagcacacctgcgggaccctgcccgagagacgaacctggttcgcaaagatgcgccccgcaccccgtcggcccgggaacagctcgacctgatcggtgatgcgagctcccgccgaatcgaccaggtagatgatcgggagtcgatggcggtaggcgagctcagtgatacgaacgatcttctcgacggtgcgcgcaccccaggagccggccttgacggtctggtcgttcgccatgatcgccaccggacggccgtcgacggtgcccgtaccggtcacgaccccgtcggccgggagcgaggggtcggtggcgttcgcgaacagaccgtcctctcgaaaactgcccgcatcgacgagcagaccgatgcgctcacgcgcgtgcaacttgcccgaggccacgagacgctcctcgaccgagctcggccaggcgtacttcgtggtctcggcgagctcaccgatgcgctcgtactgatccacgcgaccctcctccactcacgccccgcggcgacgcaccctgagcttgatcggcgtcgcatccatctcgaaggcctctcggatccggtgctcgaggaatcgcaggtacggcggcgggaggctgcggttcgcaaagagtgtgaaggtcggcggccgcgtcgccccctgtaccgcgtagaggatgcgcccggcgggcggggggtgctccgactggagctcgttcaagaagcgattgagctggcccgtcggcacgcgacgctcgtagtcggcccgagccgcgaagatcgccggcagcactcgatgcacgccgcggcccgtgagtgccgagatccgaaccggatcgagccccgtcacgaaagccagtcggtcctcgacgtcacgctcgatgcggtccttggcctcggcgtcgagctggtcccacttgttcagcacgacgacgaccggtgagcccgcggcgtcgatgcgctcgacgaggcgctgatcccatccggtgacgccctcggtcgcgtcgatcacgagcagcgacacgtcggccgcatcgatcgccgccagcgtgcgcaccatcgagaagtactcagtgcccgactcgtagcggctgcggcgccggagcccagcggtgtcaacgaagcggatgcgaccctcgtcggtctcgacgaccgtatccaaggtgtcgacggtcgtgcccggctggtcatagacgatggcccgcggctcgccaaccagtcggttgaacaggctcgacttgccgacgttcggccgccccacgatcgcgacggcaacgtcggctgccggcgccgcctccggctcctccgccgcggtgaggtcgagtcgccgtgcaacgagatcgagcagctcgaagacaccacgaccgtgcatcgccgacaccggcaccggctcgccgaccccgagcgccaagtgctcccagatggccggctcatgcccagggctgtccaccttgttcgcgacgaggatcgagggcaccttggcgcggcgcaccacgcgggcgatggctgcgtcctcctcggtggggggcacacgcgcatcgacgaccacgagcgcgagatccgcccgccggagcgccgcctccaccgcagccgacaccgcagcatcgagaccgtctgcgcccgcgaggtagccgccggtgtcgacgatcgccagcggcgccccctcccagtcgatggtcgcctccttcgcatcccgcgtcaccttgggccgttcctcgaccaccgcctctcgtcgtcccaccacgcggttgaacaggctggacttgccgacgttcgggcgcccgacgatcacgacgcgcttcatgctgctctccccacgcggatcgcccaccgcagcgcgctcccgttcgtcgcgacgacctcgagccgcgggtcgagttcatcgagagcgacgccgtcgatgaaccgacccccggacagacacacgtccggcagcaggagccgatcctcaggggcgtctgcgaccgctcgagccacgtcgctgcccgcgaggaggcctgcgacccccacgttgccgccgaaatactcgttcgccacctcgacgacacgaacatcgccgtagccatggcgctcgaggagcgggcgcagcacggctgctccatagctggatgtgacgacggccgttgctgggcctgggcgccgccgacccgagagctcgacgcgcgtcgctcggtagccgagggccggggctccctcgatcgcccgaaagaacccgctcgcgggctccgtcgacggcgacctggcgccgaggaactcggcctcgaaggccctcgcgagcccgataccgttctcgagctgaggcagaccggcgtagtcctcgagcggcgggaactcgacccccccgaccaggtagagctcgtcggcggcccaggcacggggcgcacgccgatcgcgggcccagcggtcgtagcgctcgatgatctcgaccgcccggcgtgcctcgtcgggggtgtgggcacgcaggtgctcgcggctgaagcgcgacacgccgtagggcacgaccccgatgctcgcaaggcccggtgcgaggagcgccagctcggccaaggtcgcctcgagctcgtccgcgtcgttgcgctccggcacgagcacgacctgcgcatgcacctcgacgcccgcctcgacgagcgcgaccagccagcgcagcgacaccgcgccacgcgggttacgcagcatcgacgcccgcagcgcggggttcgtggcatgcaccgagacgtagaggggccccaggcgttcggtgacgacccgttcgaagtccgcctcggtgaaacgcgtgagcgtcgtgaagttgccgtagaggaacgagaggcgatagtcgtcgtccttgacgtacagcgtccgtcgcaagcccttcggcagttggtagatgaagcagaactcgcagtggttgtcgcaggtggtcaccccgtcgaacacggcgtcagagagctccgccccgagcggcatgcccgccgccttgtcgacggccacctcgagcgacacaccgcctcgctcgacctcgagcaccgggtctgcgtcgtcgatgagctggcggtactcgatgacgtcccgaggctccacgccgttcaccgcgaccagcacgtcgccgggcgcgagaccggcgcggcccgcaggcgagtcaggctcgacgaagagcaggtgaggacgaggcacaccgagagcctagtgagcacccagagggcgccttctcgagcgccctagactcacgaaccatggccgtcgacaaggtcctgctcgccgctcctcgtggtttttgtgccggggtcgagcgggccatcggcgccctcggctggatgctgcgcatcttcgaaccgcccgtgtactgctaccacgagatcgtgcacaaccgcctcgtggtcgaggcgttcgaagcagcaggcgtcgtcttcgtcgacgacgtcgagagcgtcccccctggtcgcccggtcatgctgtctgcccacgggaccgcccccgaggtcctcgaggcggcgcgccaacgctgtcccatcgtcgtcgatgccgtctgtccgctcgtcacgaaggtccaccacgagatccgaacgcgagcccagcgcggctaccagatcgtctacgtcggtcatcgtggccacgaggaggccatcggcgccaccgccgaagctcccgaagccgtcaccttcgtcgagacgccagaggaggctcgcgccatcaccctcggcgacgggccggtcgcgctgctcgcccagaccacgctcgccgtgcccgaatgggaggcgatcgccgccatcgtcgccagccagacgcccaacctctggcagccgggccgctccgacctgtgctacgccaccacgaaccgacaggcggccgttcgggcgcttgcagagcgtgtcgacgccatggtcgtggtcggatctgcgaactcctcgaacacccgcgctctcgagcgcgtcgccacgagcgccggcgtgggccacgtcgagcgcgtcaaccgcccgagcgagctcgtcggcccgttcgagggcatcgtgggcgtcaccgccggggcatcggctgcggagtccgtcgtcaaagatgtggtggccgcactcgcgccgcggctgggcgtcgaggagatcagcgtcctcgaggaggacgagttcttcccactccctcccgatctgcgcgacctcatcggtgcgctcgcgggcgtcgtcgcggttgcaacaggcgtctccccagagggcgcactgcccgagcgagagtccgccgaggcgatactcgccgcactcgacactcgccaccgctagtcacgcctacgtcggtcgatccgtcagatcgcctgcgtcccgtcgagacggatcgaacgctcatggaccggagggagcttcggcagctgcgtcggatcagacgccacccgccgcccggaggcgacgatgagggctcgcgagcgtcgagccgcagcgaggagccgattgagctcggactcgagcatctcgctgagctggcggatctcctggcgccgaacgcgcccggcccaggatgcgcgaacttcgccgggccagagggctcgaccaacctcgatcgccacgggagccgggaggatcagtgcagatccagggcgcatcgcccgctccgacccggcgatggccgccggcacgaccggcacgcccgcccgcaaggcgaggtaggccgctccctcctcgatgccctccacgcgctcgccgcgacggcgcgtcccttcggggaacaccacgagcgagcgcccgctgccgagcgccgcgagcgcgagctcgatcgcctcccgatcggtcgcttcgcggtgcaccgggaatccaccgagcagccgcagaagcgcgccgaaacccggtgcctccatgacgccggacttggccatgtaggtcatcggctcgcccgtgatcgagccgatgaagggcgtgtcgagattcgagcgatgcgtcggcgcgaggatgtagggcgccgggggcagcgcctcctcgaacccgaccgcgacagcgaacatggcccgattggccagccggacgagctcgcgcgcgccgcggtagaaggcccgctgggccaacgagccgacctcgatcacgcaggcacctccgagagcgccgccacgagttcgcccacccgcacggcgagtgctgcaacggagacgtccgacgtgtcgacgacgatcgcatcggcggcaggcaacgccggcgccacagcgcggcgtgcgttgacccgatcccgcgcgagcaccgcgacaccctcgtcgtgtctcctcgccacacgcaccgcgtcccgcgcgacgaggaacagcttgagctcggcgtcgggaacgacgaccgtcccgatgtcacgaccctcgacgaccgccgaaccgagcgcgtggatgtcggctcgctcgagcgcgaggacggcgtcacgaaccaggcgatcttgcgtcagcacggcaagcacctcggtgagtgtgggatcgcgcaggcgcgcgccgagcgcttcggcctcgcggtagcgagcgagcgggtcgccgacgcgccggagctcttcggccacctccgccggtgccaacccctcggcctcggcgaggtgcgcagcgaaacggaagtagagccccgtgttgatacaggcaatcttgagatcgtcggcgagccgcaccgcgagagtcgacttaccggtccctgagaggccgtcgatcgcgatcacgagacggcggcgctgggctacggccccatcgtgccgagatctcgcctccacggccaggtaggctagtgaggagcaaccgacgggacgtgcgggtgcgctccgtgcgaattcgagttctgggctcaggtcattctcggattgtccggacacactcacaatgactaggtcggcgtcggatgaaggagttgggtgtgagcagaacgactcgctttgccaaggatcgcgggttgacggcacggatgaccttcaccatcttcctcctcgggctggtgtacgtcctgttcttcggactgctcatcgccgtcggcgtcggcgcgctcaccgtggtcgtcatcgcggcgatcttcctcttcgtgcagtacttctacgccgacaagatcgcgctcttcggcatgcgtggccacctcgtcaccgaggaccaggagccgcagctctaccagatcgtcgagcgactcgccgccctcgctgacatgcccatgccgaagatcgccgtgtcggaactcgacatcccgaacgccttcgccaccggccggagcccgtcgaaggcggtcgtgtgtgtgacgcgcggcctccagcgccgcctctccccccaagagctcgaggcggtcctctcccacgagctcagccacgtcgcccatcgagacgtcgccgtcatgaccatcgcatcgttcatcggcgtgctcgccggcctgctgatccgggtgatgttctactccgagctcttctcgggtgggttgggctacggcgggggacgtggtcgtggggggcagatgcaaggcggcggccaactcgtcgccgtcgagatgctgatcatgctcgtctcggcgatcgtgtacgccatcagcttcctcctcatccgcgcgctcagccgctaccgcgaactggctgccgatcgctccggcgcgatcctcatcgggcgtcccgcgctcctgaagtcggcgctcttgcgcatctcgggcgccatgggacagatcccgacgcgggacctccgaagcgcccaggcgttcaacgcgttcttcttcaccccggcgatcgcacctcgcggtggcatcggcctcggcgagctgttctcgacccatccctcgctcgagaagcgcatcgcccaactggatgcgctcgagcgccaactcggtacggcggagtaggcgtggggttcttcgacaccctcttcggccgcaccaaggtggcccagcccaaggtggacgccctcttcgcgctcccgggggcagcgatcacgctcgaggtcgccgccaacctcacgagcgacggatggggcgcggtggtcttcaagcccgcctcgggagccgccttcgcgaacaccgagcacgagttccgcgacgtgctcgccgagctgaccgacacgacggtcacgcaggccaccgatggcttcggctatcgctgggtcctccttcgcgccgcggatctcgagaccctggtcacggccgtgcacgccgtgaaccggagcctcgaggaccatggattcggccctcagctcctctgctcactgttcgccttccatgacaccacaggcgcccagcccgtcttctgggtctacctctacaagcgcggcaccttctacccattcgtccccaccggccacgaacaacgtgacaacgagcgcgaactgtcactgaaggcggtggtgggctccgatctccccgtcgaagaggacctgacgcgctggttccccctgtgggacatccccgacccgccacctgccgccgcccaagacggcacgggctcgacgacctaatcctcggttcggacgacggcctcgcacaaccgcacgaaatcgtcgacgaagccggggtagctggtcgcgacccactcggcgtcgcgaatgcgcgccccgatgccctgggtggccgcccagacggccgcactcatcgcgatccgatggtcacgcaccgaatccacgaggacgggcccgctggggctcgtcgggccctcgaccacgaagccgtcgtgcgaggtctcgaccgtcgcaccgaaggcctcgagcatccgagccgtcgtctcgatgcggtcggactccttgacgcgtagctccgcagctccctcgatgcgactcgtgccccgagcggcagcaaaggcgacggcgagcacggggacctcgtcgatcaggctcggcacctcgtcggcgacgatcgtcgtcgcgccgagcgcggcgccgcgcacgatcaccgtgtcgcgtccgagcacctcgatctcggcgcccatacgccgcagcacgtcgagatagcccgtcctcgtcggccccaggtaggcaccacgaacctcgagccgtgctcccggggtcgctgccgcggccaccacgaagaaggccgcagccgaggggtcacgcgcgaccacgatgcgctcgacggggcgcggtgtgccgggcaccacgctcacccgatgtcgcccatcggcgagctcctcctcgtcgacctcgagaccgagcagaccgaggagttcttccgtgtgcggacgggtcgcgaccggctcgacgacgctcaccgccgacgccgccccaaggccagccaacagcagggccgacttgacctgggccgaggcgacacgcagctcgatggtcccgcccgcaagccgcgcgccgcgcacggcagcaggcagccagcgagccccccctcgcgcgtcgatcaccgcgccgaggctccgcagcggctcgatcacgcgtgccatcggccgccggcgcaccgacgcatccccgtcgatgaccacgaggccaggcacgagcgtcgcgaccccgagtccgagccgcgcgagggttcccgagttgccgacgtcgatcacgccttcgggctcgacgaggccctcgatgccggggccgtcgatctcgagggtgccgttcgcacgctccgacacgacggccccgaaggcacggatcgcctcgagcgtggcggtgacgtcgagcgcgcgcgagaggccctcgacgatcgtcgttccccgcgcgaggagcgcgccgaggagcgctcgatggctgatggatttgtcgggcggcggctcgagcacgccagagggggcatgtgcacccggccggatgacgaggtccacgctcgtgacctaggccggcaggtcgtctcgcagaccgaccgcgccatggaggtagacgtggtggaaggcgctccggggtcgctcgtcttcgaggtgcatcagcacgcgcacgcaccgctgggttccccccacgatgtcgagctcgcgcgcgcagatcaacggcacgtcaccaaggccgatctcgcgggctgcggtggcaggaaagagcgagtgcagatcgtcggtcgcggtgaagaggatcgagacgagctgctccttgccgatgccgttcgccgccagcatgcggctcacgagctcctggacacgctcgcgcatcgcctcgggcgtgtcctcgtcaagcgtcgtcgctccccgcaacccccgtagcgccatgggccgacaggctagcggccccgatcgcacgacgcaggcgtgcgagctcacgcggctcgagtcggcgcgcgacccccggagggaggtgagggtcgacgagcggaccgatccgcacccgcaccaaccgctcaacgctgagtccgaccgcgcccaccatccgacggatctggcggttgcggccttcggtgaggacgatgcgcaccagcctcggaccgaccgtaccgacggatgaggcacgaaggagctcaccgtcgacctcgaccccttcgcgcagttcccgcccgaggcgtctcggcacgggccgatcgacccacacgaggtattccttgggcacgtgaaaccgcggatgggtcagctggtaggtgagcgggccgtcgttcgtgaggatcaacagaccctcgctgtcgacgtcgagacgccccaccggatacaccctcgacgtggtcgccaccagcgagcgtacggtcgggcgcccctcgggatcgaccaccgacgacaccacgccgcgcggcttgttgaggagccagtactcgcgctgctcctcggtcgcgatctcgaggccatcgaactccacacggtcgacgcccggacgcacccgcgcaccgatcgtggcaacctcgccgttgatccgcacccgaccgtcgcgaatcgcgtcctcgaggacccgacgcgaaccgcagccagctcgcgcgagcaggacgtgcaccttgaccgactcggcgctcacgactggccgcgcacctcggtctcgagctcggccacctcggccgcgctcggcacgtagcgaccgagcggcggcagctcctcgatggagccgagccccgcacgcaccaggaacgccgtcgtcgttcgaaaggcgacagggtcactcgaggggacctcttcgatgaggccacgctcgaggagcgtccgcacgactccgtccgagacgacgccgcggacctcgctcacctgcgcgcgcgtcaccggctgcagatacgcgacgacggcgagcgcctcgagcgcagctcgcgagaggcgccggtccgcgaccccgagcgcccgacgagcgagcgccgcgtactccggcactacctcgaagaccgcaaacccatcccgaacgcgcacgcgtaccccccgagcgggggcggcctcggcggccgcgatctgcgcctcgatctcggcgacgtcgcgctcgaggagctcggcgagttcgccgatcgcgacggacccgcaggcgccgaccaccgcctcgatcgctgcgccgagctcggccggatcggcggcgccaggcgcgcgctcgtcagtcatgcgacgccacgccgatcccaaccaacgcccgtgccgcgtcgtcgtcgacgagtcccacccacagctcgtcgccgacgacctcgagggtgagtgcgccgagcgcgtagccctcgagcacgatcacgaagcccacgacgacctcgagtgctcgccacccgcgtacgacgtcgcggaaggtcgtacgacgacgtgcgcgtaccgaagcgagtacccgctcggcgaccacctcgatccgtaccatctgactcggcagcgtgacggtgccaacggcccgtcgcccgcgaccttccaacccgacgagtgctgcccggagcgacgctggatcgatcggtgcgagcggcggctcgggcaccggaaccgctcgcgcgagcaccgcgtcctgatcgccgagtcgctgcgcgagctgccctgcggcccgcgagatcgcccgctgcagcgcgagcgcgacgagcacccgctcacgacgttcgtcagcgagctcgagcacctcctcgtccggctccgtggtgagcgcgcccaaccatctcgcgagcaaccaactcgcagccaccaacgccccaccgagcacctcggggtcgtcgatgccgacgagggcgctctcgacgagcgcgccgagctcgagcgagctcggatcgagccgttgggccctgacggcctcgaccgcctcagcgaggctcgttggccccatcgaacctcatcaccatcatgacgtgcggaccgacgccgggaacctcgaacgacgccccgacgcccgtgaaaccaagacgttcgtagaagccgagcacccacgctctcgcgtgcaggaacatcccgcgggggccgcgctcctcggccgtcaaccgctccagcgcctcggagacgagcatgcgaccgatcccgcgacgctgcgccgactcgaccaccgccatgccccgcaggcgccaggcccgtccctcaggatcgagcgtccccgcgagcacgtctgccgcagcagggccaggggcctcgaggaccacagtcacgacgccgatggtcgaaccatccgcacgcgaggccgcgaggtggaggctccgaggatcctcgtccccccgaaagcgcgcagcatcggcgggcttgcccggccgcagcacggccgcgcgcacctcgagcacgtcgtcgatcccgacactgcggatcgtgacgtcgctcacctctgcctcctcgccctctccgccgagctcacggcactccggtagcgtaccgtcaccgacgtggcgtcgcgcctcgacgagcagcctcgatcgagcgggcgaccagcgtcaccggatgcacgacgtcgacctctggtccgagcagcgcccgcagctgcagtgtgcagcccgggttcgggcttgcgaccacgctggcggccgtctcggtcaccgcgcgtgccttgcgctcaccgacctgcgtcgagagctcgggctcgaggaggctgtagagtccgccagccccacagcagcgcggcccgccgacgtccaccagctcgagaccggggatctggcggagcagcgcccggggggcatcgacgatcccctgtgcgaaggcgagatggcacgcgtcgtgcaccgcgacacgagcctcgatggctccgcggggggctcggggtgcgtcctcggtgagcaactccgtgatgtcgatggtggcgcgcgcgaccgccgcgccctcctcccccacgatccactcgtagcgacgcaggtgcgccccgcacccagcagaggtcaccacaagccgcaccgactcgtcacgatcggcgagtgctgccatgatgcgccgcgcatgacggcgagcagccgcctcgtcgccagcgtgctcagacagcgcaccacagcacacgctctcgagcacctcgaccgagtagccctcggcctcgagcacgctcaccgcgtcgtcgttcgtggacccgagcgcagccgaggcgacgcatccagcgagcagcaggacgcgtcgacgaggcgatcgggccgaggacgtgatgcgaggttgcccaccgtggcgtcgatcggcgacacggccctcgtcgagcgcgcgcgcaacgcgtcgtccgaacccacccccccgcgccagtgccggacgaagggcgaacaacggccgaccgagcgcgagtgcggctgcgctcgcacgagccgaggggaagagccgggcgagcgaccgacgccacgttcgatcggcgagcggccgccccggctcgacgagtccacgcgcgagatggatgatctcgtcgtagcgcacgccggaagggcacgcaggcacgcaggcttcacagccgatgcagcgatcgatgtgcagtcgaaccctgtcggcgacgacggggccgctcctggtggcctcctcggcgagcaaccagatacgaccacggggcgaatccgcctctgcgcgtgtgaccgcataggtggggcacgcggagaggcagaacccacagtggacgcacgtcgcggcgagctcggcgatccgtgcgcgagacgtcgtgtgggtcgccgtcatcggaaccgcctctcaggatcgagttcgtcggcgagtcgcgtcacgagcggatgtgcgaagcggtcgacgagaccgaaacccaccgcgtcgtccaccccctcggctcggcgcacctcgccgacggcaccctcgcggcgcgcatcgtcgagcagtgccgggagcgcttctgccccgcccggatcggcgacgacgtcgacgagaccggcacccggatagctcgcaaacgagatcccaggaggagccgtcgtgcgctcgagccacgcgagcatccgcgaggcacggccggcgagccgcagcaccacgccctcacgaggcacccggaacgcggcccgcgccgtccgctccgcgtcgagacgcgcagcatcgagctccgtggcggcgatcccgtgtgcacgaagcacccgctcgagccgctcggactgcgcctcgaccccgcgctcggtgccctcgaacaccacgagcgcctcggtcgaggctgcgagccagtcgatcgcgaccggctcaacccgctccgcgagcgacacctcgaggagcgtgcggagctcggcaggaccggacgccaccagcacaccacgctcggcctggggtcgagggtgggcgcgcaacaccacctcgccgacgagtgcgatccgaccccgtgccccgcacacgagcttggcgaggtcgtagcccgcgacgttcttgatcacgtgcccgcccgaatgcgcgacggtaccgtcagccagcagcaacgtcgcgccgatgacgaggtcgcgcaccccgccatagcgccacaccatggcgccgtgagcactcgtcgcgaccatggcgccgacggtaccgtcggccacgggatcgagcgcgatccgcaggcgcgcctcggcgaggacggcgttgagctcggagaggcgtaccccggcaccgacggcgacggtgaggtcgtccacacgggcgtcgatccagtcgagtccggtggtccgaagctcgagggagcccgctacgacaggctcttggttcgttccctcaccgacgatgcgaacgggctgctcgggctcgaggccggcgagcagtcggctcgcctcctcgatcgaggtgggcgccgctaccatcgagtcgccaccccggcctcctcgagcggatgcggccggtaccgacccgcctgctccccgcacaggcgaggggtcggcaacagcttgcccgggttggcgaggccacggggatcgagggcagtcctcacgcgtgcgaagacggacaggtccgtcgcactgaacatctcgggcatcttgcagaccttgtcgaccccgatgccgtgctcgccggtgagcgagccgccctcggcgagacagaggctgaggatcgcggccgcgacctcctcggcgcgcgcctcctcgccggggacggatgggtcgtaggtgacgagagggtgcaggttgccgtcgccggcgtggaagacgttgaggatctcgagccccgactcccgggcgaggtcgccgatggccgccagcacccgcgggagcgacgtgcgcgggatgacgccatcttggacgatgtaggcgggcgcgacgcgaccggccgccgcaaacgccgccttgcgcgcacgccacatgcgctcgcgctcggcctccgtcgtcgcgacccacaccgaacgtgcccccgcggccgcgagcgcctccctgaccgcgacgaagccctcgtccacctcctccgcggggccatcgagctcgacgagcagggcggctccccagtcgagctcgagtccggcgtgcgtcgccgcctcacaggccacgagtgccgggcgatccatcatctcgatcgcggcaggcacgaggccagcccccacgatctccgacaccgcatcccctgcttgcaccgcgtcgtcgaagtaggcgaccagcgtccgacgaagggacggttggttgatgaggcgacagacgatggtcgtggcgatgccgagggtgccctcggatccgatgatgagaccgcggacgtccggccctggcgactcgagggactgcccacccacgaagaccagctcacccgtcgggtcgatgagctcgagaccgagcacgtggttcgtggtgaagccgtacttgaagcagtgggcaccgccggagttctcggcgatgttgccgccgatggtgcaggcgatctgcgaggaggggtcaggggcgaacagcaacccctccccagcgaccgctgccgacaggtcgaggttgacgactcctggctcgaccacggccacccgcgagatgggatcgatctcgagcacacgggtgagccgcgcgagcacgacgaggacgccgtccgtctccggcaacgcgccccccgaaaggccggtaccggcccctctcgctacgaagggaaggccgagacggatgatctcgcgaaccccgacgatgagctcgtcacgactcgagggcacgaagacgagacccggagtggcgcgatggctggtgaggccgtcacagctgtaggcttgccgctcgcgaggatcgtcgatcaccgcatccggaccagcgacggatcgcgcgaacgctgcaaagcgcgcgagcgctgtcgacccgctcatggcggcaagtgtagcccgggtgggtgatccgcccgaggaggaaggagcaacgatgacacagaaggtcgtcatcacgggcgcaacggcggggatcgggctcgccaccgcccgcaccctgcacgcagccggctgggagatcatcgccatcggtcgacgcgacgatcgcctgcgagacctcgccgacgagttcggcggggagcgcatccacaccgtcgcgatggacgtccgcgacggtcaggcgatcggccgtctacgcgccatcgtgggtgtgcccgacgccatcgtcaacaacgccggcggcgcacgaggcctcgaacgggccgacgccgcgcagctcgacgactggctgtggatgatcgagacgaacgtcatcgggctcgtacggctcacgcacctcttcctccccgacatggtggcgcgcgggagcggcacgatcgtgaacgtcggctccgtggcgggcgagtttccctatccgggtgggaacgtctacggcgcgaccaaggcgttcgtgcgccagttcaccttgaacctccgggccgacctcgccgggacgggcgtgcgcgtgaccgacgtcgaaccagggatggtcggtggcaccgagttctcgctcacgcgcttcggcggcgacgagtcccgtgccgcggaggtctacgaaggcatgacacccctcggtcccgacgacgtcgccgaggtcatcgcgttcgtgctctcgcgacctgcgcacgtgaacatcaacacggtcgcgttcatgccgaccgaccagggtttcggacccttcaaggtggcccgccacgacgacgtctgagcgtccacctacgctcgaggccatgacctcgaccctcgggcgtagcgacctcgcagccccttcaccgagccgaagtagccggcgtcgggagggatggctcgcgaccagtggcgggacgctccacccagagggtgtcgtgagcgcccacccagagccgacacgactcgagcgccccgcccctcacgaacgcacggcccgcgaggacctcgaggcgatcagcctcgctccgggcgcgacccgcgccgagggggcgggacgacgagccgtcccagaggctcccgacccgttgcgaacctgcttcgaacgcgaccgcgaccgcatcgtgcactcgagcgcgttccgccgccttgccggcaagacacaggtcttcatcttcccccgcgaccaccagcgcactcgcctcacgcacgcgctcgaggtcgcccaagtcgcacgcgcgatcgcgcgtgggctccgcctgaacgagacgctcgtcgaggccatcgcgctcggccacgactgcggtcacggaccaggagggcacccgagcgagacggcgctcgacccctacctccctgaaggctatgaccacgccgtccagggtgcccgcatggcgctcggctcgctcaacctgtgcgtcgagacgctcgacggcatcgagaaccactcgtggtcacggccgcgacccatgacccccgagggggaggtcgtctccctcgccgaccggatcgcctacctcgcccacgacctcgaagacgccgtccacgcaggcatcgtgaagggagacgagctgccagcgagcgtacgagagctgctcggcgcgcaccgaggcgaccagctcgacgccctcattcgcgacgtgatcgaccagacggtcacgaagggggtgatcgggttctcccccgccgtggctgaagccatggccgacttgcgacgcttcaactacgagcgcatctatgaccgacctgcctcacgccgccaggcggccttcgtcgtcgccctcctgcgctcgctcatggactacctgctcgcgaacccgaccgcagttcccgaggtcgcagcctcgccggagccgacgagggctgccgtcgcctgggtggcaggcatgaccgatcgattcgcgctcgacgtcgccaagacctggctgggctggcgcaccgagccacccagtgcacgaggcgagggcctctaacgatatactcgatatatcgttagaaaggaggatggcatgtgtcacggacaccatcaccatccaggtgaaggagccttcggcgaaggaccgcatcgtggagctcgcggacccttcggcggcggacccttcggaggcgggccattcggcggcgggatgcgacgcggaggacgtgcaccgcgcggacgcattcgagctgagatcctgcggctcctcctcgatgggcccaagcacggctacgagctgatgaacctcatcgccgagcagagtggaggcgcatggcagccgagccccggctccatctaccccacgctccagctcctcgaggatcaaggactcgtggcgagcgccagcgatggcgatcgtcgcgtctaccagctcaccgacgcaggccgtgaggaagccgaacgactccagcacgagcccgggccacacgcaggtccggctggcgcccgactcggtcccgagatcgctcaggtcatgggcgcgctgcgcacgatcgcgatgtcggggacgccagagcagcgtgacgctgcccagagcgccatcgcggagtttcgccgaacgctctaccagatcctcgcgcagtagcgcgagtgctcgagcgcgttcgggcccgagggacgtgaggcccggtcatgagccgggcctcacgcgcgactctgatcgcgctcggacttagacgccgacgacctgatagccggcctcgacgagctcgacgaggacctcgccggccggacgcagaccgactccttgtgcctccaccacggcgtgatccagcccgagctgatcgacgttggcaggacaggcctgaacctcgacctcgccttcgcgaagctcggcgagcaccgcactcacctcggtgtgcgtcccgtcggcgagcgcgacacccggtccgaagaggtacaccttgacgtcctcaccacggcgcgtcttgagacgctccgcaagtcggagtccgctcatcgccttcccgacctgatcgggccctgctgtgatccagaatgcaatcttcgccatggcatcaggctaccccgagcacccccttttcgtgcacatcattacagttgcacgtgcaccgaaatttgccgaccacgtcgctctgggagcagtgctcactcgctccgagcgcgtgcccgagatgaccgggcgcgagaggcgcctctgctcggtcgacgacacgaaaccgttgcgcgagcacaccgtgggtcgctaggctcctgccaaccgaccggtcggtcgggacggacgctgtggttgccaaggggggacatgcacaccgtacgcgatccgctcatgcgcgccgagctcatcgctcgtgacggcaccgccgtcgtgtgtggcgccacgacgctcacctaccgcgacctcgccgaccgcgttcgacgcctcgccaacggcctcgcgggccttggccttgcgtccggcgatcgcgtggcgatcatcgccgacaactgccaccgctacgtggaggcctacctcgcggtaccgggtgcgggtttcgtgctcgtgccactcaacacgcgatcgagcccagccgagatcagcttcgccctcgaggacgccggcgtgcgcatcctgctcaccgatcgcgatccggccgcctacgaccacagcgtcgaacgagtcgtccgcatgcccgacgactacgaggacctcctcgagcgcacccctcctggtccgcttccgaacgcccccaccgagaacgacgtcgccgggctcttctacaccggcggcaccaccggccggtcgaagggcgtcatgcttacgcaccgcaatctcatcgcgaacgccgtcactgcgctcgagtggacgaggatgcgcgccgacgaccgttggctcgtcatggcaccgatgttccacgccgcgggcacctgctgcgtgctgacgtgctgctgggtcggcgcttcgcaggccatgctcccgagctttgacgccgccagcgccctcgatctcatcgaacagactcgagccaccggcaccctggccgtgccgaccatgctgaacgcgatgaacgatctccaggccaccgagccccgtgacgtctcgagcctccgcctcctcagccacggcgcgtcgccggctcccctcgagatcctgaagcgagcccacgtgctgttcccgcaggcagaactgctccatctctatggcaccaccgagaccgcgccgatcgcgacgaccttcgcccacgaggagctccatctcgacgatcgcctcgcaggttcggcgggccagcctgccttcggtgtcaccgtcgtcgcgctcgaccccgacggtcgccccgtgccgccgggcgagatcggggagatcgccgtccgaggcaacaacgtgatggctggctactggcaactccccgaccaatcagccgaggcgctccgaggcggctggtaccacaccggcgatctcggcttcctcaccgacgacggctacctcttcttggtcgatcggctcaaggacatggtcgtcaccggtggcgagaacgtctacaccgtcgaggtcgaagatgcgctctatcgacatccagccgtcgccgaggctgccgtcttcggcatccccgacgaacgctggggcgaagcggtctacgccgtcgtcgtgccccgctcgcctgtgaccgaggacgaactgcgctcgtacctgcgcaccctcatcgcgtcctacaaggtcccgaagcgcatccagttccagagcgacccactcccgaagtcaggcgccggcaagatcttgaagcgcaccctccgcgagcccttctgggcaggacgctcgacgcggatcggctcctagcctacgacccgttgtcatcagtcacctcggcgccgcacgccagcgctccaccgagccagaagggaggggtgcgtgatcatcagcaccatgaacgacctgccgggctacgacgtcaccgccgtcctgggcgaggtcttcggactcacggtacgctcgcgcaatgcagtctcccagtggggggcaggactcaagtcactcgtcggcggtgagctgaagggcatgaccaagaatctcgcgcgaagtcgcgaggaggccacccggcgcttggtagaagaggcggaggcgaagggggccaacgccatcctcgctttccgcttcgacaccagcgagctcggcgacatctggaccgagatctgcgcctacggcaccgccgtcacggtcgtcgcgaagagctgaaccctcgtccccgacgccgtcgggcgacccaccgcgggcattggggccggccgtggccccaacgccggacggacccgcaaacctaacgtgcgttgagcgagcgcgcgcgtcggccactcagtggccccccgagcagcgcggagaacgcgcagatgttgatgaggccggccaggatcggcacgagaccgacgatcgccaccacggttcgcgcggtgccatgggcgagggtaagcgcgagggcgatgatgacgagcccggcgacgacccgacccgcacgccccgctgggcgcgccatctggcatgccatctgggttccaaccttggttgccatgactcctccttgggttcgcctggccatcaaccaggctcacccatccttcggagccgtccacgtccgcggatggatcccgacgccacaccatcgccctagcgtcggcgaacatgccagcgcgcgaggcgagcgtcctcctcgcacggcacgacgtcaggggcgccggagcagggctgcgaccccctggccaacccccacgcacatcgtgacgagggcgtagcgaccgtcgcgagcacggagctcgtgtgccgccgtcagggccagacgagcaccgctcgcgcccagaggatggccgagggcaatggctccaccgttcggattgacgagatcgtcgtcgggatcggtcggcaagccaagttcaccgaggcaagccagcgactgcgccgcgaacgcctcgttcaactccaccacgtcgaggtcggcgacaccgaggccgaagcgctcgagcaagcgcctcgacgcagggaccgggccgatgcccatgatcctcggcggcacgccggccgtctggccgccgacgatctcgcaccacggctcgagtccgtaacgcgcgagggcggcgtcgctcgccacgaccacggcactcgcgccgtcgttgacgccactcgcgttgccggcggtcaccgtgccaccgacacgaaatgccggccgcagtcgtgcgagcgcctcgagcgatgtctcacgcggatgctcgtcgagctcgacgacctcctcggatcgaccgcgcaccacccgtaccggcacgatctcggccgcaaagcgaccagaacgctgcgccgcgagcgcgcgcgtgtgcgaccgcagcgcgaagcggtcttggtcctcgcgggtgaccttgaactcctcggcaacgttctccgccgtctcacccatggagtcgacaccgaagcgctcggcgaggcgcgggttgacgaagcgccacccgatggtggtgtcgtagaccgtggcagagcgggcaaaggccgcctcggccttgggcatcacgaacggtgcccgactcatcgactcgacaccgccagcgaccaccacgtcggcctctccgaccgcgatccgtcgcgccgcatccacgatcgcctcgaggcccgaggcgcagaggcgattgacggtgacggccggcacgccctcgccgaaacccgcgagcagcgtcgacatgcgcgcgacgttgcggttgtcctcacctgcttggttcgcacaccccgccacgacctcgtcgatcgcctcgaccggaatgccgacgcgctcgacggcccccgcgagaacagtcgcgagaaggtcgtccggtcggacggacgccaactgaccgccgtaacgaccaaagggggtacggaccccaccgaccaaccaggcactcattggacacctccacgtcgctcgaggagcggccgacccagcgaacgcgatcgaccccgaaacaccgccacgaccgagccatcacgcgtcacggtgacgtcgtagacaccgctacgccctcgacgcacgacctctcgagcctcggcaacgagacgatcaccgacgtaggcaggttccacgaaactgatgtccgcgccttgcgcgacggtgacgtcgtcgtaggtgttgcacgcgaacgcgaacgccgtgtcggcgagcaggaacaccacgccgccgtgggcgatcccgtgaccattcgtcatggcctcgtcgatctcgagcacgagccgcgcgtaccccggagccaccgcttcgagcgccatcccggccgagcgcgaggcggtgtcgtgctcccacagataggccgcacaggcctcggcgagctcgactggactcacgacctctcctccctgccatcggacccgctcgcgagatgcgccgtcccttggtgcgagcgcagaccggcgaggacgaagtccgccacccagttgccgtactcggcgcgtccgagacgaccatcggcttccttgaaccacgtggggtaccagttcacgatgccgaacacgctcatcgccgcgacgggaagctcgagggggtccatctcgggtgccagctcggcgacgagccgttccatgactcgcacgacgcgccgctcggcgtcgcgcaccgctcgacgctctgcgtcgtcgagacgctcgagatcgttgagctgcacccggtggacgtccgcctcgacctggtagcgctcgacgagccgacagatgagcgcacggaggcgggcctcggccgtaccttccttcgcgccgatcgcctcgacctcctcggcgagatcgagtgcgtagtccagcaggatcgccgcgaggatcgactccttcgtggagaagtaatggtagagcgccggcttggacagcccgaccgccttcgcgagcatcgccatggaggtgccacgaaaaccctcgcgcgcaaagaggatgctcgccgcacgcacgatctcactgcggcgatgctcgtcactcggcaccgtcatcgaccgatgaacctcggatcgcgtcgctcctggaacgcgcgcatcccctcatggaagtcatcggtgccggcgagctggccttgcaggtgcgcctcggcagccaagcctcggcggcgaccttcgccgccgagctcctcgaacagcgcccgggatgccagcagtgcctgcgtcgggccgctggcaacccgtgctgcgaggtcggcgacggcgcgctcgaaggtttcgtcgtcgaccacgagcgacacgagcggcgcaaccctcggatcgtcagccgggaggagttcgccggtcgcgatcaaccacatcgcccgccaacgtccgagcacgcgccagagcgcctcgtgcgcgccagagtcgggcgcggccccgagacgagcgaagggcgacccgaggcgacaggagcgagccgctacgaccaggtcacaggcgagcgcgatcccaagacccgtaccgagcgcagccccatgaatcgccgcgatggtcggtgccgagagtgagcgcagctgttcgaagagcggatggtacgtccctgccagcacaccctcggcatcgtcatggtccgggtcgatctcggtgagatcacgaccggccgagaacgtgcggccgacccctccgatcacgacggctctggccccctccgtccgtcggagcgcctcgccgagcgcctccacgagaggtcccgtggtcgcgttgcgctggcccgggcggttcagccacacccacgcaacgccgtcacggcgttcgtcgacgacgagctcctcgcgcccctcggccacagccggccatcgctcgaccacgacgctcacctcccccccggatcacccgcgccagggcccgtcgatccccgtcgctgtcgttgctcgaggaacgcccccatgcgcgcacgcttctcatcgctctcgaagagcaccgcctgtgcgaggatgtccaccgttcgcgtcgagggccgctcgacgctggcgaggaccagcttcgtgaactcgagtgcgcgcagcgactgggacgccatcgacctcgccagagcgacggcgctccccaccggatcgtcgtcgacgacgtcgacaaggccccactcgtaggcctcggccgcctcgacacgaacgcccgccaggagcatccggcgcgcgcgaccgagcccgacgagatcgaccagacgtcggtgcgcgcccgcaccggcgacaataccgagtccaacctcgggctgacgaaaccagcttcgcgtggaagcgacgcgaaggtcacaggccatcgccagctccaggccgccgccgaccgcagggccgtcgatggcggcgaccgtgggccaacgccacctggcgatccgatcgaacagatcgacgttgatggcccgaagggcatcctcctcgccgcgagcgaggagttctgcgatgtcggcccccgccacgaaccgaccgggcacggcgctcgtcaccacgagcaggtgcggggcatcacgcagatcatcgagcgcacgatggacctcgttgaccagctcgagcgagagggcgttcgccgcctctggtcgatcgatcgccagcgtggccacgagaccgtcgaccgcgacgtgcaggtgcgggtagtcccctaccactcgaagaacccgcgaccactcttacgcccgagctccccgcgcgccaccttgtcgatgaggatctgcggcggctcgaagcgcgaaccgaggtggaccgcaaggtagcgcgcgatctgcagccgcacgtcgaggccgacgaggtcgctgagccggagcggaccgacgggatggcggtagccgagctgcatgcctcgatcgatgtcctcggcgctcgcgacctcctcctcgagcatccgagcagcctcgaggccgagcaagaccccgagccgtgaggtcgcaaaacccggccgatcgcggaccacgatgggctccttcccgaagccccttgcggccgcgacgagggcgtccgtcgttgcctccgaagtcgcgccaccgacgacgacttcgatgagttggctcggcaagacggggttgaagaagtggagccccccgaaccgactcggatcctggacgctggaagcgagatcggcgacctggatcgaggacgtgttcgtcgcgaagatcgcatcgcgacgcgcgatcttcgatgcactgtggaggacctcgcgcttgagctcgacgacctccgggaccgactcgatcacgagatcggcagccacgaccgcatcgagacccgaacgagccgcaaccgcaccgaacgcgctccgctcggcgccatgagcgaccgcctggtcgaggagcctctcgacacgctcgaccgtctggcgagcagctgcgtcagagacctcgacgaccgtgacgtctcggcccgccacgaccgcctgggcggcgatgcccgaccccatggtgccgcccccgatcacgacgatcgtgcgaatggctggcggttgccctagaacaccgggatgatctcgtcccactcgacgtccgacacctcttcccccgtgatgcccacctccgggatcgccgggaacggaatcccgtagcgatcgagaacgcccttgacgttgagcatcgcctgccgccagttctcgcgcttctcatcgtagctcgcgatgccgagtccaccggagcgagcaacctcctcaatcacccgttggttgtcgatgaagtcggagggaagatcccagaagtcgtgcggcggttcgaacaaaacccccgagaggaacacgtaaccggcacggatctgcttcgtcacgatggcgcgatcttcgggcgcgatcttcgggtagtcgcgctccatgagcgcgaggcagatcgccatgtgacgaccctcgtcacgaccgatggcgcggaacgcctcacggaacactgggatacgcgtgtgcgtgtacatgtggtggaacagcgtcgaggaggccacctcccccatcaggaacgaactgaagagcaccgccatcgagtagcgcggtaccgccttttggtacccactccagtagcgcgctccgttgtgatagagccatgccacgttgcgcttggccaggcgcccgatctcggtcttcggctcgtagtcgagtggaccacctggggtgagccgactgatggcctcaccgcagacaatttcatggttctgctcgtcacgggtgatcgagaagaacgcacgccgcaccggatcttcctcgtggatctcgtaggcgtgaatgagcgccgtcgcgaacacgggtggtgcggaggcgtcgaagaccgacaggagcgagaaccagtacgcgatcgcctcgcgctcctcgtcgctcatgcgctcgggctggagcgtgtcccagggcagacgcgcaggatcccagtactctcgctgcgacgacgcccagatctcctcgagtttggccgtgtgacgttcccacgacaaggggaagatgttgggctgctcgatctcgggcggcatcgactgccgttcgtcggtcatggttccctccttgccaccgctggcaccgccatgctagcagatcttcgaccgaccggtcggtcggtcgtcggcctagactcacccttggtgtcgcaaaggagggaaggtggccaccatccgcctctacccgtcgggtcgtgaagtgccgtgcccagagggctcgacagtgctcgcggccctcgaggctgagggctgggccctcccgaacaactgccgcgccggcacctgcggtgagtgcaaggtcaaggtgcgccagggcgagttcgaccaaggtttcgtcctcgacatggcgctctccccggccgagcgagccgagggctacggcgccatgtgcatggccaagccgctgtccgacgtgctcgagatcgagtggggcacgatcgatgcacgtccgctcctcttcccaccccggcgcgacgttcccttcacgctcgtcgacgcgatcgagcgcacccccgccatcaccgaactcgtgctgcgacccgacgaggagccgctgcgttactggccgggccagtacgtgcacctcggcaaccccccggacgcgccgcggcgggcctactcgatcgccaacgccccgcgcgcggacggtgagctgcacttcttcgtcacgcgcgaacgcttcggccgcaccagcgcgtggctgctcgaccgtcggcccggcgacgagctccgcctcgatggaccctacggcgccttcatcggcgacccgtcgatcgccacgcccgtggtctgcctggcggccggctcgggactcgcaccgatcctcgcgctcaccgacgccgcgctccgtcgtgggttcgcccatccggtcacgctcgtgctctccgcacgcaccgaggccgacgtgtacccgcgtggcctgctcgcacacctcgagcggcgctatgggaacttccacttcgtgcgcaccttgacacgcgacgagggcccaccacctcgcggccgcatccctgccatcttggccgatctcgtcggcacgctcgccggggtcgcggtcttcatcgccggtccggaggccttcgtcgaggacacgcgccgggcatgtctcgcgctcggcgccgatccgtcgtcgctgtatcgagagccctacgtcccccaggacgacctcggttccttgtcggtccttgggccgtggtgagcacgtttggtaggctccggccatgactgtctcccaggcacgcatcgaggccatcggtcgtgagctcgcctccgtcgagggtgcgagcggtgtgttcggcatgcacggtctcgctggccggatcatggcccaagccctcgacgatcctggctttcgcgccaacctcttccaactcgtcgacgtgtttcctgccctcgccgacgccgacgacgtcgcagaccacgtccgcgattacctcgcagagcgtgcaccgatgtggatgcgcaccggacagcgcctcgccgaacgcgtcccttcgggccgctggctgctcgagcgcatcacccgcgagaacatcctccagatggcgaggcagttcatcgtggctgaagcgcccgacggcgtcgtcggcggcgtgggcgcgctcgccgccctcggctactcctcgaccgtggatctcctcggcgagaaggtgatcaccgccgaggagtcggcgcgctacctcgacaccatcggcgagatccacgaccacctcgtgcgcgcacgccccgtcctcgaagcccgcggaccgctcatcgggccgacggtctccatctcggtgaagccaagtgccctcagccctcgctggtcgccgctcgcccacgatctcgtcgtcgatgaggtcgtgagccgcctcgaaccgctcctcaagcgcgcccagaccgagggttcgctggtctttctcgacatggagcactacgacacctacgagacgacgctcgcggtcttccggcgcatcatcgccgacccagggctcgccgagctgcagatcgggatcgtcctccaggcctatctccgccgacacctcggcgagctcgagcgactgctcgccgagatcccgagcgccacgcacctgcgcgtctggatccgcctcgtcaagggcgcctactgggacaccgaggtctcccaagccgtcacggagagcgtcgagccgccggtcttcgtcgacaaggccgacaccgatcgcagctacgagcgctcggtggcgatgttgctcgacgccgccgatcgcgtccaccctgcgttcgcctcgcacaacctccgcagcctcgccgtcgtgctcgccgaggcagaggcgcgccgtctcgacccggaccgcttcgagatccagatgctctacggcatggccgaaccgctcgccaccgcggtacgccgctacggcgcagccgtgcgcatctacgctccggtcggctcgctcctgcccgggatgagctatctcgtgcgtcgcctcctcgagaacacctccaactcctcgttcgttcgccatcgcttcggcgatcgagaaggcctggacgagctgctcgctccgccgcgctcccgtccggccaccgtcgtgcccccgagcgtgccgcctggctatcgtcacaccccacagacgcagttccgtcacggcgacgtccgcgccgcccaacgagccacgctcgaagcgctcgccgcacagatcgcggcctcgccacgatcggtcccggctcgcctcggcgcagagcggctcctcggcacgcgcctcgcggggagtcgcaaccccgcccatcgggacgtggtcgtggcgcagtgggccgaccacgaccccaccatcgtcgaggctgcggtcgcaaccgcagagcgcgcggcccgggccctcggcgacctcggcctcgctgggcgcgccgccatctgcgaacgcgccgccgcctacctcgccgaccatcgacgcgagatcgtcgccaccgaagtcctcgaagcggccaagccgtgggtcgaggccgacaacgacgtgggcgaggcgatcgacttcttgcactactacgcccagatggcacggcgcctcgagcgggccgaccgcctcgactccccgccgggcgaacgcaaccgcctgcactatcgtccgcgcggcgtcaccgccgtcatcccgccgtggaactttccgctcgcgatcccgatgggcatgacggccgccgccctcgtgacgggcaacccgacgatcctgaagcccgccgaacagacgcctctcaccgccagcttcatcgccgatgccttcgaggctgcagggctgccgcccggagcgttggtcttcctccctggccgcggcgagaccatcggccaagccctcgtcgagcacccccaggtggcgaccatcgccttcaccggctccaaggccgtcggtctcgacatcgtggcgcgcgccgcaacgctgcgccccggtcagcgcgcgctgaagcgggtcatcgccgagctcggcggcaagaacgccatcatcgtcgatgccgatgcggatctcgaccaagcggttccgggcgtgctccagagcgcgttcggcttcgccggccagaagtgctcggccgcctcgcgggtcgtggtgcaccgacgcatccgtgacgcattcgtccagcgactgatcgaggccgccgcggagctccccatcggcgacccgcgctcctccgcgaccgtggtgcctcccgtgatcgacgatgaggcccaagcgcgcatccgcggcgtcatcgccgacgccgcggatgcggcgacgctcgcgtggcaggcaccgtcgaccccgagcgagggcagctacgtgccaccgaccatcttcgtcgatcccgaccaccgcgcgccgctctggagggacgagatcttcggtcccgtcctcgtcgtcgacaccgccgacgacctcgccgacgccatcgaccgcgcgaacgataccgactacgccctcacgcagggtgtctactcccgctcgccgagctccatccggcgcgtcgtcgaccacgctcgcgccggcaacgtctacgtcaaccgcccgatcaccggcgccatcccgggccgccatcccttcggcggcttcggacactcgggggtcggtttcaaggccggtggtccgagctatctgctccagttcctcgatcagcaggtggtgtcggagaacctgatccgccagggcttcagccccgacatcgcctgagggacgacccagcgcaccaatcgtcgcggtcgatcccgggggcggccggcacgggaagcttccagcggcacgagtggttgcattgtgcaactagcctgtgagcacgccccgctgcgtacgacgagaggaatgaccgtggccacgaagacccgtcagtggagcgagctcctccacaaccgagacgtggccatcatcttcatcgcacggctcgcgatgagcacgtcgcgcgcgatcgccggcatcgccgtgccgctctatctcgtcgcactcggcttcagcggcctcaaactcggtgttctctacctcgcggtcgcgctgtttgcggccatcctctcgcaagtcatcggcctgtccaccaatcgcgtcggcgccaaggtctggatgatcgtcgttcccgccatcaccgtgctggccgccgtggcctacgccgagagccacacgacctggatcttgttcgccttcgccgccgcaggatcgttcggccggggggcgggtgccggggccggcatggtcgggccctaccagccggccgaatccaagctcctcattcgcgcggtgacgccgaccgagcgcaaccgcgccttctccttcgtctccatcgcctccaccgcgggcgccctcgtcggcaccgcgctggcggcgctcctcggccacgcgcacgtcgtcgacagcgccgccaccgctctgtttcgaccatcgatgctggtcgcagcggccttcgccgccatcgcggcgatcgtcgcgctctggatccatgaacccgccacaccggtcgcgaccgaccagccacggcccaagctcttcaccttcccgcgtcgttccgcgtggctcctctggcggctctgggcaaccaacacactgaacggcctcgccgtcgggatgttcggaaccttcgtgacctactggctccatcgtcgctacggagcgagccaagtgacgatcggcgagctctacctcgtcatcaacatcatcacgctggcctccggactcgtcgcccccaggatcgctgcccggttcggcacggtacgcgcgaccgcgatcttgcgtgtcgcccagggactcctcctcgtgccgatggcgctcgcacccaccctggtgatcgcgggagccatctacctcgtccgcatgttcgcccagcgcatcgcccttccgctacgccagtcctacgcgctcgccatggccgaccccgaggagcagagccaggtcgccgcgctctcgaatctgccgagccagctcgcgatggccgccgccccgacactgacgggatacctcttcgacgaggtcagcctgtcgctgccgttcgtcatcggcggcctcatccagaccctgagcgcactcgtgttctgggcgttcttccgcaacctccatccacccgaagagcgccatgcggcgcgcacgagctcgctcccagggatgcacgatggtcctcccatgacctccacagctccgtgacgtagcgttggtcgcacccactcccccacccaccaaccaaggcccgcctctggcgggccttggttgtctgtgccgcgcattgtcgacggcgctcgttgcgtgaggccagcgtgaccaccgatcgtgacttgggcccgcgagccgtcaccatcgatggtggaccagcgccaagcgggtggtgggaggtcaccaactgttcaccatcggagcaccgaacgttctccagcgtgcgactgtcgcgtcaccttggcttcgtagcgtcctcgacgtcggatgacaacccagtcgaaagggacacgatgacacgaagcaagctcacgacgccccggctcttcgccggcgtcgctgcggccagcgccctgctcgccgcctgcggaagcgcgacgaccgcgtcgaccacctccgcccagacctcatcgcccgcctgctgggcaaccgcgaccacgattcaagcgtgcggcggcatgaacgccctcatcaaggccgcccgcgccgaagggcacctgaacgcgatcgccctgccgtcgaactgggccaactacggctcgatcatcgccgccttcgagaagcgctacggcatcaccgtgaacgtcgccaatcccgaaggatcgagcggcgaggagctcgcggcgctgaagacggagaaggggaccgcgaaggagcccgacgtcgtcgatgtcggattgtcgttcgccctccagggccaacaggagcatctcttcgcacccttcaaggtgcccacctggtccgagatcccggccaatcagaaggcagcgaacggcgactggttcgaggactacggcggcctgatcgcggttggctacaacgcaggtgccgtccctcgcccgacctcgctcgcctcgctcacgcagcctgcctacaagggcagcgtctgcctcgacggcaaccctgagagcgcaggcgccgccttctcgggcgtcttcgctgcggccctcgcgaacgggggctcctatgccaacatcgcaccgggcatcgcgtacttccagcgtctgcaccaagccggcaccttcgtgcccaccggcgccaccgccgccagcatcgaggccggccagtgccgcgtgaccctcgactggacctacctccaggcgcagtacgccagccagctggccggcaaggtcacctggaagtcgttcatcccctcgaacgcccacgtcgctgcctactacgtgcaggcgatctcggccaacgcgcccgatccagcggcagcgcgcctgtgggagacctacctctactctcccgctggccagaacggctggctcgagggctatgcctacccggtcgagctcaaggccatgatcgccaacggcacggtcaaccgcgcagcgctcgccaagctgccgccgctcccctcgaatcttgcgttcccaacggcgagcgaactcgcctcggccgcaaagacggtggtcgccgagtggccaacggtctagcggtcgcctccaccaccacccgagcagcgtcccccaccgctgctcgggtggcccgcctgacaccgctcgtcggcctcgtgccgatgatcgcctacctggccatcttcctcgtcgtgcccgctgccggcgtgctcgaaggcgccttcacgggcgcgcacggcgtgagcctggcggcgctcaagggggctaccagcggcgcctttctccacgcgctcgtcgtgagcgtcgaactctccgccaccgcgtccgtggtggccgcggtcctcggcaccgcagccgcggcggccatcgtctcgctcggctccgagcgcctcaaccgcatcaccgcctccgtcgctgcggtcctcgccaacaccggcggggtcccgctcgcgttcgcgttcgtggcgaccctcgggaacttcggggtcgtcacgctggcgctcgcccacctcggcttcgacccgtacgcgcatggcttcacgctctactcggtgacggggctcgtgatcgtctatcagtacttcctcctccccctcatggtgctgatcatggtccccgccattcgagggttgcggcgtgagtggtcggaggccacctggaccctcggcggacgtccgtcccacttctggcgccacgtcgcggccccgctgctggccccgaccgtcctcgccggcctcctcgtcctctttgccgacgcgttcgcggcctacgccaccgccgccgccctcgcaggcggcgtcatcccgctcatcccgctcgagatcggcaacctcatcgacgggaacgtcgtcgcgaaccaggccaacgtcggtgacgccctcggcctcgagatgatcgtgctcgtcgcgctggtctcggtggtctacgcgctcgcccaacgtcgccaaaccaggtgggcccggtgagccgcgcacgcctgctcgcgcttgccgtggtcgtgctggtcgcggcctacgtcctcgtgccactcgtcgcatcagggcgcttcagcctggacggaccccacggaaccctgaccatgtccgcgtacgcagccatcgtccgcaccggcgcattctggagctcgctctggctctccgtacgcgtgggcgtcgcgacggcgatcctcgagctgatcctcgtcacctggacctcgctctgggtgcgcctccgcgccccgcgcctcgccccgctcgtcgacacgctcgtgctgatcccgatcatggtgccggtcgtggtcatcgtgctcggtgtcacctcgtcgctgcggttcctgccgtcgctcatcaccgggaccccggcgatcctcgtcgccgagtacgtggtcctcgcgatgccctacagctaccgcatcgtcgatgcgggcgtcgccgccctcgacctgcgcaccctcaccgaggcggctggctccctcggagcgcgctggagcgcgacgatgcggctcgtcctcgtccccagccttcgagggcccctgctcgccgccgccgccatggcctttgctctctcgctcggggagtacgtcatggcgagtctgctctcgttcacgaccttccccgtgtggctccagaccatcggagccacccaagcaaccgaggcggtcgcggtgtcgacgctcgcgctggtcggcaccgtcgtcctgctcgcggtcgtcgtcgtcgccgctggccgcgagcgaacccgagtcgcggatcgacaagcctgaggagcgccatggacgttctcgaacccgttaccgacacccgcacgaccgtcgcgcgatcacacggcgtcgaggtacgcctcgagggcctcgtgcgcgcgttcggtccgacacgggcgctcgacgacgtctcgatcaccgtcaaccccggcgaactcgtcgccctcctcggcccgtcgggaagcgggaagaccaccgcactcagagtcctcgccggcctcgagcgccccgaccaggggagggtcgtcatcgacggcgaggacgtcactcgcgtgagcgcccatcgacgcggcatcggcatggtgttccaggcctacagcctcttccccaccatgaccgccctcgagaacgtcgccttcggcctccgcctccgcaggatgcgtcgccccgcccgcacggctcgcgcacacgagctcctcgagctcgtcgggctcggccaactcgccgatcgtcgaccccaccagctctcggggggtcaagcccaacgggtcgcgctcgctcgcgcactcgcgatcgagccccgcgtcctgctcctcgacgaaccgctgagcgcgctcgatgccgccgtgcgtgtgcgcctgcgcgaggagatccgtcgcattcagctcgaactcggcaccacgaccgtcttcgtcacgcacgaccaagaggaagccctcagcatcgccgaccgagtcgcggtgctgagggcgggccgactcgagcagctcgacaccccgacacagatctaccatcggccggcgacgcccttcgtcgcgtccttcatcggccgagccaatcgcatcccggcccagatgaccgagaacgggcggctcctcgtgctcggacacgagatcgacgcgcctaccgccgacctcgcccccggcacccggcacgtcgcactcatgcggcccgaatcgctcaccatcacacccgcaccggacggtacgggccgcatcctcggcctcgtgttccgaggtgcaagcaccgacgtcaccgtggcgtggccgacgctgcccgatccgctcgtcgtgaccctcgctggcgagccaaccgccgacctcgcccccggcgcccgcgtcgaggtcgtcccccgcggcacggtgctcttcgtcgagcgtgccgaggagcgtccatgacgaccgatcgcaccatcgcgacgacgggccccgagcccttcgtgacgactgctccggcgcccggtgagccgcaccgtcgcctcggcgagcgtggctccctccacgagcacgccaacggcgcaccgatcgttctcggcaccctctggcacctcaccgacctccacgtcaccgacccttcgagcccgatccgcgcgccattcctcaaccacctcggcgaaccgaacggtccgctgcgtacgcgcatcggccgcgtcggcacctatcgaccccacgaggcggcgagtgcccacgtcctcgccgcgatggtccgccaactcggatccatcacccgtgcgcccgtgttcggtggtgccgtcgacctcgtcgtcgcgagcggcgacctcgccgacaatgcccaggccaacgaggttgcagcggcgagcgcgctcctcagcggccgtgaggggacgcttagggctccgggcctcgccgatcccttcgaagggccgggcgggctcgacgacgatccgcactactggcacccagagggtgagcccttcgacgagtggcgcacgaggcgcggctttccgcagatcgaagggtggtggtcggcactggcggcgcccatcccgctcgccacgcacgatctgccggtcctcttcgtcgccggcaaccacgacctcctcctccaaggcaccgtcccagcatcgccccgccttgcccgagccgcgatgggggggctcgcacccactggcgtcgcagccgacctcgatctcgcgcacgccctcgccgaccacgagcggacggcaccggacccctggcgactcgtggtcggggctccacaccgttgcgtcgctccgctcgccgagcgcgcaccactcgccgccatcacgaacgactaccccttgcctcgcaggatcgacgtcggcgcgctccgtctgctggtactcgacacgaccaacccgtggggtggctggcaaggctcgctcgacgcggcgtcggttcgctggctcgtcgacgaactcgacagcgcccacgaacgacggctcgacgacgaaggccgctgggtacccgcaggaggctccgacgtcgcggtcgtgctcgtcacgcatcatccgatcgagactctggtcaacacgaccgtcccagaggaggagcggccacgagtcggcggatcgtccctcgctgcgctgctggatcactacccgaacgtcatcgcctggctggccgggcacacccaccgacaccgggtacggtgggtgcgatcgaggctcggcccctacgggatgctccacgtgacgacggcgtcactcatcgactggccccagcaaggcaggatcatcgaggtggccttcgaccctcgagcgcagcgcctcgtcgtcgcgacgacggtcgtcgaccacgctggtgccgtcggcataccagtgtcgacaccggcttcgatcaccgagatcgccgggatcgcccgcatgctcgccgcgaacgaccccgagcgcctcggagagcgcgaaccaccaggacgcggtaccccgaacgaccgtaacgccatctggacactcccgatccctccagggctcgcgcgccagctcgcgcgtcgcggcgacggatggaccgcgttcgccccggccacaccgagcatgccgccagcggctccctaactgccgagatctgcgaggctcgcccggagcgcgctacggagggtcgcgacgaagcgctcgtcgacggctcgagcctcctgccacaaccgatcgagtgtcgccggctcgagactcgagcgccgtcgctcgatcgccacgaggcgggtgtggagctcttcgtgcacctggcggaggagcgagcgcgcaccctcgtcaccgatcagtcgcttagcatcgctagccaaccaccgacccaggtggcagtcgtcgaggctcgcggccatccacgtcgcgccctcgtcgtcgcgctcgtcgacgacggcggcctcgaggcgacccatcagcgcgtggtggacgctgagcagcggaccgagcccagcgcgctggaagagcgggtcctctgctcgcgggcggtcgtgccaccgtgacccctcgaggtcgagccatcgggcaacggcctcggccggcatcggcctggcgagatggaagccctggagactcacctcgccgagggagcgtgccacgcgctcgaggtacgcatcctcgacgccctcgatgacgatccgacgaccgaggaacagggcggcttgcacgctggagacgacgatgccgaagtccgccgcggacgtcagcatgccgcgcacgaagctctggtcgatcttgaccgtctgcgcaggcagctcccgcaggtaccggagcgaggcatggccgaccccgaagtcgtcgatggcgatggtgagtccgagttcggcgatcgcctcgaggacgtcgtcgactgcacgggtgtcgccgagtgccgccgtctcggtgatctcgagttcgacgagcctcgtcggcaccggaccaaggcgctcgagcgcgctcgccacatcgtcgacgaagcgaggatcgagcaggtgctgcggcgagatgttcaccgagaccccgaaggtgaacccggactcgtgccacgtggcgagctgcgcgagggcctcctcgagcacccaccgaccgacacgacgcgccagcgccggatgatcgagcgccgctccgaagaccgccggcccgatacgtccacggtcggggtcgtcgatacggatgagcgcctccatcgcctccaccgccccatcggcgctcacgatgggctggtagtcgagtgagacccgtccgcgctcgagcgcgacgaccaccatggtgcgggcctcgtcggcacgccgagccgccacctccatcgccggaacgaacaccgaagctcgatcaccaccgtgggccttcgcgtcgtagagcgcgagctctgcatgacgcaccagcccctcgaccgtagcccggtcggctgggaagctcgtgatcccgacgctcccgctcagctggggcaccccgagacgatcccagtcgaggtcacggatcgcaccgatccagcgctccgcctccgccgcgagcgatgcccgacccgatcgccccggcagcaccagcgcgaactcgtcgccacccatccgcacgacgaggtcaccctcgcgcgcgacccctgcgagcgcgtgcgccaccactcgcaggacccgatcgcccgtctcgtgtccgacgaggtcgttcacctccttgaagcgatcgagatcgagcaaggcgaccgcaaccgggtcctcggtggatcgcgatgaccgacacagcgtctcgaggcgaggcgtcagcacgctgcggttcgcgagtccggtgagcagatctcgctcggcgacgtgcagcaagttcaacgcgagtacacctgcctcttggagcggttcgaagtagtcgagtccgacgcggcgcgcaaagcccgacgccgtgaccacgacaccgagaccgcgggccggacccgccgcaaaggggacgagcaccacctcgccgaacggaaggttccggacgctgtcccagcgcggtacgaggcgatcgcccacgtcgagcacgatcggctcagacgaccggcgcccctcgagcaccgactcgaggggcgcgtcgacgacggtcgtcggtagctcgcgtcgtagtgccgcagcgagcccccctcccgcggcagccagcgtccagtgcccgctcgccggatcacgcagcacataggccacgagcacgatctccctcgagcgctcagacacgagtcgacacaacgtttcgagcatcgcaccgaccagcgaattcgtctggtcgatcgcattcgcgctcccgacacgagccgcggcctccacgagcgcgtcgaagacggccacacgatctcgaaccgtcgccttggccgcgcgcgcgaagccctcgagctggagcatcagatcggcgatgacgatgcgtgccaacgcgtcgaggagggggacgcgatcggcgatgggcacctggtgttcgacgagcgtgccccagtgctgccagtagacgacgtagccggcggccaaccacgccggatcgacgtgccacgtgaagtgtcgtcggcccagctcctcggtgcctcggcgccaggcctcatcgaagcgacgatcgagaagctgggtcgcgtgttgggcctggaggtcgatgagacgctggatggtcggcaccgagaagcccgcgaagaccgcacgggtctcgggatgcgcgagcacgaggtcgtagaaagccgcagcgagtgccggagcctcggacgccaacagatcacggtagcgctcgacgagcctccaatcctcctcaccgagatcgatgagctcggtgagggtcgtgcgtcgtcgggtgtcggcgatgaaccgcctccgcgggatccgacggtcgccgagaccgccgaccacccaggcaccgtacgaacgtcgctctggcatgtaccacacctgcccgcgccgaaatccccacagcgcactcacgtgctgggggcatcgaccacctcgcggtcacccgtaccgttggcacgccccgcgccgcacgcggacgccacgcacacctcgtgctggagcctaccatgaacgtcgacgaaggctcggagacaccaccgcgcccagcgggagctgcacaatcctcggacgagcctcgtcgcaggccatggccgcaaccgacggacccgccccagcacaaccacgacggacgagaggacgggctcagcccggaacccgcagaaccgaccttcggtcgcacgccgacgacgtggcatcacgtcgcccaccgtgggccgccggggtctcgaaccccgcaccttgggattaaaagtcccctgctctaccggatgagctagcggcccatggccatcagcctacctgcgcagttgccgtgcgccaggaaccacgagcaccgcgagcgcgactcgagccctccgccaccgggccgacacgcatcgccgagatctcgaagggccgtcgcgttctcgacgtgcgagctagaatcccgtcggctcggacagaaggaacgacaccatgggcacgacgagaggacgcacgacgaccgtgcggccgagaggtaccacgatgcggatcgccgctctggcggcgaccgccgcggcgatgctcgctggctgtggtgccacgacggccacgtccacgacgtcgacggccgcatcctcgagccccaagccgcagcccatcgcggcgacgcacctccccgacccctgttcgctggtgacgaccagcgaagcgagtgcggctctccaggtgccccttcgccagacacaggacgaatccacggcgggataccgcagctgcgactgggtcaacacgacgagcagcctgagcgcgggtcgcggctcgacgatgaacctctacttctatccgggcccgacgatctcgcaggccagcgactaccgcgccctggaggcgcaagggcacttcgcccctaccgagatcgacggctatccggccatcgtggcgggcgccgagtacgaggtcgacctcggcagcgtgctcgtcaccggtgtcgcgttctcgacggtgtcgccgcaggcatcgagcggcgccgaacgcaccaccatcgcgacggcgatccgacgcctctgcacactcgtccgctgcgtggcctgagcgcgtctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtaaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgggacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttatctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatgtcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagctcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagcagtcgcactgtcgatgtgttgatctgcttgtcgtcaacctcgagcgtccggccttcgacagcgagccctaagggcgttggcttcaggccgtagctcgacttcaccgacgcgagcgctagaacgtcgccgtgggagccgagaagaagcacggatcgggcggcggcggggaaggccctggagccgagcagacggtccagcggtgcggccccactcgccttggtcaagtgaccgatcccgacgatggttgccccggcgtcacaggcgatgctacgcaaccggccgagcaccgcccgaacgtccgcgtcacggtgcgtgtcaaccctcccaccgagcgcacccgacagcggctcgacgatgaccaagcgagcatgattgtcgagcactgtccgccgcagcctctcgaaatcggcagggaaactgacggggactgtcgtgaagccgagcatgcgcggatcgccgcccgccgccaggtaccggggccccagcacactcgtcgcgttatcttcgctggaagcgtcgagcgtgacggcgggctggccgaacagggcacccggcagttccccgcgacacagccgggccgccagctgcagcagagcctgttgcatgaacctccgcggcgatctgcaaactccctggtagcacgcgtgtgagatccaccatctcaacaggctcgatggcgaggattgggcccgtggcctacaacctgctcacctcagagcgccaccagctttacctgttgccggcgtcgatggcggactggctgcctgaggaccatttggcgtggttcgtgctggacgctttggaggagatggaccttttcgccttctacgccgattaccgagccgatggctggggcggcgcagcgcacgatacggccacgatggagacgctgttgctctacgcctactgcgtcggggtccgctcgtcgcgccaggtcgagcgtgcgtgccacgtcgacgtcgccttccgggtgatctgcgccgggctactcctcgaccacacgacgatcgcccggttctgccatcgtcacgaagaggccttggagacgatcttcaccgcctcgcttcgtctgtgtgcgaaggcagggatggcctgggtcggcctcgtggcgctcgatcggacgacgatggccgctctcgcatccctgcagcgcaacgtgatcaaggacacgatcgacgaggccgtcgagaagatgttcgccgaggcgaaggacatcgacgaagccgaagacgccacttttggcgaggcccgcggcgacgagccccctgccgttcttcgtggacgccgggaccggcgctgacgcttcaaggcggccaaggaggtcctcgacaaagaactggcagccgagcgcacggcccacgaggcccatctggccaagcgggtggacgaggaggaacgacggggcaagaagctgcggggccgaaagcccaagacgccgaaggacaaggccggcgcgaaggaggagaaggtcaacacgaccgacccgcagtccaaggtcatgtcgacgaagaacggcttcctccagggcttcaacgcgtaggcggtcgccaacaaagaccaggtcatcctcgcagcctcggtcaccgacgagcagaacgacaaggccccactccacccgatgatcgaggcgatcagcgagtcgctcgacaaggcagggatcgatgagcggcccggaaagctcctcgcggatgccagctacgcgtcggaggagaacttcgccgcccttgggccagacgaccccgacagctacgtggccgttcgcaacatgaggaagaacccaacccggcgcaccggccggcgcggaccgctcaggaggaacgcgaccttcctcgacaagatggaccccaaggtgtcgaacaactcggggcgggacctctacaagcgacgccaggcgatcatcgagccgatcttcggccagatcaaagacgtccgcaagattcgctcgttcatgcggaagggcaagtccgcagcggactcggagtaaaagctcatctgcggcacccacaacctcttgaagctctcccggcgcgcccttgccacgccgggcaccgtgccattcagccggctggcgatgacgacagccagatgaaggccaagtagcaagagctcagcggccctccgtggccatcattcccgcgttcaccaacgatcagccgtccctgccgtcgccctggtggaacctgccgaggcggagcccgccgagaggagcagagttcacgcaacagcctcatctgcccccaataggccgtttcagaaccctatgatgcgtgtcatgccttccaacaccatcacaagacgccgtgcgggggcgagccccggcggtttgcgccgtctcgtctccctccaacagcgtgttaccggcagccgccaggctgccgcggtccgcaaccagctggtcgccgagcttcacgcccaaggggtgcccacacgggtgctcgccgaacagttagggatgagcgtgccgggcgtgcagcgcatcatccacctccacacccgcgccggcggctaacctgcagcgtcggtgagcgaaaggttaccgcctgcccccccgcatggggggaacctccctgaccaagcagccccccgccgtaatggcggggggcctttccgcgtcaacagcagctcaacggcggctcaggcgtaacaccaggaacgtgacaccgaggatcacgtcgaccgccacccacaaagcgatcacgatccctgccccgatcgtcgtgcccacatcggcggcagcctggcaggtttgggtggtgagcgtcccgcagtgggtggcgtgcgaccccgagtggattcccaccaccaagcacacgatgaagatggcttagacggcgaggaacacccagcggaagattcgccgtcgccggcgcggggttgtcggcgtctcagactgttgcatcggtttgcctccccctccttcaccgggagcgtggcccccgcagcggtcactatagccccgcgacgctggcagcgcccgcatcgaggtaggatcggccctccatcgccaagcgcaaacgacgactggctctaccggtggttgcgacactccgaccatgatggtcggtggacaggtagcaaccaccggtggtgggttttagcatgccaggtcgacgcctcgggttggaagagtgggaggagatccgggtcgggttggtgcgaggcgagtcgctgcgggtgatcgcccggcggctcgggcggccggtgtcgacgatcgctcgcgcagtggaccgcaacggcggttggatacgctatgtggcggcttgtgcgcagcgtcgagcgaaacgctgtgctcgtcggcccaagccaccgcggctggtggaagacgctgcgctggctcggcgtgtcactcggcgcttggtggaggaccaggagtcgccgatgacgatcgctcgagccaaggacgtaagtcatgagacgatctaccaggcgagctacccaggagaccgcgggctcgatccagggctgtggcgtcatctgcaccaccagcgccgccctcgctggcggtgaggcttccctggggagcaaagacgcttcgtgctgggccagttccagccgatccaccagcgcccagcggccgccgctcgccgcacgcagatcgggcatctcgaaggtgacctgatcatcggcgcgaaaaacgcctcgccggtcgtcacgatcatcgaccgcaccacacgcttctgcctgcttggggcattgcccgacggctacgacgcagcatctttggcgtcgtgtgtcatacggctgctgcgctcgatccctgaggcaggccagcgcaccctcacttgggatcagggccgagagatgacgctgtgagcggacatcgaacatgttctcggcacccccctctacttcgctgatccccacgccccctggcagcgtcccgtcaacgagaacttcaacggcctcgtgcgccgctggctggcgaagagcaccgacctgtccatctactcccaagccgacgtcgacgccatcgcccgccgcatcaaccacatgccacgccgctccctcaactagggccacgcccatcgccactactacgatgccctcgtcgcgatgaccgattgaaccggccctgcgttggagcgaacgcttcactctcggataaatagatcatcaaccgaactcgctactttgtactgtgccgggttctcgcgatccttgagcgcctcgaaatgcgccttgccgcagtcaatcttcgccttttccttgccacgcaagtcgtcggcgaccacactgcccttggtctcaacgacaaagtaaaagtagaggcgctcctcgccttcctgctcgacgaccaccgcccagtcagggttgtatccgcccagcggcgtcggcacggtgaaccagcccgggagttttgcgtagaccttgatatcacggttgtactcgagctgctgggcaaacgttagctcggtgtcggagtcgtagaccacctgctcatagaccgacttcttggcctcgaagagattcttcaggtagccggtcagctcctcactttcgaacagctcccgcgcgtagtagtgctcgtcacccaggcgctggtatttgatgccatcaaccatcgccttccgcttgcagcggttaatagtctctgccgccagctcgatgaaccgctggggattgcgcttgaagtcggccagacgcctactttccgtcaggacgcggtaaatcgtgcggcgcgtgagttgggtccggtcttgaagctcggtaagcaggtccggcagatcgatgtccgtttcctcgagccctacgggcgccccacgctcgcgctcggcggctaccacgccggccttgccgatggcgatatccgcctttcgccactggaggctcaccttcgggatcgccggcatttctttgagcgctttgatgcacgcctccacgagcgcttcgttgtcgaatttcacccggtatgtggttttgtccttgatgcggtcccacagcgccttgaactcatcactgatatggacctccccgcgaacacgcacctgccgacgctcgtcggcgttcttgatctcaagccgcccggccgccttcttgaggacatccgtgatttggtcacgctgcgcggcgaactcctcgggcacttccacggtgccgtccctgagtgcccttctgagtgaatcctgcacccgtcctttggcgtcgatgtagccataggccttgaaggactcccacaacgccttcgaccgttcgatgccgagcggcgaggctttgccattcgcatcggtgaccacgatgtgagcgaactggtccgcctcgacaatgccgaaccggatgccggtatcctcctcgatttccttctgcaagttctcggcgaagtcctcgtagctctccgtagcgatcacggtcagtgtattgacatcgaagccccgcacacgctcgccgtactgattcacgcacaaacgcaagccgcgcccgatggtttgccgccgttcgcgctccgtacggatgtctcgcagggtgcagatttgaaagacgttggggttgtcccagccttcgcgcagcgccgagtgcgagaaaataaacttgatcggcgtctcgagggagaggagcttttccttgtccttcatgatgaggttgtaggcccgctcggcgttgtcgcggcccgcctcgttgttctcggcagtatccgtccagccgcctttcttgtcgatggaaaagtagccgttgtgaaccttctcggcttcgcggctcacatccacccctttgaagagcggttcatactctggcaggttggcagctcgtcggtactcttcctcgaagatgcgggcgtaatcacctttcacggggttcccggccgcgtcatactggcgatacttggcgacttcgtcgataaaaaagagcgacagcaccttgatgccctttggtagcaggcgcatctccttgtccaggtgctcgcgaatggttcggcgaatcagctggcgctgaacggccagcatgtccacgtctccccaggcctgccccggcttgaggaagtgctcgccgccggggacgcgcagctccatgtactcatttcccttttcgacccggatttcgccgatacggtagccggcgtagatcgcgcggccggcgatctcttccaggtcgtcgccgtcctgaaccttcacctcccgccgcttgaccccaccgctgtcggtcttcacgtccagctcgaccttcgctgaaatgatgccgcgcttgttcgacaccgaaaccaggcgcacgtagggcttgttgtgggcatgttcgaccgtggccgaggccacctcgatctgcttgaccagccgcttctcgtaggcgtccacagcgtccagccggtagaccatgtggtgcttatccacgtgggtggccgagtaacgcagggtgcaaagcggattcatggcgtcgagcgcttccttgccgcgcccctgaaggccgccgtccacgctctgaggctcatcgacgatcacaatgggccgggtggccttgatcaggtcgatgggcttttcaccgcctgtcttctcgctttccttgtagaggttgttgacgtctttcttgttgatggccccgacggtcatcaccatgatctggatgttcgcgctggtggcgaagttgcgcacctgcccgagtttggaggagtcgtagaggaaatagtcgaaaggcacgccggagtacaggctcttgaaatggtcttcggtgatctgaagcgtcttgtacacaccctccttgatggcaatcgacggcaccacgatgacgaacttggtaaagccgtagcgtttgttcagctcgaaaatggtgcgcagatacacataggtcttgccggtgccggtctccatctccacagtgaagtcacctgatgcgagtgattccgagggcggcaggccgttgcggagttggatgtcgttcaggttcttgagcagctcgtcgtcgagcaacatcagacggttgccgatgccaagctcgttctgcgcaacgccgaggcgcatctgggtgtccgcgggatcgcgcgtgaccgtgaactcggtgcggcagatctcctgcccgcggaacagatcgcacacagcctctatggcctgccactggtagtcgaggttcggttcaaagtgcagtttcatcacaagctccgcacgttagcgatgccgttctggttgaggatggcggcgaggttcgtcttggcctcgtcgtcggcaaaggcgctgtcccggaagacgcaggtggtctcgcccgccggggcgagttccttgcgccacccgacgatgccctggccaagcgcctccacgtcgtcgaccgcaatctcctcggacaggcaagcgatcagcacgccatagcctacggcataaaccgtgtatttcttcccttctgtcccctgactcttgacttctttctcctgtatcggcacgcacagatcgaggccaagcttgagcagcagttcgtaaaggatgtccgcctcgctgcggccttcgacaatgtgatcctggtgcgcaaacagctccgcctcaaggtcatcaggcttggggttccaggcgcggatgttggatgtgtccagcttgaacacgcgaaaaccgaggtcgcccgcaaactgcgggttctcatcctggatcttcctggcggcacggcggagacgttccttggtcagctcagcgatgttgcgcggctttccgagcttgtcgcagaagtctgcggcgaccttctgttccttgttctctgggtcgacaggctccgggagttggacaaggatatagcgacggttgccgccgtcggcggcgttctgtgccatgaccgcatggccggtggttccggagccggcgaagaaatccaggacaagttctttctccttcaccccagctgctgatgccaagtactcgattaacccccgcggctttggattgttgaagaccgttgcctcgaaaagttgctgaagctcttcagaccccttttcgttgtagcacgtattatcgtcaagaaggtcgttcagtaactttgcttgatctagctcctcagggagcattgttcgacggagccctaagttgcgcgttacaaagagcgtcctatcaagggtttcttgattgattctccacggacccctgatgcgcacatccctcgcgactctcccatccgtaaccttaaggtcgtcaagcaattcaaacgagaggctgcgggccgcgtaggtgcccgcattgtacgttccatcgccacacttggcaatagcaccggaacgtagcactcgcacgcttactgtgttgccttcgttgaacacggggcgtgtcccatcggatacttgacccgcactaagtggggcggcggcatctgagcgaacgtatgcgacaacgtaatcgcacatgtcggtcattcgcttcctcaggaaagcggtcttccttgccgcgcgacgcttgataacgccgcagaagttttccgcaccgaacacttcgtcacacagagtgcggaggtgtccgatttccccatcgtcaatgctgataaagagcactccatcttcccgcaataggttcctcgccagcttcagcctcggatacatcatgttcaaccagtcggtatgaaaccgcccgctggcttcggtgttgctgctgatcttccgcccgccctccacctgccccgtcagctcgaggtagttcttgatgctgtcctggaagttgtccggatacacgaagtccttccccgtgttgtacggcgggtcgatgtagatgagcttcaccttgcccgcgtagctcttttgcaggagcttgagcacttcgaggttgtcgccttcaatcacgaggttctgcgtggtgtcccagtccacgctgtcttcgggcgccgggcgcagcgtcccggtcgagggcgtgagcgcgagctgtcgagcctggcgtttgccgtgccagttgaggccgtacttttcatcgcagtcggtgacggtggcatcacccacgagctgcttgagcacgtcaacgttgaccgccgcgccgttgggtccctcggtgatgagctcagggaacaacgccttgagcttggcgacgttctccgccaccaggtcgtcggaacgggcttcggggtcggcgggcgtcagtttcttcattgtctcctcctttatagtctttcgcgagcggccgcgcgggccgcttcggcgcgcttgagttccaggttcagttccacccgccgggacatctgtttctccctggcggcagcagtgcccaggcgggcgatctcggcgtccagtcgggcgcattcgcgcaacgcctcctgccgcgcggcggcgtgatcggcatcagaggcaaggacgaagacgcccgtcacgcgggccgccttgagcgcgagcagggtatccatccagccctgatagagggcgtaaagggcggttctcggttgccgccccagcgccaacgcggcggaaaaggcgggccagggcccggcgtcgcgctcgggactcagttccgcgacaaccaactcgccgtcgagcaccgtcttgcccgcctcgttctgcgcccaacgcttgtgggcggcggaaaggtcggcctgcgcgccgagttcggtgatcagcagcaacggatagggcacggcccgatgcaccagctccaccaggcgctgcaccttggccccggcgcgcagggtcaagcgaagcacggcgatttccaggtactcgcgtatggcgtcccgatattcggccacgccgatggtcgcgggcttgagcgccgcaacccagaccaactcctcgatgctctcgttgatctgccgcttgtcggcgcccgtgggcgcgccgttttcaaggagcagcgtcttgggcacgcgccggtccacgcggcaactcgcgggaaggtcgagggcggccaggatcgcgtcagcgttcattcgcccgcctcgggcaagatcacaagataggccgccacctcgaagtcgttgatgccggcaaattcgcctttgagcgcgtgcgtcccgcccggagaaaaaaggctggcgacggcccgctcctcgttcttgcgcaccaccgaggcgacggcggcggccagcagccgttgcgcggagcgcatgtcttcgccttgcttggtggcccggtcgaaacgggcgcaggctccgacatcgggcagatcgcgcccggcgcagaggcgcttcagccgatcgaggatttgcttggcctgggtgtggggaagcagtacggtgccgtcctcgcccacgtgaacgaggtagtgcggagccagtggatagcccgcctcgaccgttcgcttcgccgcctcaccctcagcccgcaggcagaagatgatgccgggcggtatctcggcctcggtcgtcgtcgtgaccgcgtaggtgccgagcggcaggttctccagcacgccggggtgcgccttgcggaactccgcgaggtcgatgcgaaagtcggtcagcgtgagatcggcgatcgagacaccggtcgagaggtcctccaggtcgatgaccgcatcctggagcttgaggagctgcttgcggcggtactctaggtcgttcatctggttgccggactgctgctcgatgaggttttcctcgccggtcgccgagatgtcgaggagcaccatgcggccgctcacgcgctgctccaggttgatgtactcctctagctccatgttgggccagaagttgacgagctgaatgcgctcgttgggcgagccgatgcggtcgatccggccgaaccgctggataatgcgcaccgggttccagtggatgtcgtagttgatgagccagtcacagtcctggaggttctggccctcggagatacagtcggtggcgatcaggaggtcgagttcgccttcgtcggccaagtcttccggccgttccttggagcgcggcgaaaaggccgtgaggatggaggcgagatccttgcggagcttgggcagggtggtctggttgtagccggtgccggtgaccagggcggtgtcgatgtcgagccgctttttggcccacggggcgagctggtcgtagaggtagcgggccgtgtccgcgaaggccgtaaagacgatcaacttccggttgccggggttgatggggttttcggccttctgctcgatcattttccgaagcgcggcgagcttggcgtcacgcgaagcgtccacctgcccagcggcggtatggagtttgactagccggttgcggtcttcgatcaggtcctgcttccaacggataagatccaggtccttgaggaggaccttgaccttgcggccgaccaggagactctcgaaggcggggtcgtcgacatccaggtcttcgatgtcaatttcctccatctcctcggcgtggttctcgatccgttccagcgtcgcctccacgtctcggagctgccgctcgacggtcagggcgaacgacggcacggcgctttccatgcgcttaagtacgttcacgcgcaagagatggatcaggctctcttcgcggtccacctgccggaagaagcccgtgccacccttgacctcggtgctgtacttcttgtcgtaggcttcctgcttgtgcggaagcacgtaccgcaacggcgcgtaggcggacagattcaggcggcggatttcgaggttgatgtcgcggatgggcgggaacttgcccgccaggtccacgtcggccttgatgttgatcggcttcaagcggtccgggaatcgtcccgtctcggcgatgccgtagtatttttcgatgtgcttgcgcgaccgggcgatggtcagcaggtccaggagcgtgaagtagtcgaaacccagcatctcgatcaaccgcgacggcgtgcgctcggactcgtccaggttgagccagcggttgaactgttgctgcgccaggcgggtggtgctgtcgatgcttccgacaccgtggtcgcgcagggccgtgtcgtcgccctcggtggcaaaggcaatctggttgcgcaggtcggccatgcggttgttgaccggagtggcggaaagcatgaggacgcgggtcttcacgccctctttgatgatcttgcgcatgagtcggtcgtagcgcgtctcaccgcccttctgcggtgtgcgcttgttgcggaagttgtgcgactcgtcgatcacaacgaggtcgtagtttccccagttcacgtccgcgagatcgatatcgccggagagtccgctatcgcgcgacagatccgtgtggttcagaacgtcgtagttgaagcggtccggggccaggaagttgcggcggtcgttggccttgtagagcgtccagttgtcgcgcaggcgcttggggcagagcacgagcacgcgatcgttgcgcagctcgtggtacttgatgatcgctagtgcctcaaaggtcttcccaaggccgacactgtcggcgatgatgcagccgccgaaacggttgagcttgtcgatggctccgatcacgccgtcacgctgaaacttgaaaagcttcttccagaccaccgtgttgcggataccagtcgcggtcttgaccacgcgctcctcgtcgagttcttctcctcggtcccggaagatgtggtgcaggatcaaagcatagacgagaagcgggtcccggttcccggccagttctttcaagctgtcgatcaatgcggtcttcgaggcagggtcggccgcaagggcggaccactgtgcatcgaaccactcgcttagtaacgtggcctcttcgagtgtctcggatgcctggatcaggttcatcggattgcccggcgtcaggccgaggccgtccgtgctgaacgccagcgaaccgaggagcgcctgtacggggcggccgtttgagttgcggatgacgaacgcgccttgcgggatggggctcaacgcgcggcggacttccgccttgttctcgatccactggagcaagcgcttcgccagccagcgggattgcaggcggttgcgagcgggacggtcggcagccgtacccagcatcgcaagatcggaaccgttcggcggcaacaccaggcggcagccttccagttcccgcgcctcgcgattgacctccgcgaatgcgaagagcgacaaggcgggcgtgagcacgtcgagccgatgactgcgcccgatccccagacggatcagatcgatcacgcggtccgtgccggtgttgcggatgaacttcatgccgctcttacccctcgtccacaatagagtaactggctctaccggtggttgcgacactccgaccatgatggtcggtggacaggtagcaaccaccggtgggggttttagcatgccaggtcgacgcctcgggttggaagagtgggaggagatccgggtcgggttggtgcgaggcgagtcgctgcgggtgatcgcccggcggctcgggcggccggtgtcgacgatcgctcgcgcagtggaccgcaacggcggttggatacgctatgtggcggcttgtgcgcagcgtcgagcgaaacgctgtgctcgtcggcccaagccaccgcggctggtggaagacgctgcgctggctcggcgtgtcactcggcgcttggtggaggaccaggagtcgccgatgacgatcgctcgagccaaggacgtaagtcatgagacgatctaccaggcgagctacccaggagaccgcgggctcgatccagggctgtggcgtcatctgcaccaccagcgccgccgtcgctggcggtgaggcttccctggggagcaaagacgcttcgtgctgggccagttccagccgatccaccagcgcccagcggccgccgctcgccgcacgcagatcgggcatctcgaaggtgacctgatcatcggcgcgaaaaacgcctcggcggtcgtcacgatcatcgaccgcaccacacgcttctgcctgcttggggcattgcccgacggctacgacgcagcatctttggcgtcgtgtgtcatacggctgctgcgctcgatccctgaggcaggccagcgcaccctcacttgggatcagggccgagagatgacgttgtgagcggacatcgaacatgttctcggcacccccctctacttcgctgatccccacgccccctggcagcgtcccgtcaacgagaacttcaacggcctcgtgcgccgctggctggcgaagagcaccgacctgtccatctactcccaagccgacgtcgacgccatcgcccgccgcatcaaccacatgccacgccgctccctcaagtagggccacgcccatcgccactactacgatgccctcgtcgcaatgaccgatcgaaccggccgcctcacgcgcgttccccagcaccgcgcgcagcgctaccagcgccccctccaggcggtaaaccgtcgcagccggcgccaccagctcgccggccctgaccctcttgagcaagactgcaacctcatcggccagcttctcgacttcagccttcgtcacatcgccaccttcagggtcacttcactccaccgcggtcgtcgagtgccaacccacccccaccccagctgctacccatcagtagtcaacccaccccaccccagctgctacccatacgtagcaacacggctgaggggcgcaaaagttaccaacgagtaactatcagggtaactatcagggacgcgcttggtgcccgagatcgtgggtcgcgcgcacgggcctcgtcacggctccccggcgagggcgtggtacgcagcctggataataggagccgccccttggcccgctaccgccgccagcgggtcaggctgggcctcgcagtacggcctcggcctcatcgagcacctcgtcctcgctggcccactcgtcggggtcgaggtcccacggcgcgggctgcgggaacggctcgctcgggtcgggcggcggggccaggtcgagcacccggtcgggtacgtccggtggtccgtcgtcccacggctcggggggctccaactcgactggctcgccgccaagaggatcatccgcacttgatcctcttagagttgatcctcttagagttgatcctcttagagttgatcctcttagagttgatcctcttagagttgatcctcttagagttgcgtcagtcgcgggctcggggtcgccgccctcgccgtgaaggaccgacaaaacggggcgatcccgggcctcatcgaggccccaccaccactcgcccgcccggcggatcgagcgaacccggagggcgctcttggctcgctttaaggtgaccagcgagtaccccgcgtgcgcggccaggttggccacctcctgcgctcgcatcggcccctcggccagctggtctcggagccacatctcagccgaccgcagccggccgcccccgtgttcgccaccggccttcggcagaaggtcgaccgggtcaacgtcgaccggccctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtaaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgggacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatgtcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagttcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagcccgctgctggtgtataggacgcgcttcccgtctgcggcaagacctccacccaggtgcggccaggatcgagcggaatgatcgatccgttcgaactccgcagcaccgtgggactcgcgagcgacgcccgcgaccacgttcctcggatcagctcgccgttgcgaaggacccagacgttgccgctcccgatgacctcggagtgaaccccgagcgagttcggaccgctctcgttgtagggccccggcaccgattgcacgaactgcaccacgacgttcgtcgcgctctgcacggcacccgacgcgccgtaggcaggtacgcctgcgtaggagcgatcgaagagcccagtcgcagcgttccacgtccactcgacaggctcgaccgccgagaacgtcaccgcgaccgacgacaccggaatgccaccgtgcggcacggtggacgagaaggtaaagatcggcgagggcgcggtcgtcggacccacgagcgaccagatccccgccgggttgccgtagaggttctcgggaggcacgcgcgtcgtggtgcgctcgaacggtgtcccgctgtagtccaaggcgtcgacgcgatgcagccaggtctgagccgccagttcctgccggtcggggatgatccctcccgcgtagacgaggatcggatggccgaactgcccgaggacgtgccagtcgacccagcgcagcgaccgaatcggacccacttcggcaggcgagccgcactggaagatggcgatgaatcgcgtgatcccaccctcggcctggacctcgtagaccatgtcggcttcgttgagaccgctctgaggacgagcgcccggatcgttgccgaccttgatcgccagtgccgcacgatcaggaacgacgccgccaggtgccgcacgaccggtcagcgggcatgtggctgacgcaggtgcggccgacgacgacaccggcgtctggctcgtgctcgtcgagtcggcgtgcgaggagggtgttcgggagtgatcgagggcgagcgccgcgcctgcgccaacgaccaccaccacgacggcggccccgagcaccacgcctcggcgtcgacggacacgcttcgaggtgcggtgcgccatcactcctcctcaaacgttgaacgcagcgagcttagggccctcatcgcccgaccccatcgtctccgagagcgtggggctcgcgtcccgaacgcgccgaggacgccggcgcatcggcgaggtcacggtagcgaacccagccgaccctgaggcgaccagcaacgacgacaccgagcgcatccggctcgacgagccccacgcggccgaagcgcgcccgcgccagtgcgagcgagctatcggcgtcgatgctcaccactggggccgcgggcggcgcgccgcgccggacgcgctcgagcaggccacccgccatcgtggcaccgagaccacgatgagccaggaagccctgccatgcatcgcagccaaggtcgcgagcccatcgaagctgatcgggccgctccacgcccaccgcgaccacgatcgcgccgagctcgtgggcggccgtcgtggtcacctcggcgatcaagcgcgcgcgctcgcgcgtcgaggcggcgacgatgctccggtcgaccttgaccacgtcgggctcgagtatcgcgaggcgctcgagaccggcgaaccccgcccccgcgtgatccagcgcgaccagcaagccagcgtgccggagcggttcgagcgcgcgcgctaccacctcgggcgatggaccgcccgcgagctcggagacctcgacgacgaggcgcgacgctcggggctccaagatgcgcagcacggcatcgaggaccaccaccgacggcgacaggttcacgctcagccgcacgcccgactcgaactccggggcgtcgagaagttcgagcacgcgagccagtgcgacgagctcgagatgcaggtcgagccccaatgcggtcgccgagctgaagagctcgtccgcctcacactcgtcgtctcgaaccaacccttcccacgcgatcggtcggttggtctcgatgccgcggatcgcctcgagacgaggggcgagccgttcagggcaccccaagacccgctcgatggcgccccgggacacgctcatcgccgatccgaacccgtgtcgtgatcgtcgaggacgacaccgaggacgtggcgccactcgtcgacgacgagcaccgcctcgaccccaccatcgagtgcgcgacgcacgccatcccagccctcgacgagatcgacctcggccgcgcgaagcggtgctcgatcctgatcggcgacccacacggctcgacccaagccgtcgacgcccactcgcagatcagtgccgagcaacgggctgcgcgcaggaacgatgcgcgcgacggccagtcgttgagcgagttcggcgccaaagagcacccgacgatccgaccgaacgactcccgcgatgcactccgggtcgacccgagggaagccctctgctggacgagccagccaatagccctgcgcggcatcgattcccaaccggacgcacgcgtcgagggtgaggcgatcctcgactccttctgcaatcacgcgggctccgagacgatgcgccgtctcgacgagcgtggtcacgacgccagctcgaccggcgtggtgagcgaggcccttgacgagtcgggcgtcgagcttgacgatgtcgggacgcacgcccatcagcagatcgagaccgccaaagcccgatcccgcgtcatccactgcgaccaacgctcccgcacatcgcaggtcagcgagtgatcgctcgagcacggcgacgtctcgcgccggcacgtgttccgtgagctcgatcacaacccgatcaagacgggcgtgcaggagcacgtcgcgcacgcagggcgcatcgatgacgctcggggcgacgttgacgtgcaggcgccagcctcgcgcaaggcgcctcgttgcagccagcgcacgctccagcacgcgagcctcgagatcggcgccgatcccgagcagctgaccatggaggaacactgcttgcgtggctcgtacaccctcgaaccgtgcgagcgcctcgtagccgacgacactgcccccgtcgagcccgacgattggctggtggaccatcgtcaagccgcgaccactccgcacgacctgcgctgcgcaggtcgtggcccgaagttcgtcgctcatcggatccacgctgatcggatccagctcggcaggatccgtcaccaccgcaatcccttcgctctccacgctcgttgacctcggcgcgttccggtcgcgacttgacgcactacgtccgatgatcgcggctcgatgcctgagccctgtcattgcgaacggtcgccggttccatgacgtggctcgagcctgcatggagagagcgaacctcggcgtgatcgacgatgcgcactctcgccagaggtgggcccgtgcgcaccacccgatgatcgacgggtgggcacaaccgcagctcggccgccggatccctgggtccaacagacgtcggtgcgcagccagcccgccacctcgccaagacccaagggttgtcgtcgccgcatcgcagttcatcgcgttcgccgcggccaacccgccaggtaacaacgacacgtcgtgaccaacgtcacctcccccagggaccattggctcctgcacgccacacgcgcccggcgtagcttcagaggtgtcgagagtctcgggcgaagggaggcacgatgaacgagacgaccatggagtcggcgggcgagaccagcgcaacgaccggcggcaagctcgccatcatcgcctacagcggcaccgcggacaagctcattccgctgggagtgctcgcgcaagcggccgcggcgatgggctttgccgtggagatcttcgtgacgggcttctcgctccttgccttcacgaaggaacgtcacgagctgccctttgccgcggagtacgcagcgatggctccccagctcgccgaaagcctctcggccaacaagatcgccccgtgggacgagatgctgcgccaggccaaggagctcggagctcgggtgcacgcatgctcgatgatgtcgacggtgatggggctcggtccggacgacttcggcgatctcgtcgatgacgtcgtcggagccgcaaccttcgttgctgcagctgaaggcgcagagacattcttcatctgagcccgttgcgaggcgaccatggcatccaaggagaccacatcgaggaggtgcacagcatgaccgaacagccatcggagcagacgacacgaacgatcgtcgattcgcggggatctgcttgccccggaccgatcacggacctcgcactcgcctaccgcaaagccaaggtcggcgacgagatcgagctgctcgcaacggatcccggcgtcaaggctgacgtgaccgcttgggcggccaagacacataacgaggttctcgctatcgaagagggggtcgatggtgtgatcacgacccggatcaagatcgtgagccggtgagatgacacgccgcgtgctgatcgtcggtggaggcgacgggggcacgatcctcgcaaactcgctcgatccccgccgcttcgacgtgaccgtgctgaccgcctcacttgaacatgtcttccagcgcggttacctcggcgtcgccttccaggggcggcgtcgcaacctcgtgcgcgacgagcacagcttgctgcgctcgcacatcacactgatccacgacaccgcagtgcgcatcgacctggttgaccacgaggtcgagaccgcgaccggcaggcgtctcggttacgacgacctcgtcatcgcgaccggtgtgcgcaccgatccgtcccagatccccggtctctgggagatcaatgagcgcatcggcgacttccactcgacgaccgcgaatgcgcgtcgcttgtggcgcaacctcaacgccttctccggaggcaccgtggcactcggacaagcgagcccgatcatcaagtgtccaccctcgcccgtggagggaatcctcggcgtcgacgcacgactacgggctcggagggtacgggaggcggcgaagctcgtgctgttcaccccgtacccacgcgcgtaccccgcagagcccatcaacgaggtgatcacgccgattctcgaggagcgaggtatcgaggtcatgccgttcttcgacgtggatcggatcgatcccgcgaccgggaccatcacttcgctcgagggcgacgaagtcaaggcagacctgcccatcgtcgtacccccgttcgttggagcgccgatcgtctacgagcccgcggacgtcgtcgacgacaatggactcgtgaagacgaacaaggagacgctcgccgtcgagggggtcgagcatgcgtggtgcatcggtgatgccaacaacgtgccgacgtccaaggcgggcgtgggcgcgcacctcgaggcgaaggtggtcgcgcggacactggcaggtcacccgacgcgcttcgatgggcgcaccaactgctccctcgagatcgtaggagatcggcgcttgaccttcgtcattggatctttcgacgctccggtcgagaagctccggccgacacgagtcaagtacctcgaggagtggttgctcggcgagacgttcttctggggccttcggggctggctggacccggtcttcgacgcctacttccgactgaccgagccaaaacctcggcgagtcgccgcctgagagccccgaggtctcgtcactcaccttctctcgtcaagggttactcctcggtctcgtcgtcgagccccttgacaggcccggctcgtgcattggcctgggacacacccgtcgaggaacgattggagaccacgatggtgcacgacctcggcatcgagacgagcaacgcctccgcggtcaccgaggatcgtgtgcgatcgatgtcgccccgacgcgcgagcggacaacaccacgaccatgcgtcgtcgcaggccacgggacccgggttcgtcgctgctcgggcgagaggccgatggcgcacggcacctgctcgagaggacttcagccaactgccacaccagtccacgatcgtcgtggcgacgaggggcagaggcgcatgacgctcaggacccagtcatcggccatgcgtcatctcatgccatcggtcgtgtcgggagcgccctgacaccggaaacttcagtcaggggccttccgtctcgaggaggccggtccacgaggaacccccgtcaaggaactccgccaaggcagccgtgcgcacggaggaccggatgcctcgaccgcgagccgctgggcgctcgcgcactcctcgaccgtgcgcagcatgcaatcccaactccacaggagacgaacccagcgggtgctcaacctggtgtgcactcgagcgcgatcgaagccccgtccgcgggtcgtacgccctcaccttgcgcgagctcagacagacgcttccacccggaggtcaccgcgccgagagcgactagggtgctccgcaccaggggcgcttagctcagtcggttagagcgcagccttcacacggctgaggtcggaggttcgagtcctctagcgcccaccggaaccgcgacgccgtggacccgacgcgatagacccgacgcgatggacagcgccaaggggctcggaccgcgctcgtccttcgcaaccacgacacggagcgcaacatcgaggcccgtctcgcccgcgcatcgcgacgcacggcctgacacgaccgcgtccctttggagcgagtgatcgagtccgcaacggaggcggtcgacaggcctgaccagacgaacacgtcgccactcgccgaccccactatcagctcgatcgatgcccagtgatcgatgcccagttcgggcgggggccatgttgactggcgctcggccacgcggaccgcactaccccgacggtggctcttggctgcagcacccgacgcgcacgcatcagcgtcgtgccctgtcacctcgaccaccaccactcgcacccgctcgcgtcgccgacgcacgaaggatgcgaggaactaccagtctcgtcaggactcacccgtcccggttcggccggaccaccacagtcgtcccgaccgcgtcggccaccaccgaagcgaggactgacgcgccagagcgctcgacgtcacgcgtcgcggtcaacacgaccagctcgtcatcgaccgcccaccggacgaggtcggcgaactgcgtgcccgtcatctgatgctcgagttcggccagatagcgacggcgaaactcgggccagcgctccggctcgtgaccgtaccaccgccgcagctcgtcggtgggagcgagctcgcggcaccagcaggcgaacggagcatccgcacgccggagcccacggggccagaggcggtcgacgagcacccaatggccaggcggccatgggcgctcgtagacacgccagagcacgactcccacgagagacccccgcgagcgggtctagccgtggtgatgacgctggcggatcatgttgagtgcgctccctgcgcggaaccaggcgatctggtcctccgagaacgtgtgacgcagttcgagatcgaagctggtgccgtctggtcgatggaccactgcgcgaatgggttggtcaggcgcgagctcatcgagaccgacgaggtccactcggtcatcacgctcgatgcgctcgtagtcggcaggatcggtgaacgtcagcgggagcatcccttgcttcttcagattggtctcgtggatcctcgcgaacgaacgcgcgatgatcgcacgggcgccgaggtagcgaggctccatcgccgcgtgctccctcgacgaaccctcgccgtagttctcgtctccgatcatgacccatccctggccggcgtctcggtagtggcgtgcgatctcgggcaacggctcgtcagcctggtggatctggcaccaaccatggccgggctccgcggcgaaggcgttctggaccccgaggaacaggttgcgtgagatgttgtcgaggtgaccgcggtagcggagccagggaccggccgccgaaatgtggtcggtggtgcacttgccgaccgccttggccaacacgacgagcccgacgagatcaccaccctcgaagggctcgaacggagtcagcacctggagacgctccgacgccggatcgatgcggacctcgatcgcagaaccgtcggcgggcggtgcgacgaagccgcgaacttcgcgcgcgaggccagcactcgggagttcgagcccctccggctccgggagccgctccccggcgagctcgtcggtgagggggttgaagtcgagggtacccgcgagcgcgtaggcaacgacgacctcgggcgaggcgatgaacgccaacgtcgccgcgttgccgtcgttacgacgcggaaagttgcggttgtaggacgtgatgatggagttggtcgtcccaggctcgatatccgtgcgatgccactgcccgatgcacggaccgcaggcgttcgcgagcacggtcgccccgatcgcctcgaggtcacgcaacaatccgtcacgctcgatggtcgcacggatgcgctcggagcccggggtcacgaggagcggcgtgcgcacccgtagacctctggcgctcgcccaacgagcgacgctcgccgcacgtgcgatgtcctcataggaggagttggtgcacgaaccgacgagggcgctcgagagctcgagcggccacccatgctcgcgcgcctctcgaccgatcgacccgaccccacgtccgagatccggagtcgcaggcccgacgatctggggctcgagcgtgtcgagatcgatctcgatcacctggtcgaagtagcgagccggatcctcctcgacctcggggtcggcctcgagcgacccgaggcgggcttcgacgagcgcagcgatctcgtcgcgacccgtggcccgaaggtaggcaaccgcatggtcgtcggcagggaacaacgagcacgtcgcgccgatctcggctcccatgttgcagatcgtcgctttgccggtcgtcgagagcgcacgggcgcctgggccgaagtactcgaccaccgcgcccgtaccgcccttcacggtgaggatctcggccacccggagaatcacgtccttcgcgctcgtccagccgttcgggcgtccggtgagccgcaccccgatgagacgcggcatgcgaaccgtgaacgggtcgccgaccatcacgtcaacggcgtcggcccctccgacgccgatcgcgaccatgccgagacctccggcgttcggggtgtgcgagtcggtcccgatgatcatgccgcccggaaacgcgtactgctcgagcacgacctgatggatgatgccggcaccaggctcccagaagccgatgccgtagcgagccgacaccgacgacaggaagtcgtagacctcacggttcgtgacgcgagcggccgcgaggtcgtcatcggcgccgcgctccgcctggatgagatggtcgcagtggaccgtcgtcggcacccgaacctcggggaggtcggcaaccatgaactgcagcagcgccatctgcgcggtcgcgtcctgcatggccacccgatccgggtcgagctcgatccagctcacaccgcgctcgagttcggcgcgctcagggtggcgtaggtgcgcgtagagcaccttctcggcgaaggtgagcggtcggcccaaccgctctcgcaggaccgacgcaacctcctcgtagcgtgcgagcgccttggcgacgagcgccgccggcgttgtatcgcgaacctctgccatggtggtacctctctccctctcgaatcccccgaagaggaccgatcgttgtcacgcagcgctagcgtagacaagcataggacaagttcgcattccccgctacctcgccatcgcagagcgcctccgcgcttcgatcggcgatggccgcacgagcgaaggtgacctccttccttcggaggccgagctgtgcgcacgctacggcgcgtcacgcatcaccattcgccgtgccctcgagacgctccgagacgaggggctcgtcgagtctcgccagggccttggctggatcgtgacgagggtgcccgtcgcgcagtcgctcgggcgctttacgaccatcgaacagcagctccgagaactcggacgcacacccgaacggcggatcctgtcgtcgatcatcaagcccgcgaccgggccgatcgaagccgttctcgggggcggtgacgtccgcgaagtccgacgtttgaacctcgccgaccaggagcccttcgcgaccgtgaccgtgtggatccccgcgcacctcgcagagcgcttcacggtcaccgaactcgaacgttcgtcgttctacgagctcctgtccgcgagcggccagctgctcagaccgctcgcctgggcgcaccaagtgatccgagcggccgctatcgacgagcacgacgctgcggtcctcaacgtgcccgcggaatccgtcggcttgaccgtggaacgcacgacctacgacaccgccgacgtcgccatcctccactcccggttcgtgttccccgcaagccgcgtgttcttcgaggtcgacctcgtcgatgaggtcagctccatcggtccgagcggcctccgcctcgtcacctgaaccgcttgacaggattcattcagagacctacgatgctgtatcgagctatgcagtagcacggctcgctgcacgtcgaggggggaccatgagctcggcaccgatgttcgaggcgcgttcgatcgagcagattcccgaccacgaacgccatggtcggccactgtcgctgctcacgctgtggttcgcctccaacttccagatcaacggcctggtcaccggcgcgatcgccatcgccgtcggcttgagcgtgccccaagcccttctcgccctcgtgatcggcaatctgctcggtggtctgttcatggcctaccactccgcccaaggccccaagctcggactcgcgcagatgatccagtctcgggcccagttcggcttcgtcggtgccatcgtgccctatgcggtcgtggtcatcatgtacctcggcttcgcggtcgcagggggcctcgtcgcgggaccggccatcgcgagtgcgctcggcaccacgagagatgtcggcatcgtcgtctacaacgtggtcgtcctcgcggtcgcggtgttcggctatcggctgatccacgcgatctcgcgagcgatctcgctcctctcgctcgtcgccttcgtggtgatcgcggtcgcggtgctcggtcgccttcacctccacgcggcgccgtcagcaggtgccggggccttcctcctggcggtctcgatcgccgcatcgtggcagatcacctgggccccgtacgtctccgactattcccgctacctgccggcgagcactcggacctcgacgacggtcgcgttcacctacgtcggctcggcgatcggtggcgcgctcatcatggcgatcggcgccctcgccgccgcgctcaacgcgaacgccgtgaacgccaacccgatcggctttctcgccggacaggtctcgccgatccacgaagcgctcgtcgccctcctcctgctcagcctcgtgccggcgagcgcggagagcccgtatggcgcattcctgaccgcgctcgcggccgtgacaccccggggactcgtctcctcgacacgcaccgcgcgcacgatcttcgtcgtggccttcacagtggtgagcctcgtcctcacgctcgccctcccagcgacgatcctcacggactttgagaacgtgatcttgttcctcctctatctcctcgtgccgtggacggccatcaacctgaccgactactacctcgttcggcgtgggcgctacgacgtcgccggcatcctcgacgcgaacggcccctatggccgcctgcaagctgggccgctcgccatctacgtcgtcacgatcctcgtcgagctccccttcgtgaactcggcgctctacgagggaccgatcgcccgagcgctcgacggcgccgacatctcgtggatcgtgggcctcgtcgtcgccacgatcgcctacctcgcctgggctcgcgcacgcggcctcctcgtcgccagggccccggggacggcgccggcgtgaccgcacgcgccgaccgtctcgccgcgctgcgcgacctcgtcgggacgaaccgcttgactccggttcagcgtcggatcgtccagaccatcgccgagcacctcgacgacgcggacacgttctcgagcgccgagcttgcggcgattgcgggggtctcgcaaccgtcggtcacgcgccttgcgtccgcactcggctttgcctcctatccagagctccgccaggcgctgcgcgctctcgtgcgcgacgactcccaacctgtcgagtcgacgccccgactcgacgcggtgcgcgacgagatcgccaacctgacctggatggagcgacagctcacctcagaaccccttctcgccgaggccggtcgtcgactggcgggctccgtaccgctcctcgtcatcggccttcgtgcctccgcgccactcgcggcgtacctgagcttctacgcccgcaaggtacaccctgccgtgatcacggtcgaccgcgccggctcagagggcatcgatgcgatcgccgaggcacacgcgcgtggcgccaacgcagcgctcgtcctcgcgctgcccaggtggccgagagaactcctcaccctcgtcgaggtcgctggcgacctcggcatcgacctcgtcaccatcgccgaccgcgcccacgggcccatccaggcgcgcgcacgcgtgtcgctcgtcgctccggtcggaacgagccttctctacgacacccacgcaagcgccttcgtgctcgcgcagctgctcgtgcaggcgatcgccgacgccgcgccgctcagcgcgaaggcatcgatggaggcattcgaagaacgtgcctcgcgctatcgctacttcctccgaggagaggcatgaccgcactgctcgtcgacctcttggagcgtgcacgcccgatcggtcggcacgccgacggtggctggacgcgtctcgggttcagccccgaggagaccgctctcggcgacctcgtcatcgccgaggcgagccggatcgggctcgacacctcccgcgaccgggctcagaacctctgggcatggctgggtgcgccgggccccgacgcactggtgctcggctcccacctcgactccgtcccccgtggcggcgaactcgacggtccgctcggcgtcttcactgcgatcgcagccctcgacgccctgctcgctcgcggctggcgcccacggcgcccgctcgccgtcgtcgcctttcgcgacgaggaaggcggtcgcttcggacgcgcctgtctcggctcgcgcctgctcgccggcgaacttgcgcccgccgatctcgcgaccctgcgcgatgggcacggacggagctttgccgaggtgctcagagacctcgagctcgagccggcgcgcgtcgggcccgatccccaacgcatcgcagcgatcggcacctacgtcgaactccacatcgaacagggtcgccagctcgcacccctcggcgcaccggtggggatcgccaccgggatctggccccacgcacgagcgctcgcgaccctgcccggtgaggcgaaccacgccggcacgacgcccctcgatgaccgtcgggatccggtggtcaccctggctcgcctcgtcctcgccacgcgagaccaggcagcactcaggggagcactcgccacgatcggccgcatcgacgtcgaccccaacgcccccaacgcggtagccggctccgccgcggcgtggctcgacgtacgggcaccccaggcgacgatcctcgatcagctcctcgacgatctcgcacgcctggtggtcgagctcggcgggacgttcgacctccgctcgatgacgccagcgaccatcttcgatacccagctcgccagcgagctctccgcgctcctcggtggtgccccacggatcgccaccggagcggggcacgacgcgggtatcctcgccgaccacggcgtacgagccgggatgctcttcgtgcgcaacccgaccggcgtgtcccacgcccccggggaacaggcaacacccgccgatcttgccgcagggcagcacgcactcgagcgagtcatcgaggcactcgcatgaggatcgcggccgacttcgcgctgctctcaccgaccgagctcgccaccgacgtggtcgtcgaggttcacggcgagcgcatcaccgcgatcgagcacggccgagcgggcgcgtgcgacagcgccgtcgagctcctcgtgcccgggttcgcgaacgtccacggtcacgcgttccaccgcgccctgcgcggtcgggccagcctcggcgctgacttctgggactggcgatcgagcatgctggccgtcgccgagatcctcgacccggatcgctaccgagacctcgcaaccctggtctaccgcgaactcctcctcggcggctacaccacggttggtgagtttcactaccttcaccacacacgagacggctccccctatcgagatccgaacgccatgggcgtcgccctcgtcgaggccgcccgggccgcggggtgccgctacaccctgatcgacgcggcctacctccaccaggctcccgaccacggcgagtgggcaccgaccgagggcgtccttcgtcgcttcgccgacgcaacggtcgatgcctacctcgcgcggaccgaagagctctccgagggcgcaacccatcgcgtgcaactcgccgggcattcgctgcgcacgtgcacgcccagcgagctcgtcaccattgcgcaggccgcacggcgtggctggcacctccacctcgccgagcaacacctggaggtggagatcgtcgaggcggcactcggcgcacgaccggtcgcgctcctcgagcacgccggcctcctcggccccgagctcgtggcggtgcacgcgaacgcggcgacggccgaggaactcggcacgctcgcacgccacgacgtggtcctctgcgcatgcccgagcaccgaggaggatctcggtgacggaccatcgcctgcggcgaacttccatgggctcggtggacgcctcgcgatcggctccgacgagcacgtactcgccgacgggctcgtcgaggcgtcgcgcctcgaggcccatgcccgactcgcgagccgccgacgtcgcggtctcgatgtcgccgcgctctggaccgcgctcaccgcccaccacgcccttggttggcccgaggcgggcaggatcgctcccggttggctggccgacctcgtcgccatcgacctccacgacgtctcgctcgctggggtcacgcccgaggcgatcatccagatcacgacgccggcacgggttgtgcgagtctgggttggcggcacggagatcgtgcacgacgccgccgtcgaacgtcgcgaactcgccccccgtctcgaccacctcatccgcaccatctggaaggagatcccatgagcacgcgtcacgacgagagccgaaccatccgtgcgccacgagggagcgagctctcctgccggagctggctcaccgaagccccgtaccgcatgatccagaacaacctcgatcgagaggtcgccgagcatccggaggacctcgtggtctacggcggaatcggccgagctgcccgcgactgggagagcttcgaccagatcctcgacaccctgcggaccctcggtgacgacgagacactcctcgtccaaagcggcaagccggtcgcggtcctgccgacgcatccggatgcacctcgcgtcctcatcgccaactccaacttggtcccgcactgggccacgtgggagcacttcgacgagctcgaccgtcgggggctcatgatgttcggtcagatgacggcggggtcgtggatctacatcggctcgcagggcatcgtccaggggacctacgagaccttcgccgcggtcgcgaagacgcacttcgacgacgacgtggctgggcgctgggtcctcaccgcgggtctcggaggcatgggcggtgcccagcccttggcggcgaccatggcagggttctccatcctcgccgtcgagtgcgacccgagtcgcatcgagctccgcctccagaccggctatctcgagcaccgcgcgctgtcgctcgacgatgccctcgcgatcctcgagcgggcccgtcgagacggacgaccgacctccgtcggcctgctcggcaacgccgccgaggtcctccccgatctcgtcgagcgcggcatcatccccgacgtcgtcaccgaccagacgagcgcccacgaccctctccggggttacctaccactcgactacagcctggaggagtggcgggcggcccgcgaacccgagcgccaggtcgcagacgccaaggcagccatggcccgtcacgtgcgcgccatcatcgccatgcgcgatcgtggtgcggtcgccttcgactacggcaacaacctccgccagggagcgctcgaggcgggcgtcgacgatgcgttctcgtatcccggcttcgttcctgcctacattcggccactgttctgccgtggctacggaccgttccgctgggttgcactctcgggcaaccccgaggacatctaccgcaccgacgaggtcgttgccgagctcgtcgacgatccgcacctgcaccactggctccagatggctcgcgagcgcatccacttccagggcctccctgcccgtatctgctggctcgggctcgcggatcgcgcccgagtcggactcgccttcaacgagctggttcgtcgaggagaggtaggcgccccgatcgtcatcggacgcgaccacctcgacacgggttctgtggcgagcccgtaccgcgagaccgaggcgatggccgatggctcggacgccgtcagcgactggcccttcctgaacgcgatggtcaacgtggcttccggagcgacctgggtctcgatccatcatggcggtggcgtaggcatgggcttctcgcagcacgccggccaggtcatcgtggccgacggcaccgatgctgccgcacgacggctcgcacgggtgctccacaacgatccggcgatcggcgtcgtgcgccacgcggacgcgggctatgcggacgccatcgacgaagcccgacggcgaggactgcagatcccgtggctcgcctaggggagggccccgtcgactggctgctcacgaacgccgtactcgccgacgtcgacggacacggcagccttcggatcgaggaaggctggctgcacgttcgaggcgagcgcatctgcgcgcgaggcaccggtcgacccccagccgacctcccacacgtggatgctggcggggcggtcgtcacgccggcgttcgtcgagtgccacagtcatctgctctttgcggggaaccgtctcggcgactggatgcgacgccagggactcgaacccgacgacccccgcctcggcaccggcggcatcgccgccaccgcgaaggccacgtcggcgctcgacgacgctcagctcgtcgcgacgacgctcgcacgccttgcacccctcgcgcgctccggcgtcggcacggtcgagatcaagaccggctatggcctgagcgcgcccgccgagcttcggctcgcacgcctcgccctcgaggtggccgagcgggcccgccacgacatcggactcgacgtcgtggtgacgttcctgggcctgcatgcactgccgacagcccctgcccacgagcgacgtcacatcgtcgacgacatgatcggtgccctcgacgaacttcccgctggcgtccgcaccgtcgatgctttcgtcgatccggctggggtgagtgccgaggaggcacgacccttcctggaagcagcgcgagcacgcgggttcgacctccgccttcacgtcgaccaattcgccgacgcgaacggtgcggccctcgcggcgtcactgggcgccctgagtgcggaccacctcgacgccacgggccccgagggcatcgcggccctcgcggctgctggcacggtgggcgtgctcacaccgatcgcgaccgtgctctcgggaacgcgactgcgccctccggtgatggccctgcgagacgccggggtcggcctcgcggtctccgccgacgccaatccgggcacctcgccatctgccgacctgcgcctcgcggcgctcctcgcggtcaccgagctcggccttcgacccgacgaagccttcgccggcatcacgctccacgcagcccgcgcgctcggcctcgcggaccgcggcaccctcgaagctggggcgcgcgccgacctcgtcgcctggcccgtttcccaccccttcgaactcgtcctgagccacctgccgctcgaaccatggcgcccgctgcctgactgagcgtgctccagctcggaaccggccccttcccacaacaagcccccacctgcccacgacccctgaatccatggagcgccacgcgcggcgacacgcctggccgctccgacccgcagcacaatgcgctcgcccatctcgagggcccgaaccgcaccatcacgctcgagctccgcgagcccgacgcccgatgggcatcgtgagctctcgagcgacgtcacgagccgttggccggccccacgcgtccggtgacggacgatcccgagtggacggccgatgttggcaaccacgtccgatcgaacgatccgtcaacgcgcaagggcctacgcggatgcgctgggccagatacgtcgcccagcgacctcgacctggaaggcgaccgacaccggcaactcatcgcgcacgagccgcacgaaatcggagtcatcgagccatcccgtggaggcgacctggatgcgaacgaacggagaggaggccggatcgtcctggtgtcggcgtacgccgccggtctcggtgaggatcacgggcccgccggtcaccgcctcgagaatggtcgtcagccctcgccgcgtcccgcgccaggccagcgcctccccgaggctacgaacggcccgccgctgcgtggcttccgggagcgaaccatcgagccaggacacgccgagccacgctcccaaccacgccagcatcggcaccggggtgacggtcgggtcgacgatgtgctcgatcgtgtcggcgtcctcgagcagtgtcgacgcgacctcctgaaagatcgacacgaatcgaacgaagaaatcatcgtccgtcatccccatcgggagttgctgcaggagccatccgtcacgtcgcatggtgagccctagcggacgacgacctggtgacggaacgagaggaacagcgacaacggatcgagcgccaagacctcccgtccgcgtccttgacgctcgccggtgcgcagatcagcctcgaacaggagcacctcctcgaccgcctcgatgccgtcgacggtctcgagtcgttcggccacaccggctgcggtcaaatctgcgtcgaacggccaaccgtcaccggcggggccaccgaccagcggatggacgtattgatagagcacatcgagggcacgctggcgcacgatggcactcgggcgcccggggatggcccgcacgagtgcagcgaccgtggcgccccgatagtacggggtggagacgtcgaccgtggtaccaatcagtcgtcgcggttcgaggtagccgatgacctgctcgacgagcgcgtccgagagttcgaagtcgtcgagctggtgatcctcgcagcgccctcggaccctcggcacgacgagcaagcgcaccggatcaccgacgaggttcggcgccacgcagcggacccgtgcgacctcgggcgaggcttcgagcgtgagccgctcgaaatccgatgcgctcacggcccgctgaccggagcgcaacgtcatcggcccgcgaagcttggcgttcgcgaccgattcgggatcgaccccgcccgaggcagggaatgggttcgtgactcgatcgatgtaggccaccgaactgcgcaagacggtgagcgtctcggcgccgacgttgccgacggaaccgcccccgtagcggtacgacgagagcatgatcgccgcaccgtcgggggggatcgcgccgtgctgacggacggtgccgtcggcgtaacgcacgcgcggaccgaagcgaaccgttccggtcgctccatcgagcacgaagtgtcggtcctcacccgtcgacgatgcaaagtccgcacgcggctcccacgtccagaccacgccgtctggggtcgtcgtcgtgagcacctcgtcgtcacggagagccaacaccggggcgtgactcagctgaaactcctgtccgggtgagccatcgctccgaccaagacgctcgggccctgtggtcgcagcgtgctcggcagccaccgttccgccgaggacgttcacggtcaccgacgacagggatggtgaggctcgatagggaggttggccagggcgtgccgcgagaagacggacgcgcagccacgtcgcgcgaacaccaccgagcgtcaggggcgagagcgcgcgcgggcacacgagcacgatctccccatcgcgattgagcccacccgttgtgtctcgatgcacgggcatcgctacccatgactctccgacgaacgcctcccacgcgagtggcggatcggtcggatcgacaccgatcccctcgatcgaggctcccacgttgaggcgaatgacggcacccggagcgagtccctcgaatccgaagtacgtcgcgtcaccgggtgcaagcgggtccgaggtgaagcatcgcacgaccccgccctcgaagcggaggtcatcccacacgtcgcgaacctggccaccgccgtcggctgtggcggtcatcgcgccaatcagggtcggggggcgaatgacgagatcgtcgatggtggagaagagcacctccggctgccccggtacgggggcggtggcgacctgggtcccctttggcacgacgacgtcgtgctcgagaacggtcgagagccaaaagaccaggtcggcatgggctggcgccggtgggaatgggctgatgccaacgaggtcgaggaacttcgtgtagagccggtctggcacctgattgatgcggtagagcacggtctcgctcatccaggcgaacagctcgatgagcgcaaccccgggatcggagacgttgtggttggtccactcgggacagtagcgcgggatcaaacgcttggcttcgtcgacgatgtcctgaaagcggcgatcgtcgagttcgggagtcggcagccccactacccctcctctcgtgggatggtgtagaacggatagacgagattgcggcgatcattcgtcgcacgaagacggtaggtcacggtgatgtgcaccaggctcgcatcgttgtcgtcctgcgccacggcgacgttctcgacgtcgatccgcggctcccactgtgccagtgcctcacgcaccgcctgagccatcaaccccatcgtgttggcgttcaccggctcgaacaacagatcccagatgcggcacccgaacgccggacgcatgacccgctcacccggcgccgtggagatcacgacccgaatcgcggtatcggtggagccggttccgtcggacagcgcgatgcctccgcggacatcgacccgcatcggaaacgcgaagccacggccgacgaagccggggtcgctgacgctggcgtccgtcggatgctcacgcgtcgccacggcgcaccgtcgatctcatcacgcgagcacctagaggacgtcgggtcggtgacgcaacccgcgcgcatcgagttcgcgcgcgagacgccgctcgacctgctcgaccaaccagtcgaggaactcctcggcctgaggagcgctcgacggtcgaaccggtcccgcctcctcgaccatgcgaccacctcctatctcgatccctgaaccctcgccacctcgccgccgtgtggaccccggggattcggacgcggccatcatcgccggcgcagctcgcgtcgcgactcgggcatccgacgacccttgggacactgatgacgaccctcggggcaacgacgtcgatcgtgcatagagcgcctgaaggtcagcgagcaccgcgtcatgctcccgagaagcgagtacgtcgccaccgggtcccatgggtggcgcgagtaccggggtcaaccccgtgcccgacggctcagggttgtgcgcacgagaaccacgcggtggcggcggcatcgccgcgagcagacgccgctcgtgctccccatcacccgcctcatcgccgaccagtgcacgcaccaagcttcccactcgcctcgcgtgccgctcctcgtcatcgaggtgcggatcgtcgaacagtcggggggcgcgtcccgtgtcacccgaggccacgtgcacaagttcgtgcgcaatgacgccgagtgcacccggcgagcggtccacggggcgctcgagaaagatcgtctgcccgaccgtcgcggcaaccgtcccgagggcgcgcaggctccgacgagtgagcgggccgctctgcacctccaccggtccgcggacgcccagcgcgctggcgaggggttccagcacggccggaagcggctgaacggcctctcccggctcctgcgaacgctcccgagggccctgccaattcgacctgaccggtctcgatcctcggcgcgacccgacatcggccatgaccgcgtcggatgcgctcgcgaagagccgaccgtcggactcgactccgcgccccgcgacctgcgatggtcgaagctcgcggccccgaggtcgtgacggccctgaccagccaaggcccctcgtcgcgaccaccccatcactgagcgcacgtggcatcgagccgagcactgagagtccctgcgcgacccatccactcgatgcaagcgtggccacaccacgttcccaccgacgacgaccgcgcgacgccatggtcggccacgacccgagcgctcggcgaaccccaccgtgccttcggacggcctcgtcgtcgccgacgaccgagccgtccccagtcggagcagctggctcgccgatcggcacatcgaccctcacgcccctcgaagcgtcgacgcgacgcagttggcctctcccgcggaccgcatcgattgcgtgtcgacgagcggcgagtccgccatcggacagcccgatccccgagctccccgcccgtcccgccgacgtgcgaacgtcgctccgtcgaccgccggactcaaccatcgaacgcctcgcgctcggcacgcgagcgcccgtgctcctcgcctgggactcctcgtcgaatccgatcgaacgcagccagggggtgcgccgacggaccgggcgcagcggccgaccgggaggcgcgccgcgctcgcggccccgacgaaactcagaccgaggaaaccgcgacgtgtactgccagagcggccctcgctcgcccgccctctcgctgccgtgccgagccagtgcggcgtaggtctcctggcgtacgagaccgtcgagaatgaccgcagccgcctcccaaccagccgccagcgactcgccgaacgtcatagcgtggctcgccccgtccgaggttgcccctcccgccccaacggcttctcgatccgtgacggtgcgaccagctgtcacggcgtccaggagcccgaccgccgatctcggcggccgatcgcctccttcacgtggtgccccaggagctccccgtccttccaggccaggctcagggggcgatgctccatcgcgatgctgctggcgttgtgccccctgttcggcctggtgtcgctgcggcgacgcccctgccggagtcgtggccgtcggcgtcgaaggatccgagctcgatgcgggctccgcggacgcgccactgcccgccccggcctccccatccctcgcgctcccccgcgatcctcctcgacgagagggtgccacacgcggcgcacggtacgcactgcgcgatggcgaaggcctcgccgccgcgcgcggacgtcctcgctcccgatccgacaccacggtaccgacagctgcgacatcgggcacgagccgaaccggcaagacctcgcgtcggagcctcgccaagcctccccctggtgcgtagggggtctgctgccgagccgtgacgcgaggaaggcggcccgcgtgcgccccaaccgcatccgccagcgccgacgcgtcgtcctggccctgaccagcaagccacagccgcaggaacggatggccgagcggacgaaccgggcgatcaccggtacccgccccaatcggcaacgaagggccaatcgccgaccgcagcgagagaggccgaccgacgatcgttgcgtggcgcaccgaccgcagtgcgagggcgccaaccgacggtcgaggccgacgcacgagcgaacgatgccacccgaaccgtcgctcaatgccggccacgaacgtcgacacggtggcgtcgtggccgctcatgatgcgaacgtcttcgacgtgaagccctggtgagcgacctcgatctcctccatggcaggaatcccatgcgcgtcgaccgccaacttcggaccgacccaccgcacggcgaatgcccccgtgatctcccaggagcgcagccgacgaccgtcggaagcgatcagcgtgatcgcagccgtcgatcgctgcagcttgttctggttcgccgcgaacgccggccccgaggaccgacgaacccaatcgaacagtgcgtccgagcgacaaatccctcgccgcagcacgatattcggccaatggatctggcccgggaacttgtgtgtgaagccgttctgtccgccttcggcgaactcggcgacctcgacggtcatctcgagtcccgacacctcagcgaacatgccgatctcggtgccatcgacctcaagaaggaagctggaggagtcgggaatatgcccatcaaagcctgactgcgtggtcacgagagctgtcgtacctcctcccatgctcgtgcgttcagcgcggcgaccccttggacgagcctcacacggtcctgatgctccagatcgagcagatcgtcaagatcccagtgcaggtggtacgccaggtagatcacctcttgccagaggacgtcgatcggatagtgcttcatcgcccgttctgcggcacctcctcgatcgctgcgcgccgcccaccagcaggtggtcgcggaggcgactccgatcccgcggcagccgtcggaggcgtcgtctcggacgccgtagtctcgggtcgaggactcgtctgcgactcggctcgctcctgcgcggccaagagcgcctcgatgtcctcttcggaaccaaagttgatcacgccgtagaagtcctgcaaatacgcgaggtcgaccgcgaagaggtcttggatctcgttgggtgtcacgagctcgagatccccaagccgctccaccacgcgcgccaagaccagaatggtcaggcgcggatcgtccgggccgctgatcgtgggatcacggagcggctcgagctcgtcgcgagccgtcgcaaggcgcatcacgccacggcgacgaacgaccccttggtcgtcgatgtagcctctcggcagaacaaactcgtagcgcgtccgcacggcctacttcttgcgctcgagcttctcgtactgcaaggtgatggtctcggtggcgacgtcgttcgccgaggcctcgaggctggcgaactcgatcttcgagggccaggcgtcgtagaagttccagcgggccgtctccgagagcgccgaatcgtagacgacgatggagccgtggcggcgaggcttgttgcggttctggacccccatgcccttcgtgcgcaggtcgttgaaccacttccagatgtcgtcgtcggcgacgttcagcggggcgacgcgcttcatggtgagctcgccgttccacttcggcttgctcatgaccttgtgctggacgagctgggcgcccttcgtacgctcgttgaagtcggcgacctcgatctcgacgctcaggccgtcgatgctcgtgacgttggtgacgtaggcaccgtcgatctcgacgaagaagttcgtcgtggtgagcggatcgttcttgatcaggttgaactgggccatggtgctcctttctccttagccagcgagctgcttgtgctggctgatgcggaagacgacgaactcggcgggcttcaccggggcgatgcccacctccacgacgagacgaccctcgtcgatgacggcgggagggttggtctcggcgtcgcacttgacgtagaacgcctcttcgggcgaggcgccaaagagtgccccgtcttgccagaggccgccgaggaaggcggtgagggttcgggtgatgccctcccagagggtgacgtcgttcggctcgaacaccgcgaactgcgtgccgtcgaggatggtggtctccaccatgttgaacagacgccgcacgttgatgtagcgccagtcgctgtcggaggagagggtgcgtgccccccagatgcggatcccgcgcgtgccgaaggggcggatgcagttgatcccgatggggttcaagagtgcctgctcgttcttcgtgatggagcgctcgacgtccaagcacccgcggatggtgtcgttggccggggccttccacacgccacgggtgtcgtcggtccgcgaccacaccccggcgatgtgaccgctcggcgggatgagcacctcgctctggccgttggtgccgacggggttctccactcggatccacgggtagtacatggccgcgaaggccgagtcgtacatggcgacgtcgctgcgccactcgcgcacctgctggggggtcatgccgggcggggcgtcgaggatcgccatgcggttgccctggcgctcgcagtggccgatgagggcggtctggacggccttccacatggcgaggtcgatggtgccgtcgggacgggtcgccgccgtcacgaggtcggggacgatcaccatggtgacgtcgtcggcgatggtgaggccattgatgccggtgcgggcactctcggagcctgcgaagcgcttggggctcacagggacggggtgcggggccggtgccacgaggggataggtcccgggacgcatcacctcgagcagcgacgagaggtcgacggcgtcggcgaggtccacgcgcacgcgcacggtgtgggaggcggcgttgacgaccgtggcgacgttgcgctcggagtcgtcgagggtgaggttggtgaacgactcgatggtcgtgccgtcagggccgacgatgtcgaggtcgaagggagccgggccgtcggcgtcggcgtccaccgtgcgcacgactacctggagcggagcgccttgttccaggctctcgacgtgcaccggggagccgagggcacgatcggccgcagggagggaggccgtcgagggggcgtcagcgggctcggtgttcgggatccgaacgatgtaggcgatcgtgccaccgttctggaagaagccgtagacgctgagcggcagcatggccccgggggtgaagctgccgtagagctcctcgaactgcgtccagctcgtgacgagacgagggcgggtgccctcgggatcgctcgggtcgtcgttcggggcacgctcggtgaagcccacgaaggccgcgatcgcggtcggggcaggcgtcaggctcttctgcgcagagggcatttcctccacgtagaccccaggagcggcgtacgtcggcacgatggttcccctttccctcgccctcgagctgtcctcgaggaggttcactcactccagacactcactcacagcactcgcgaacgacacggcacgcatgcccgggggccaccaccgcaggccatctgcgagctcgcgtcagagcgacctggtgacgtccggcccgcaccatccgacgtcaacgaaacgcttcgacgccatcggtccgacagggcgttgccacaagaccactcagcgtggccgataccctccacacacacgtacttgccacgtgacgttatcagagtgtgcgggggtggtcaacagggggttgtgaactgctccagcatgagtctgtcatacaccaagtacgtgtgtgttagtgatacagtggcgccgtgaacctcaccgagtgggcacgccgccagggtatccaccctcagaccgcctacaaccggttccatgcaggcacacttccggtgcctgcggtgagagtgaagcagcggaccatcctggcccagccagacgctgccaccactaccccgagggacatggtaggtctctctgcccgcgtctcttcgtatgaccagcgaggtgatctcgaccgtcaggtcgcacggctgaccgagtgggcagcgaaggtcggcctgccgagagcccgggtggaagcagaggtcggctcggggatgaacgggtctcgacccaagcttcgacgcctcctcgctgatccgcaggtcaccatcatcgtcgtggagcacctgaccgcctggctcgcatgaatgtagaactcgtcgaagcagcacgctcggcccatggccgcaggctcgtcgtgatcgacgacggcgaggtggacgacgacctggtgcgggacatgaccgaggtgctcacgagcttctgccccagactctacggacgcaggtccgctcgtagccgagcagagaaggccctgcgatgtgctacccaggacatggggccaaagccccctccaagaaggcaatgccatcgcgggcgtctcacctgaaggagcagagcaagccgtgagcaagcggcttcgcgcgatctctccgccgttcgtggtagcgccacccacaggtgttcgtgtgcgcaccaggcttcaggtgactgacgtcgatgcagcggtcctcatggcccttggtacctacctcggctcccttgcatcgaatgacctggctgagcgctgccgccaaggagagctcgatgccaagggcaagactgagtctcgtcgtgagcgcaaacgagcgctgacggccctcacgtcctctcggtgggcgggaacgatcaccagaacgagcgaggatgccttccaactcgccatgggcaacctcgaagccgaacaacggagcctccgggctcggatcgcccagattcgccgtcgtctcgcggtgcctgcgggaacacgacgtggacgttcttacgggtatcccactcaggccgagcggttccagaagcaacgccgtctccagatcctcgaacaccgcctcgaggtggtcgaggcccgcctggagagcgggcgggtgtccatctgtcgtggtgggaagcacctggccaacgtccatcaccacctggacgaagccggactgactgacgatgcctggcgagagcgctggcgagctgagcgctggtttctcaccgcggacggggagaaggacaagtaccttggcaacctcacgatccggtggcacccagatgagcagtggctcgacatcgcccttcctagggcgcttgcccacctcgccaaccggtcccgaaaccgctaccgactctcatgcccgatcagcttcccctacagaggggatgaggtcgcagctcaggccgtgaatggggccgtgcgctacgacattgtgttcctgccgcagaaggggcgatggtatctcgacgcatcctggagataccccgaccgtcagccactcaccatcgagcaggtccgagagcatcgggtcatggccgtcgatctgaacgccggacaccttgcaaccgtcctcctcgacccgtcgggcaaccctgtcgggcgaccggccaccatccccattgtcctcgacgggctgccagccaccacccgagacggccacctgcgtcaagcgatctctgacgtactcaccatggcgaagaccggcggtgctcgggccatcgtgatcgagaacctggacttcgccgagtccagggacataggtcgagaactgcatggcaaccgaccatcgcgtggcaagcggggcagacgctttcgccgcctcatcgcaggcatccctacggcgaagttccgtaacctgctcatccagatggccgcgaacaccggaatcacggttgtcgccgtcgatccggcctacaccagtaggtggggcgccgaacactggctcggcgccctccaggaaaccttcatcgatatctcgggccaccatgcggcggccctggtcatcggaagacgtggacttggacagcgagcacgacgaaagacgaggtgtgacttgacccgagcagagcatcgggaagagagagctacccgcccggtcgtgggggccacgggtgacgggggaccatcactcctgtccaggcagcgcatgaggggacttgggacccgagaggccagagggcagccacagacgtggcagaagacccgaagggccgaccggaccaccccggttacccaggtggcccaagaccgttcggggccacccacgaagcgggacagagtttcgctgagtgtctaggaacggtgaggagatgttcacgatgaacagcccgcactggcatcatcacagcaccacggtggggagcacactcgacggctttctcgtgactccacccccgcctgaaggcgggggcttcgggtgcgctgttcacgcacctgcggttcctaccatggcaggaaccttcgcggaaacgccgaccgccttgcgacgatcgcgaacactcgaaccttgctagagtcagtggtcactggccaccttggccgatgctgcggcgcgcggccgcagaagggggttggcgatgccttcctggtttccatggcttcggcgtcggcggcccgccgcaccgcaagtatccgcacagacatcccgtcctcagtggcagcgtgtgggcacaccctcaaccgatgggcgtgcctcgcgaccgtcaccacaacaggtgctcgccctccaacggcagctcggcaatcgcacgacgagcatgcttgtcgacaactccggatcggcgccgggtgggaactacaacaacaccgagaaccagcctctctacgaggacctacgccatgtggtcggcgaggggcaacagcacgaggcgccgggtgggaactacaacaacaccgagaaccagcctctctacgaggacctacgccatgtggtcggcgaggggcaacagcacgaggcgccgggtgggaactacaacaacacccaatcgtcaccttcgcagtcccgcgcaccaagctacggcaatgacatcaacgagttgctcgcaacagtatcaagcaggccgccgtcggtggaggcccaagagaaggcaacctccctatgggcccttgacgcacacctgcgtgccaagcacggcctcgcaccagctttcccctcgacgaagcagctcgccatgcgcgagttcaccacgacgaagtacctcacgccgctcgagtcgcagtcgaagaccctcgcgtttcgcggtggcctgctcatgcgccgtgtcgccccgggccccgaccagccaccgggtaagtggcaactcgagccctatgacaccacggacatccagaacacgatgcatggcaacgagtctgagcgaggccaagccctctacgtcctctcccaaggtggcacgctgctctcggcaccgggcaaggtacaggagacgcatcactccacgctcctcgcaggcactgaggtggcaggggctggcatgatgcgagtcgagaacggcaagatccgctcgatctccaacgcgagcgggcactaccgtcccacggccgactacttgcgcaacgttttcaaggtattcgagcgcaaccacgtcaatctcgacgagatcgaagtcgaggaagccctcaactccacctgcaatcgatctcacctgaacggtcatcgccgcaactgggcatcggcgacggaatggctcgccttccacgacgaaccggccgaggacacgcaaggtccaccgccacagtcgatcggttaccagtcgtccgcaccgccctcagacgagtagacccggctacagctcggggctgtcgccgtccacggtgcgcgagccgaagttacgcggccagagacgctcgcgttcgtcccgatgacggtgagcgctccgctgccagagctcgatccagctccgtccttctggaacgaacgtacccttcgtccggcgcgcttcccagaaatccgttgcagcctcgcgaccggcaagcgcgagagcatcggcgatccgagcggtgaacgcaccgggacgctctccctcgcgcgccgtgagtggttctccaacgacgatggtcgtcgagcccggtcgcaggcggcgttgtcccttgccgaggatctcccacgtgccatcgatgaacaacggcacgaccggtcgtcctgttcgcagcgccacttgtgctgctccagccttcggctcctgtggcaggccatcgggagttctcccgccctcggggaacagaaggagattccagccctcctcgacgagctgctcggcgagttcggctgagcgccgagagactcgctgccgctcgatggggatcgcaccgagcaccagggcggaggcgaacgccttcgagggacgatcgaagaagtagtccgctcccgcacccacgacggtccgatgccgcaccctcgccggcagaaccgacagcacgaccggggtgtcgaggtgactctggtggttcgccacgaacacgaccggctcatccaaggcgtcgagaacctcgcccgcaatgagacgaggacgcgcgatggctcgcaccccaggtaacaccaccccatcgagcaagacggcgcgagcgacccgcaccgagtcccgccgggcaaaggacgtgtcgaactccacgcccgtccgcgcagttcgatcaaacggaagctgcccaggcgggctcggagctcgtacgacgaagcggacggaagcgggcagcttcaccgctgtccctccgatacgtcggccatgaccagcggcggactgtgcaggtgggtgatcgatgggttggggccgacgatcgaccgcgccatctccagagcatcgtcgagggtgctcgccgcctggaaaccgaggcgacgagctgtcttcggatcaccgccgagaatgatcacgccgccaaggtggtcgagggcatgtgcgccccaataccacatgtagaacgggtgcacgccgtggtaggcgttctgcgtccgatacaaatggatgtaccaggggtcccgcgcaaagctctcctcgtactttgcctcgatcacgaggggatccgtcgtctcggagagcacctggtcatagaagtcgatgtagctcgggtggaacgctggatcgaactcgggcctcgtcggatgcgccatgatcaagactccgccacgacgaaccaagggacggcctcgatacatgttgaagagatagccaagtcctaggcagtagacgaggatggggttcatgatcgagttcacgttgtagggcccgacgaagggaaggcccatggtcaagatgtcagcctgcccctcgacgggcacgagctgctggcgatagacccgctcgatggtctgctcgtgcaccgcctcgacctcaccggcggcgacgcccgtcaaaccgtagggcgatcgaacgcgatggaagatctcccgcgcgagatgcggcggagtgcgtcgcaaggactcggcgacggcgacgtagctcgctcgatcgcgaaggtcccactcccactcccgtcgattgaggaaccgaaacgacgatggaaaggtgttggtgttcagcgtggtctcgatctggaaaatacgtatgccgctacgggcgatgagacggcccatgcgccagttggaggagtgcagctgggagttgtgtcggtccatgaacgaccgcgagtgcaccatcgtcgtgacgttgtgatgatggcggatggagtcgtagctcgcaagcccagttgcaacactcttgtggcccccatccatggagacgaggttgatattgacgtacacgagcaagtcgctctcgaccgcacggcgattgagctcgaccagctctccctcgtcggtatggccgacgacgaccatgttggccttgtcttcggcatcgtgctgggtgatcatcccacgcggtgcaagcgcatcgtagacccgacgaccgagggcatgtcgaagttccgactccgtcatacgccgatgcaaggccagagccgcgacgagctggatatcctcgacccccttggcggcggcgagctcgagaacctcctcaatgacgaggctgcggacatcgggggcagccatctgcggcagcgggagcgacacgtcgtcgaaggcgatcgtcagtcgcatccccggaaagagcagcgcttcgagcggctcggcatcgatcgggtgcgccagcgcatcgcgaatcgccgcacgagcgtctcgaactgccggcagcggatccggaggatacaccacccgtgatcccgcagggagccgctccagccggaaaccctccccataccagaacagggtcgggggcgtcgctcggtctacttcgagtacgaagccaggtcgatatgccacttagcgtgccttcctttggtgaagatcgaagacgaccttgattgcatcggcgcgacccccttcccgagccttcgcgatggccgtgacgtagtcgcgcaggccatagcgatgggtcacgagtcgtccgaggccaaggtccgcggcgagacccatcgccagatcgaacgtgcgtaccggaccggcgactcgtcccaaggactgggcgatgtcgggttcgagcacctcggtgccgtaggcgtatgcgccgatcagtcgcacctcccggtgccacaagggtgcgagatcgagacgttggggcgacggcatgcccgccacgatcacctcgccacccggtcggaccgactcgatcgcgagctggatcgaactggcagagcccaccgcatcgatgacggcatcgaaaccgtcgccgaggaagcgccctgctcgcagtgttcctcgcagacgacgtgcccgctctggtagctcgcgctcagtcacgacacgatccgcaccgaacgcgctcgcgagctcacgttggagcgggtagcgtgcgacgctcgtcacgctggcaaagctctgcagccgagcggcgacggccgtcgcgacaaggcccacggtgccagcaccgatcaccgccacatgcccgtcacgccgaccgacgctcaagacggtatggagaccacacgccagtggctcgaccatcacggcgtccgcatcgtcgacctcgtcaggaaccgcgtgcaacgtggcctcgtgcgccacgaactcgctcgcccaaccacccccggtcgaggcacagtagccggtctggatgcccggctcgagatcgccgaccgcgatcgacgcacagcgctgcgtttcacctcgttggcacgcgtcacacagcggcacgccccgcacggcacacgtcaacgccggctcgacgacccaccgacccgatcgaccctccgcgtcaacgacgacttcgtgccccgggatgaagggcagcgagacgagaggctcgaagtagcgcgacgtctcgaagaacaccgatgcgaggtctgacccacagatcccggcaagccggggccgtacgcgcacccagttgggcccaggaagctccggcgggtcgacgtcaaccaacgcgagtgggccgctctcgatcgcccgtcgcgtcgaggatccagcgagcagacgagccgccgcgaaccgcgctggccgacgttcgacctgcaacgccctcatcgacgacctccgatgggcagcatgagcgacgggaacccagaggcacgttcccactcctcgatgagccaaccccgccgcttggcaagcgcgcgcagcttcgcatccggattcaccgcgaccgccgtacccgctgcttcgagcatgggcagatcactggtggagtctgcgtaggcgatcgtgtcagcgagcgggatctcgtagcgggccgcgagctgacgcacgaggtcggctcgtgcctccccaatgggcagcgtcccgggcaccgtaccacttaagcggccgttcctctcaggcatgtccagggcgatgagctcgtcgaacagcgggcggaacggctccatcgcaaagcgcagcgcaccggtgacgccgaccgtcacatgaccggcggcacgatgttgccgcactctggcgaggccctccgggaacgtcttgcgcaggaggtagcccgtcatgagatccggagccagcttggcaagctcggcaggatccgcatcgcggtaacgacgatagaagtaccggaggaagtcggagcggtcgcggccgtcgagccgcaacagcttcggcgcctcggcgagcaggctcgcgacgagcccgaaccgatccacggggcgcagcgcactggtcgcgacgaaggcgaacgagtccaccacgttcgctgcgaccaaggtgttctcgagatcgaacacggccaggcgtcgcccgcgcagcagaccctcgcgtaggcggtcgtctcgggagcgtcgcggaccgcgccggggattcgtgcgcgcgcgagcgtgctcgaccacgctcggcaggtggacgtcgaggatgaagtgccgccaatcgatggccgccggatcgacgagcacgccgtcgtcagcgctcgcgagggagacgagttctacgagccgttcggacccgtacatcgcctcgcactcggcgtaggcaccgtagagctcgacgtaggaacgagcccgctcgagggcgtcctgcgtctcgacgagaccatcttgggccgagagcatgggaccgcgaagcggcagccgccccaggaggccgagcaccgccccgacggcccgcctggtgcgctcgagacggcgttcgacctcccctctggctgggtaggtccacgaaggtatcgcgatggcttggcccttgtcgtcgtagagcgggtgttcggcgaagtactgccggatgagcgagaccatcacctcgtaacgaagcgggttcctcgtgcccgaggccgcgtggtagtacgccatcgcccgggggggatgagcagcggcgacgagaaccgcgccgacgacgaagtccacggggatcacgtcgaccaccgtctcggccgacccagggaaatcgcgcagcagcccccgcgcgaacgagatgatgatgggctccgccatgcggaaccctcgaatccaacccggtcgcggctcggcgtagctcgactcgatgatcgaggggcgcacgaccgacaccggggtgcgctgacggcgctcctccaggacgcgttccccgagcgccttcgtcatggcgtaggcgtccggccatcccaggctctgcgctcgcgcccgacccagttcgaccatacgctcatggacccagtcgcgtcgaaagcgctcggtgcgttcggccacgatcgcgacccccgcagccccgagctccgccagcgccttgcgacggaacgtttcgagccgctccggctcgcgagaacgatgctccgtctctcgacgcagagccctggcagcctcgacctccgcacgccaatccacgtccggatagtgcggctgcgtgcggagcgacgcctcgggtgcgtcacccttgcgcgagccggcgacgtaggcggtcgagatggcgacgaagtggcctggcgcgagatcggcctcggcacgtgcctgctcgtacgcctcgagcactctcgccggcccgagcaggttgatctcgacggcagcatcgagtgtcgcgtcgaagctcaccgtcgccgcggagtggatcacgatgtcggctgcgccaagcaccgaccgtcccgcagggtcgagaccgagaccatcacggccaacgtcaccctcgacgagcacgacccgacgagcagccatgtccgcaaacgcatcccgaccgagctcggctcggagtcgatcgaagcagctgttgccaagcagctctcgacggaggcgctcctcggcgctcgtcgtacgaccgcgtcgaatcaagaccgcaacacgagtctccgggagcaaccgaagaacggactcgacgatggccgtcccgaggaagcccgtcgcgcccgtaaggaagatcaaccgacccgccaaggactcgcgcaacaccccgacctagcctcctcaagcccccaccgtggggctcatcaagcctaccttcgggcactcacgacgaggacgtgccccgacgacgcaccgtcgccctgcgcttgggcggggtgtagcgcttcgatgcggttgtcggccgatgcggcaacaaggtcccttctgtggcggcaccatcgccagtcttgcccttgccgctgcgtcgtgcttcacgagcagctcgacgagcagcgacgacctcgggattggccttgaagccgacgaagacgccccacgcgaggatcgggaatgcggcgatgacgaggttgccccaaccggcgccgatcgcgacgagcatcgcaaacccacccgcgatccgtcgccggtctcgctgaatcatgatggccgtgatcgccatcaagaccagcccctcggcaagaatgaactcagggttagcgaggatcccgtggcccgtgagcttcacgtggccatcgaggactgggatccacagcaccgtgtacaccacggcctcgatcagcacgagtgcgtagccgatctgtcgttctcgacgagagagtggcatggcacggcgaagggctgcggtcacgggaccagtgtagtgcttgctactgcccacacttggtccccgcgaccgcgggctaccgatccgtcaccgaagtgtggcccttccgtcgagcgcgagcaaccgcaccgtcacccagggctctcacgctggaagcgtccctggaagacgacaacgggaggtcactgtggacacgcatcaaccgccaagtccgtatgaaccggtcgacgaggctcgactgaaccgcttccactggcggtcgctcttcaccactgggatgggcgtgctcaccgacggctacgacctgtcctcggtcgggatcgtcttgccacttgcgctggcaagcttccatcagcactcactgaccggtgtcgagagctcgctgctcgccgggtcagcactcgtcggatctgccgttggcgcgctcgccttcggcttcgccgcgaaccggggccgcaagcgcttctatggtctcgacgtcacgatcatggccctcgcagcgctcgctcaggccttcgcaccctcgatcacctggctcatcgcgatccggttcatcctcggcatcggcgtcggagccgactacgtcctcagtccgatgatcctcggtgagcacgccaatcgccgagatcgcggcaagatcatggcgctgggcttcggccttacctggaccgtcggcgcggtgatcgcaagcatgctctacctcatcctcgagggagcgggcgtcgcgcctgatctcgtctggcggatcgtgctcgcggccggcgcactaccggcggcatccgtgatctacctgcgacgacgccttcccgaaacgccgcgctttctcctggccatccgccgcgaccccaccgcctatgcagccgtcgcacgcgaagccagcggcgatcgcgtcgcaccgcccacgcgcctcggcctgaacgaggacctcaagtcattcttcgcacgtcgttggcccgccgtcctcgcagcctgctcactctggttcttgttcgacatcgtcgcctacagcggcatcctcttcgggccctcgttgatcgcgaaggggatcggcctgacgcccggaacgttcaacttggccatggagctcgtcgcgacgatccccggcgccatcgtcgggctcagcctcgtcgatcgggtcggtcgtcgctggatgcaggcgctcggcttcgccggcatggcagccttcctcgtcatgttcgccgcagcgcacgctgcgatcgccgcagcaccgcttgtcggcgcattggtgtacggaggcgtcaacttctcccagcaagcaggtccaggatcgatctcggcttcggggcttctcggcgtcgaactctcctcgacacgagcacgcggactcgtccaagcgctcaccgtcgcctcgggtcgtctcggtgcctcgctgacgtcattcgtctttccagcactcttcgcgacctggggagaagatgccgcactcgtgttcctcgcgggggtcgcgatcctagcgctcgccatcacgctgctcgcggtccccgagacagcgcgacgcaccctcgaggagaacgcaggcgaactccttcccgccggcgcagcggactgatcagacccgccgaggcacgcaccgacacgctcagctaccgctcggcccgcccgagcggtagctcgtgtcgcggggcctcgatcgggacagcccgcgaagcgcgctcgaccgcgccccacgcgcgtgcacagcgtcacgatcgtcacccacgtgtgctcgtgtgtcgtaaggcttcggcttgcgccacgccgcggcccctccccgaccactcccacctcttcgagcaggcagaaccgggttggacccgcccgctaccgcgacaggcgtcccacgtcagggctcaagcgccaacgggccacccgatccgaccgagcgtggagcgaaggacccgtcgtggcgatcgaagcgcggttccaccgggtgtcgtcgcaccggtgacggcgaccgcccaccacgatcactcggcggctccgggcaagtcgagctcacgaagccgcaaacgggtccctggtcgggtccctgttcggctccaactccaacgtccgagccagctccatcgcggtctcatccccgcagagcgacgcaacgagcgcaaccgtcatgtcgagaccagccgcaatgccagatgacgtccagcgatcacgatcctccacccatcgagcctgggcctcccagcggacctgcggcgcttgctccatcacccacgccaacgctcgcttgttcgaggtagcccggtaaccatcgagcaaacccgccgcaccgaggagtgcagagcccgtgcagaccgagctgaccaacgttgccgccgacgcccacgtacgcagccatgcgaggaagtcatgatcgtcgaccagctcgcgagttcctctcccgcccggcacgagcacgatatcggcgactggagcatcagcgtaggtggtatcgacacagagtcgtggtccttgcgtgctccgtaccggtgcggtcgtcggaccgacgaccgcgatcgcgaactggtccgcgagcgcgccgaggagctccatcggtccacacgcatcgaggagctcgaaaccatcgaacaccaccacggccacctgctgcgacatgggatccccctcgactcgacacactgacgttaggccacggccgcctcctcgcggaccgaagagagctcgtcgccgacgcaagcctggcacccgagggccgacgacaggcagatcgtgtcggttcactcgacccagcgtgcgatggcgtggccgcctcggcgaggtccatgacgcggtggcgggcgacgagctcgcacgatgagctcgcgaggaaggtcccggcgacggcgttgtcgcaacaggccacgaccgtgcccacccatgccaacaccccgtctgccaccagagcgtccacacgttcgcgacgagccgtgcaaccttagtcccgaggaagatcgcacccgtgaggccaccgcgagtccgccgcgcagctccgatcacctcgatcgccagctcacatcgagcatgcgctgctcgagcaaccagcccttcgtccgcctcgagtcggctcaggtgcgattgcgaggcggctcgatccctcgccgcgtcggacgtcggtgaggccggtcgattccgagtcggcgcagatcacgctgacgggcatcacgtgctcgctatcctcgccccttgggcgatcgctggccgtcgcaggcctggcgtcagatgtcgatggatcgtgctgggcatcgtcgcggagagccgatcggccccgtcgtgcaaggcccagcgcccagagcccactgtcgcgctctcacgccgagtcgggcatcgctcgcttcgcacgctcccgctccgtgtcgagctgcttgcgctggcggcagaggcagatctcctcctcgcggtcggcgggctcgagcccaccgtccggccgtgcgtgatgtgctctgcggacccagctccaagagtctgccctcgcgccgagcccaccggaggcatcggcactgcgcggggttggtcgaggaccagtgccgcgacaagcgcgacggaactggtaggagcagcggcccgccgacgtcgagcggaaccgctgcccaggagtggttcgtcgtctgtgactccttcgttccgggcccagtacgtatcaacccggcagaggaacggcggcgaggcgagtgctctgtgactcgaggctcgcgaccgcgctgcctcgtgcatcaggcacactccccgtcgctcacgccagtggcgccgaggcccggtgaccactgcccacgcggacggccccgagcgcgagccccacgatcgcgccgacgatcgccacgccgatcgcgacgatcatggccacatgcagaccgctcatgaacgcagcgtgcgacccgttggtgacggcggtctgaacaagggccggtacttgtggaatccgcggtgcgagtccttccgcaatcaaggggcgcgctggtccgagtcgcgttgcgacgacgccaggcacacccgctgcctcgagcttggagatcagtacactgcccacccgattcgagagcaccgaaccgagcaccgccgttccaaggagcccaccgatctgcacggcggtcgactgcacacctccggccacgcccgcttcggcctcaggcacgttcgcgacgatggtatccgaggtcgtcggcatgacgaggccaatacccaatccgacgatgacgaacggaagtgcaaggtggacgagataggaggagctgaccccgagcgtcgtgagcagtgcgagcccaacggcgatggcagccataccgatcccgaccggcacgcgcggcccgaaccgaccgttcagcgcagcaccgagcggcgccccgaccacaaaggaagcggtcaagggcaaaactcgcacgccggccgctacggggctgtagccgtgtacctcttggagatagagggcgacgaagaacaccaccccgaagaaggcgaagaacgacaagatgaccaccacagcggacagcgagacctgtcggcgtccgaacatgccaagtggcaccaatgggaagcgagctcgcccttcaacgaacacgaagatcaccgcgccaacgattgccaacccgaagaagatccaggtgcgacccgcgagccatccccagctctgggccttgatcagcccgaagacgagggagaacaacgtaccggcaagcacgatggtccccggagcgtcgagtcggtcgggttcttgttcacgtgattcggcgaggacgaacaggccgaggaggatgccaatggctccgacgggcacattgaggtagaacaccgactgccacgagacgttctgcaccaacagcccagccacgatcggtccgccagcgatcgccaagccactggaagcgccccagataccgatggccgtgttcagccgctcgaccgggaaactcgcacgcaagatcgcaagcgtgctcggcatgatcagcgcaccgaaaccgccttggatggcgcggaaggcgatgacccacccaatggaccccgcgagccccacacctgctgacgcggcggcgaagcccagcatgcccaccaagaaggtggcccgtcgaccgatccgatcggcgagcttgccagccgggatcagcagcaccgcagtggtgagcaggtacgcgttcgtaacccactgcagatcagcgaggttggcgtgcaggtctctcgcgatgaagggattcgcgatcgccacgacggtcgcgtcgagaccgaccatgatcaccccgaaggccacgctggccagggcccaccaggggttcgcgcgaatcgtgcgcttctcttgtgtctccatgagcttgcctcctcaccggccgtcgacctgcgccattctggcagccgctgccagtctagcaattctgacagtcactgacacttccaacccgatgctcccgcgatgcattccgccgcgcgtacactgatgattccggaggagccatgacccgcgagcagacgaaggcgcgcacggaggcagagcttgctcgggcagccgccgaactcttcgcacgccagggcgttgcccagacaaccgtggagcagatcgccgagcgagcaggcgtgtcggagcgaacgttctttcgctacttcccgaccaaggaagatgcagtcctctcgtacatctggttgaaggcagacgacctgcgcagtgccttcctcgctcgacctgcgtccgagtcactcgccgaagcgttcctggcgtccgttcgagccaccaagacggacgacgaggcccaagcgaccctcgaccgcgagctccttcgcctccttcgcaacaccccgaccctacgggcgcgctggctcgtcgccggatgggaaaccgcggcagccttcacgccgctcgtcgccgagcgactcgcctgcgagcccgacgcgctcatagctcggctcgcgacgaatgcgctactcgttgccatccagacagcgctggacgtggtcggagagcatggcgcagattttctcgaggtgctcacggacgccatcggccggctcgccgatggagcgggactcgctacgagaccgctcgagcgcccatcagactcgcaacgatctggctgaagtggcgagctgcgatcgccgcaccgctctcgacgaggaacgccacctcgggatcgcgcaggcggtagcgccgctgacgaccatcgcgctccgtcgagagcaacccggcgtcgaccagacacgacaggtgcaccgacgttcgcccctgcgacagtccagtgatctgtcgacactccagcgaggtcaactcgccccgttccaacagggttcgcaccagccgcacccgcgtcggatctgcgagcgccgcaaacaaacgtgccagcacggcgtcgacgtcggcatccggacgctcgtccagtgcgacgccacctgtgagcgctatctccctcatgacacacccatccccaccagtcgatcgagcatctctgcgaggacctccggctccgtcgccacgttcacacgcatccagtccgaacgtccctggagatcgaaggtctcacccgctgagacgacgacgccagcgcgacgggcccacgcagccgcactctctgccccaagaccgagcacctgcacccagagcaggtaggtgccggcgggaacggacgtgcgcatccgaccggtgcgaacgagtgcctccgcagctgtctcgaggttgtcctggatgcggtcaagggtggactccaaccactcgccgccctgctcccatgcgacggcggcagcgagcagccccagcgacgtcggcgaactgcgaaagtgtgcatcgacctcaccgagcatctgcgcaacgcgtgtcgagccggcctccacgtgagccgccttgaggcctgcgatgttgaacgtcttcgttgccgcggacagaccgactgaccgctcggttgcggcatgatccagcgagagccagggcacgtggcgcacgcccgtgcgcacgatatcctgatggatctcgtcggcgatcacgaccacgtgatgtcgctcgacgacgtcggcgatggcggtgagttcctcgcgtgtcgccacccgtcccgtcggattgtgcgggttgcagaggatcagtgccttcgcccccgacgcgatcaaggtccgctcgaggcgctctgggtcgagtcgatagtcatcctcttcgcgaagcggaaccgtcacgacgcgacgcccgagcgacaccggcgtcgagaggaatgggggggtacgacggcgtcggcaccaccacgccactcccgggctccgtgagtgtccagagtgccaaggcgaggccgcccaggacgtcgccgaccaggagcacgtcccgtggctcgtagccggtgcgcgccttggaccagcgtgccagtgccgatcgataccgctcgtcgagggctcccgaggcgtagccgacgtcgccacgcgtcaccgcatccgccaccgttcgccgcacgacctccggagggagcaagtccatgtccgcgacccacgccggtaggagcggcgagggtgccagctcccacttcacgctcaggggacgacgggcacggagcgcgtcgatgactcgccctcgcgccgccccggtatcgatcggacgaccattcgagccgtcctgagggagatcgaactgctggtgagccacagcatcatgctacgcatcgacgatccgcccgcgagagtggcaggtcccccaaagggatgatgcgaatgtgctatccggatgcgcgggactgcagcgcagctcgaatccgcgcatcggcgagctcgcgccatgccgtcgagggttcgacccgcggcacatgcgcgcgctcgagcagccaagcggcgaggtatggattgcgtgcaaggaccgggccatgcaggtaggtgccgaccacgctgcctgcgacgaccccgtccacgcccccaacgccgttcccgacaccgacgagcacccgaccgagcgggacggcatcaccttcgagcgtggtgacgccgcggtggttctcgaagcctgtcagataggccccgaccgagatcacgggactcgtcagaacctcgccgaccgcacggcgctcgccgctcgccgaccgaaccggcaagagcccgagtccttcgtgctccgctccctccgcggcaaacgagcgtcctaggagctgcaggcctgcgcacaccgcgagaaccgggcgcccctcctcgacgacggcacgcagcgtgccatcgcgcgcaagcagccgagcggccagcacctgcgggccgtcctcaccgccgcccaagaggtagaaggcgccatcatgtggcaagggacgatccgatgacgcatcgacgacctcagcctcgtgaccagctcggcgaacagcagcggccaacaccaacgcgttgccacggtctccataggtcccgagcaggtcggggtagacgacgacgatgcgcaccatcatggcacggccctcgccgaagcactcgcagccaaggtggtatcgcggagcgcaccgagcgcacgcagcgacgcattggcctcccaaaacgctgtgtagttgccgacgaaggcgatgggcttggaagcgtcggcacggcgaagcgcctcacggagcgaggaggcctgccaaggctcgtgcccggccacctccagacgcaaggcgagatcttcgacccgtcgcccacacacgatgacgcgtcggggcgcgattcgctcccagggcgcatcccaaatccacgaggtgtcacgaccatcggcgatctcggcattgagttgcgcaatcacgtcaccgtcccaatctgcgagcagctcgacgagagcatcgaaccccgctggattcttcgcgagcatcgtcatcacacgaggcgtaccgggcagctcgaggacccgccagtactcgaagcgtccctcgacctcgagccgtcgacggccaaggccgcgcagcacgtcggcgaccggccgacgttcgagcgccccgatcgcaaccgccgcagccagcgcattgaaacgattgaacgtcccaggtggcgcctcggccaggctgagcatcccctcgggaccatgggcgttcccgtcgtctccgatccaccaatccggatccggcgacgcgaggccgcacccctcgcaccaccatcggccgtcctggaacgacacgtggccaccacagcggggacacgcgtgggcgtcgtcggtccaggtcgacgtcgggcgaatccaaatctgacgtcgaaatcgcgacgcgccgagcaccacgatggggtccagtgcgttcgccacgacgagctcgatcgaactcgccgcttcggcgatgcgctcggacagccggcggacctcgagggctcgatcgagttggtcgcgagtgaggttgagccagacgagaagcgagggccgaagcgcctccgccacgctcggcacgaacgcctcgtcgacctcgaagaccccgaccgtcgcctctcgtcgagctcgagccagtgccccagcgatgccgaaactcatgttcgcaccacggttggtgaccaccgcgcccgcggccatggctaccgcaagcgcggtcgtcgtcgacttcccattcgtgcccgtcacgaggatcgagcggagttgtcgccccgcacgttcgaggatgtgcgggtcaatcgccaacgccagtcgaccactcaacgcgccaccagcgccgactcccaacatccgagacaacgccgacgcggcctgcgcggcgcccctcgccgcacgctgacgagcactctccacgggcgtgaggctatcgaccgggtgggcgcccttgcgctcatgcccgacgcgcggccgactccttcggacacgcggcagaacgtagaaggagccggctggggggtagccggctccttaagtgtgcaacggtgttgtgttggggggaaccatgccgttgctgtatgccagactaccccaccagtccgcgaaaatccaactatggtgatgatatcgtgtatcactttttccgatagcctcggtggctcgccatggagttgcgccaacttcgatcactcatcgccgtccaagaggcaggcagtttctccgcggcagcggaggcgctcgccacggttcagtccaacgtctccgcccacatctcgaagctcgagcgtgagctccaggtcgtgctggtcgaccgcagaacgggccagctcaccaccgagggcgagatcgtagccaagcgggctcgccatctcctcggagagatcgccgagatctacgaggatctctcgctccatggctccgacgccacgggcaaggttcgcctcggcatgatcgcgacggtggcgagttggctcctaccgccgctcctcgaccggctcgccaaggaacatccgcgagtcgagctcgaagtcgccgagggcaccgcggcctcgctgcagcggcggctccagagtggcagtatcgaccttgcggtactgacgacgccgattcgctacgaggaactggtctttcgcgttctgctcgaagagcgctacgtcctggtcgcaccgcgctcccatcccctggccagcgaatcgacgctcaccatcgcccaagccgcttccgtgccgatgctggtcccgcccgtccacgtcgggttccgcgacgaactcgaggcgatcgcggcgagccggggcgtgcgcctgcgcgtcattgcggagatcgacggtctcaacgtcatcgccgccatcgcacttcgcggctttgcacctgcgatcctccccgcgagcgccgtcgaggtgctcgcccatcacgccgacacggtcgccgtccaactcaccgacgtccctcctcgccagatcggactcgcacgccaccgcaaccacctccagagcgcagcagctcgagcggtcaccacactcctcatgagcctcccgactcggatggcggcccatgccctgccggcaggcgtcaccgcccctcgaccacgaggagcggaggcccgacgctagcgcacgcttctatcaccatcgttataggagtatcgacttctacgcactcttccggggtgccatgtccggcccgtggcgtcgtggcaggatggagcggttcgttcctcggaggaggaacgctcgctgggaaggagcaccatggctgggatctgtgaaggccgggtcgtgatcgtgaccggcgcgggccgagggattggacgtgcccacgcgctcgcgttcgctgaacagggcgcacgagtggtcgtcaacgacctcggcgccgaggtcgacggatccggctcgtcgacagggcccgctggcgaggtggtcgatcacatccgaagccaggggggtgcggccatcgccaacggcgacgacgtcgccagttgggagggcgcgcagcgcctcatcaacgcggccatcgagtcgttcggtcgcctcgatgtggtcgtgaacaacgcgggcatcctgcgcgaccgcatgctggtcaacatgaccgagtccgaatgggatgacgtgattcgggtgcacctcaagggcaccttcgccatgacccgctgggccgccgcctactttcgggagcaagcgaaggcgggtgtcgcgcaagacgcccgaatcatcaacaccacgagcgcatcagggatctacggcaacgtcggccaagccaactatggcgccgcgaaggcaggcatcgcgtcgttgaccatcatcgcagcgatggaactcgcgcgctacggcgtcacggtcaacgcgatcgcccccgtagcgctgacccgcatgactgagaaccttggcatcgtcgccccggacgaccgtgcagcacaggccgaactcgcgccggagaacatcgcacccctcgtggtctggctcggatcgacgcactcggccggcatcactggacgagtgttcgacgtcgccggccaccatatcgacgtcgccgaaggctggcacgcgggcccaagcgcggaggcgcgcggccaacgtttcaccgtcgacgagctcgacgacgtcgtcccggccctcgtccgcgcggcacggcgcaacgccgacatgagcgggcacgaaccacccgaggcgcccaacgcctaagctccatgcatcgtgaccacgccccctgagcctgtgtatcgctcacggtcgatcgacttcgcggtgctcgagcttttcgccctcgtgagcgacgcgttctcgggtgcaaaggaggcgttcctccacgaagacaagggcatcatcgcccacctcgtcgagcgcgaacgcattatcgacggtcgatacctcgcactcgagcgtgaggtgcacgagcggctcttggccccggaccgcaccccggcgatggtccactacctcgtcaccattgtccgcatcatcccagagctggagcgctcgggcgacctcgccgagcacatcgcgcgcaagggtgcactcggcctcgtgcgcgagctccgaccccgtgcgcgaggtcttctcgaatcgatggccgagctcgcgctgtcgatgtggtccgagaccgcggtggcgttcgagcacatcgacccaaccgtggcgcgtcgagtcaacgacctcgacgagtccctcgacgacctccacgtcaccttcacggccgagatcgcgtcgacgtgccaatccatcgcgaccgcgatggatttggcgctcgttgctcggttcgtcgaacgcttcggcgatcacgccgtcaacttggctcggtcgacggcggcactcgccacactcgagagccctatccccaagggcgacttgtcgtccgcgtcgtgagcagccgctaacgaacgtcgagatcggctgacgagcgcgatcggcggcgctcttcgagtcgggcgcccagcgccgcgatctcacttcgatggtgcatgccgagcttcgacaggatgttcgatacgtagttcttgacggtcttctcggcgagaaagactgactcggcgatctcgcggttggtcttgccatcgacgatcagatcgaagatccggcgctcctgcggcgagagttccgcgagcggatcgtcccccgcatcctggggatgccggatgcgctcgaggagccgtaccgtcaacgcggggtcgatgagcgactcccctttggcaacgcggcgcagcgcatcgagcagctcgtcgacccggacccgcttgagcagatagccagatgcgcccgccatgatcgaggcgaacagcgcctcgtcgtcagcgtacgacgtcaacatcaggcaacgcagctctggtcgtgcggcgcgaagctcgcgacacagctccacaccactgccatccgggaggcgcacatcgagcacggcgacatcgggagcagccaaggggattctcgcccgcgcctcctcaagagagccggcctcgcccacgacctcaaagccgtcgtcctcagcgacgaggcgagcaatgcctcgacgcacgacctcgtggtcctccacgaggaatacgcgcaccacgccatctagcttatcgcgtggcgcggtcgtcggattggcacgcggccccgagcggctaggcccgacgtcgaacgacgaccaccgggatcggcgcgtggtggacgagttggtcactcacgctgccgagcagcaacgaggtgaagcccccatgaccacgcgcgccgacgaccaagagatcggcagtctcacactgctcgatcagacgtgaggccgggttgccctcctcgagcacggtctccaggtcaagatcgggttccagggcgcgcacctgcgcggtcgcgtcgtcgagcagcgcgcgaccggcggcctcgagctcttccacggcggagggagttggaccgtagccaaactccggcaccgtccacgagtacacgatcacgagcgtcgaccggcgtcgcttcgcctcgtcgacggcgaactgcagcgccgtgcgacccgactcggagccgtcatacccaaccacgacgcgccgatgctctgtgaatcctgcctccaccatcgtgtgcacctcctcgagctcagcctacgcaacggtcctggccaccgcatcggacgatagtcccaagtcgcagcaggccttggcactagcatcgaaccgtgagcatgcgggcacgactgcgagaccacgtcgcaagctcgcagcaagcccttgctcgggtcttcgacgagtcgagcgcgctcggatcgctgcggcgggcccatctcctgtccatgaccgccgacgccatgatgacggtcgcgttggctggttctctgttcttctccgtgtcacccaccgaagcgcgaagccgcattgccctctatctcctcatcacgatggcgcccttcgcagcgctctcgccgctcgtggctcccatcgtcgaccggtctcgtcagctccgccgatcgatggtgaccatctccgccgtcgtccgcattgcggcggtcctgctgatggcggcgttcctcaggactctgctgctgttcccactggcactgattgcgctcatcgcatccaaggcgtacctcatcacgaaatcatccctggtgcccgaggtggtcggcgacccgcaacctcgaacactcgtcgcgaccaacgcatcgctgaccctgttggcatccgtcgggggcgcactcggggtggtcgcaggtgggatcctcgccaagacgcctcacctcggtcccgcgtgggcgctcatcgccgaacccgtcgcgctgctctacatggttgcggccggtcttcgtcttcatcggatgctgccccaggcggtagccggagcgtcgcaggctcgcgagcggctacgcagccgccccaccggacccggatacgcgagaaccttgctcgcgtccctccttgtcgccgtacttcgaggtcagatcggcttctttgccttcgtcatcgcgttcgcgctcaagggcagatcggctccgacctgggcctacggagcagcactcgcagccagcgccatcggtgcgatggccgccacgcaggttgctccccgcctccgacgccgactctccgaaatccccatcaccctcggcgcggcgacactcgtctccctcgtggccatcgcggcaaccaccgcacatccagcgatcgtctgggccatcgtggtcatggggatcctctcactcgcagccgggtccgcgaagatcgccttcgacgcaaccgtgcagcagggtctgcgcgaagagcactacgggaggaccttcgctcgctacgagacggagttccagctggcatgggtcgtgggggctgccgcagcaaccttcgctcgcacgccgttggccagcggtgagagcctgatcgcgaccacggcagtggtcgcgctcgccgcctacgcgctcgcgaccactgcactgcgtcacgcccgcgagcctgagttgccaggcgaggggacatgacattcacctatcctcgcgtgcgaattggcggctgcgtgcatcgctaggatcgtgtcgtggatcgcggcctcgagagctccgtagcgagcccatggaggccagccctcatcgcggcgatcggcgcactgctggaaatcgccgtacaagtcatcggggtcgggcacggcaacccaggaatcttggcgctcgtcggaaccctgttcggatcgcgcgcccacctccccgcctggattccacaggttcgcgggcctggctacgacggacagttcttcttgcgcctcgcgctcgacccattcgacatccaccgccgagccttcggcatcacctttgacacgccgtaccgtgcccagcgcatcggactgcccttcctcgcctggctcatcgccggtggtcagcagcacctcgttgtgtggacactcccactgatcgaagtcctggcggctgcgtgcatcgccggatcggtcactgtcttggccggatccgaaagccgagccgccctcactggtgtcgctgccgccctctacgaaggctacgcgttcagctacggacgagatctcgccgagccggtcgcggcggcactcatgttgctcgcgattctctccatcgaacactgggaccggccaatcgttggcaccgtcctcctgcttgcatcgacactgaccctcgagaccgaactcatggcggttggcgcgctcggactcgtagggcttgcccgatcgctgcgcatgaggcgggttgaccatcgcctcatcgtggcaacggccgcggcgatcagttggatcggctgggacgcctttgtgtcgcacgaggtcggccacgtcaccgccgctgccgatctcaacgctaacttgggtgtccctctgctcacacaggtcaaggctgtcgccctgcacctccacccctccgctgccgacctggcgtggctcctccagctcgggctcctagtccttgccgtcgcaatcacgatcccgaggatctcgcgttcgcgtgcgccctcggtgatcaaggttctgttcatcgccatgatcgtgctcgcactgctggtgggtcccgctgactgggacgtcgaaagcgggtttcgccagttcgatctcgtctggatttcgagcctgatcgtcatcggcaccaccgacaatccgccggcctggcttccagcgctcggcatcgcggcgtggatcggcacggttcacctcgcggtcaacaccactgccttcctgcgccgtctctagcgagtacacgagaggcggcccgccggtcttgcctgaggcatgaccaattcggtagagtcacaccattcgcaccagcggtcgactagcgagtccgaggtgcggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccgaagaaggcgaagactgcttgcaagttctcgcagacgctcggccgcctgagcttcgtgagagaggacgccgcgcccgtggcgctcgacgagggcatgtgcaagcgcctcggcaacgcgcgggcgcgggccaaccaaccagcgcggatccgaaccttccaacaccgcgctgacgagcgcagtcatggacgaggagtcggcccaggcagcatcaccgagatcagcgatgaatcgacgctcgtcgcccggcgaaccttgtggtcccaatgcgagggtggccgcaaccgtcgcgccccgcccgcgggccagctctgccgcgatcttgagcgcatctcccgggtccaccgcatacgtcaggagaaggccaactggcgccctcagattggccggtagtgcctcgagcaaacgacgcataccctcgctgggccgttgcccgaccaccagcgccccgtcaacccagccggcgacaacgatcagatcggcgtcgacgaggtcctcggtttcgaactgatcggcggggatgcagcgcacgcttggcgcaaaattcgcgagcgtctctcccagggaaagtgccgccgcgcgggtgtggccacccttggagtcgtaggcaatgagcacccgtggcggagccagtcgtcgaccgggcaacaccgcgttgcgaccgcctgcggcgagcatctcctccccgacccggcgcccgtgagccatcgcctccaccaccgttgacggtccgacgaggacatcaccaatggcccaggtgcgggcctgccgccacgctgccgctcgcctccgggcccgatcccggctccaggcgagatcaccgacacgcaaccctcggagcggctcacccgcgaagatccctgaggccaaccagtgtcggctcggcagatctccaacttccttgcgttcagcgagcccaggcaccgaagcgatccaggacggatcgacgcgatagcccatcgcagctaccactcgatcgaccacgagctcctcggcgatctcactggtcaccgtaggccgctcactcgcgcgctcctgcttcgtccgaacgaggagacagtggatcccgtcgtcgcgttcggcgaccgactggagcgtcacgccaaatcgcacctgtacgccctcggcctccgcttcggcaagttcgtcaggccgcacaaggctgaagcgctgatccatccaatcgatacagactgcagagccaccgcgccgtcgcaccaggcgcgcgacgtccatcgccgtgttgcccgccccaaccacgagcacacgatcatccaccggcggcaaaccagcttgaatcgccgcctcggccacggcgatctcgtcgagtgcgttgccgacagagatggtctcgatgccatcggcgcgtacgggcaacggagcgccagcaccaacggccagcaccacggcgtcgtagcggttacgcgccgccaccacatcgtccggagacagcgcggtgttcatctggaaagccacgcctcgccgctcgagacgctcgatgacccgatcgagaacgtccgagggcagcgtgaaccgcgggatcccgttgcgcagcaagcctccaggttggtcggcagcgtcgaccacggtgacctcgaccccggctcccgacaggacatctgcggcaccgagcccggccggaccgctcccaacgatcagtacgcggccctccttggcagccggcgtcgggtcgaccgcatcagcatggtcagcgatgtagcgctcgatggcgtggatcgccaccggcctcgctccggcaagccgccaggaacagctcccctcgcattggatcgccgcatcacagacgcgtgagcagatctcgggcaacgatgtatgtgcgctcagcacgtcacgggcaccggcgagatcgccactacgcagctgagcgatgaactcggggatgtcgttgtgcgtcgggcagcctcgcacacacgtcgggtccggacacgccaagcagcgattggcctcttcgagcacgtccgcaaagctcgcgaatccgccgcgtacctcgtcaaggccgcccagggccacgtctggatccaactctggcaagacagcgcccggcgcaacctgcggatcacccgcgacgacgatcgcatcgaacggacagacccgctcgcactggcggcacccgacacaccgtgcgctgtcgacagtgacgacgtaacgatcgaggtcgagatcgatcgcctccaccggacaacgaatcagacactcttgacacccggcacaccggtcggtgagcacctcaacgacaacagcgctcatgttcaaccctcctaggacgctccgtgcatgatgacgtacagccatccagccacggccccgaacacgacgacgagcgcaagagcagagagcttggcgacggcacgatgacgcacgatcgacgcgagatcagcgtcgaagatgcgcgccatggcccagaggccaccgacgactccgagcgccatcacgccgacctggacctcgacaatttgcgggatcgccagcaggtggtccgacagcaagctccagtgctgcgtgttgacaccgaagatgccgacgatggctgggatgaggctcgggatgtgcttgaagaacttcggcagctggcgtgcgaagtagtccatcccgacaactgggatgaggccgtaggtgagcggcaggaacacctgacggaacggagtgacgcggtcgagccgactctctgcggtgaccgtccgccgtgcagccggatcgagaaaggctcgaccccacgcccagatgatccctgcagttgcgagagccaccgcggcgatgatgcccaggtagtcaatcgggttcgggtaggccggccacccagtcgcgcgattgagcgtggcatcgatggagctgtagacgtcggtcgcgttgaactgctggaagatcacgaggccccacaagatcgcgatggcccaggcaaggtcccaacggcgacgcttcggcgcgaccacggaggtgagtggcgcctgcaggaagagtcccacattgttcgaggggcatgccttgtagcactccgtgcacagtccgcaggcggcattcgactcagccgatcccggccacgtgaaccatggacagccataaccggacgcaccgccacgcatgcaatccttggtggtgcactcgaggcacgtctcgcggtcgaccgttcgaaagcccgcgaccgagcccatcgacccgacggtgccgatcaacgccgagagtggacacaggtaccggcagaagctccgccgctcgaagacgaggaacaccgagaccgccgtggcgacgataccgagcaccatgatggctgtgtagcgaggcacccccggacctgcgatgttgaagtactcctcgatgaaggtcagcagcacgaaggtcgcgacagatcccaagaagccgtactcggccagccacggaggcaccgggcgcccgagaccgatcgccgagtgcagtcggcgaaagaaggtacgacgctggatccactccgcgaagccgccgaaggggcacatggagcaccacgcgcgcccgaccacggccatgagcacgaagacaacgcagaaccacaggtaccacgtgatcgcggtcgcaaagttcgtctggggatcgacgacgccgacgaagcccaggacgatcaccagccagaagatgatctggttcggcagaatcaagaggaattgggtggtccgattcgcggcgaggcgggcgatgataccccgacgtgccacgttggcacgtggcgacggatctgatcgctcgaatcgatcctggcccggccgatgcggcggtcgcaatcgcacgaccacctgatcatcgagcacggtctgcacatgcgggggcttggtcgtagccatctcgctcctcctttggcaccgcgccaatgattagtcattgactaatcgttactgtagccatgcccatacgtggtgtcaagtcgcgactacgatcggacacgtggacctctcgctgtctcggcgtggcgactatgcggtacgtgcagcgctctaccttgcgcgccaggagtcgaacgaggccgtcggcgtgcgcgagatcacggccgcaatggcgattccaccgagcttcgcaggccagatcctcgcggacctgacccgcgcaggcatcctcggtgcgcggccgggccgcggaggcggctattggctccaacacgacccgaaggacatcaccctcctcaccatcgtcgaagcagccgagggcaccctccgcgcggaacggtgcgcgctcggggatggaccatgccgttgggacagcgtgtgtccactccacaccttctggcagggagccgttcgagccgttcgcgatcagctcgccaccgtgacgctcgccgacgtccgagacgcggacgtcgccctcgaacatggggttgccccgccgcccgatgcccaccgccacgccacggtcaccaaccttgccgagacgatcgacgtcgaggcacccgcagacgaggtcgaacgacgcttgcgcacgctgacgtccgacgatctcgccaaggcgatcgcgcatcgcctgaaggccgcactcgacctcgacctcactctctgcgaactcgcccatccaggccgtcgcctcgtcgtcgaggtgaacgaccccatcggccagacggcgagagcagagttcgatctcaccaccgagccggcggatcccctgcgcaccacgctcactgcggcgatcctctggcgcggtcggctcgaggacccacgccctagcgttcgcgcgatcctgacggcgacggcaagactcctcgaggacgcgcgctgatgcaccgctcacagacgccgtaggcctcgacctggtgatacaagactgggccaggcgcgtcgtcgatcgtgatcgcctgacacgaggccacccgaacctcgaagatctccccgcacgacacgcagtggaagtggtggtggtgcgacgcgtagggcggcaggagctcataggcgatgtcgtcaccgatggtcaccggttggacgatgccagcctcggcaaacgccgcgatggttcggtaggccgtcgccgacccaacgcccgcttctgcgagaacgtcgaccaactcggccctcgtcagcggacgccccgcctccgccaacacgcgaaacaccgcacgtcgctcatcggtgacccgcaacccgcgttgtctgagtgcaccctcgaactgcgtctcagccatcgagctgctccgtccgaccgggctcggcactcggagccgcatcctgctcgccagcgcgcgagagcgagcgggcccgacgcgcagcgtgacgagtctcacggacgagcgtcccgatcccgacgacgacgacggcgaagatgacgagcacctgagcgatgccgatgttgtgaaggttgtgcacgtggagcggtgtcaccaggtgaaaggagagaaggttcgggaatgcgagtccgacgacaccggcgaccacgaacgccacacctccccacaacagcgtgcgcccagcggtgaccagtgcgacggcgcgaatctgcgcctccgtcaacgacaggtgtcgagcgacggcaccgaagaggccgcccgcgaccgcctggaccaccgtggtgcccaggccgaaggctgcaccaggcgcccaaccgagccacacgggcatcgctggcgcgagcacggtgtagaggatgagagcaaacgccccgataccccagcctgcgatgaaaccgtgcaccgcgggcatccatggcttcatggtgacgtcgggtacaccgtcctcgacgtgatgggccggcgagagcagatgccagtgctcaccgcggaacaagtaacgtgccgccagcgccatcgccagcccgacggcgacgtagacggcatagtccagccagggcgtgtcaacgaagaccttggcgagcgccaggttcgcaagttcggacgcgatcgcacgctgcacggtgaacgcagccgagaacgtcaggccggcgacgagaccgcgtcgactcgagtagctgccgatggcgtacgagaacgtgatcggccacgtgtgctcgtcgggggtgatgccatgcacgatgccgagcgcgaacgcgagtaccagcgcaccgccgatcgtcgccaccccagccgggttccacaagttcagcaccgcgagcagatccacgacgacctcctgtccgtgctacacatgatagcaattctcacttagtgttgacacgcattctcaacaacgaggcggccgtcccattccctgaccgcgcgcgctagccttcccctgggacgatgtgtgcacgtgcaatcgtgggcgcggcgctcgactcggctccccacgcaccccggatcgtcaacggaaaggatccatgatgcgctatcgccatctcggccgaaccggtctcaaggtctccgaactcggcttcggctcctgggtcaccttcggaacccagctcgacgtcgggcgcgcggccgacatcctcgccgccgccagggaagccggcatcaatctgttcgacaacgccgaggcctacgccggaggcgagtccgaacgcatcatgggacaggccatcgcgcgactcggatggccacggtggagctacgtcgtcacctccaagttcttctgggggatccacgacgacgtgaacacgcaccacaccctcaaccgcaagtacctcgtcgaggccgtcgacgcgtcactcgagcgcttcggcctggaccacctcgacatcatctactgccaccgaccggaccccacgacgcccatcgccgagacggtcttcgcgatgagcgaactcgtcagcgcacacaaggcgcactactgggggaccagcgagtggagcgccgaggaaattcgccacgccatcgacgtcgcaaccgccaatcacctccacgctccggtcgtggagcaacctcagtacaacctgctcgagcgccagcgcgtcgagcacgaatacgcccgcctgctcgacgaggaaggcatcggcctcaccacctggagtccgcttgcgtccggcttgctcaccggcaagtacgtcaatggggtgcccgcgggatcacgagccacgctccacgggtacgagtggctccgtgatctgctcaccgacccgggacgccaagccgtcgtgcgcagcctgctcccgctcgcgtcacggctcgaggtctcgctcgcccagctcgccatcggctggtgcctcctgaatccgcacgtatcctccgtcctcctcggtgccacctccatcgatcaactcaacgagaacctcggagcactcgaggcccgagaccgtctgaccccagcggtcgtggacgagatcaacgcgatcctggcggagcacgcctgagcggaccaccacgtctcggacgtgcggtcgctgcggcggccctgttcgcaaccgcacccgcgctcacgcaacgcgcagacgcgctggcgggaccgggtgcggtcctcggtatgcgagccatcgtctcggtcgcggccctcgtcgtgatcgggctgccgcgggtcaggcacctcgctcctaccgtcgcagccggtgtcgccatcgtcctcggctactacggcgcgaccaccctcggctatgccatcgccccggcgacaatcgcgtcgctgggtttggcgagcgaaccgctcgtcgtcggtctcctcaatccccactggttgcgctcgccgcgcaccctcgcaacggtgacgctcgcagtggcggccatggtgctgccggtcaccgcggcccacgcagggacccatcatgtggtagctgggatcggactggtggcgctcggcggcgcatgcttcgtcatcggagctcgtctcctcccggcaagcgcgacgccgcgcgacgccgtgcggacgaccaccttcgcccaagccctcggtgcgatcgtcctggctgctgtgctcgccggaaccggtcgctttgccgtcgcgaccacgatcgagccctggctgctcgtcgcggtgctcgtcgccggctcctccctggtcgggatcgccctctacgtcggggcggctcgcgacgcacctgccatcgcggcctcgagcctcagcctcgtgccaccgctcggagccgcccttgcctggggcgcgcttggcgatccgatgacctggcaactcgccctgagtgccatcgtggccgcgttggctgtctacctgggcgcacgtagcccgaccgttccgtagtacctggcggtaggatcgcaggtgtgtccaccgcgtggaccttcggagcagccgccctccgctacgacactctacgaccgccgtaccccgcggcgaccttctcaacgctcgagcgcgcgatcggatcctacgagggctctcgagtggtggaggtcggtgccggaaccggcatcgccacccaggggctcgtcgctgcaggcgcggacgtcctcgccctcgagcccgatccaggcatggggcgcatcctgcgtcgacgcctcccgaccgtacgcatggtccccgccaggctggaggacgtcgacctcgagggcgtccacctcctcgtcggctttcagtcgctccattggataccggtgcgagccttgtggcgcgctgcccgtcgagccctggctcccggcggcgttctcgccggcgtctggcagctcgccacgctctccgatgtccgagcggcccacgcgatcggcgaggtgctcgcgagattcggcgtggaacgctccaggggatccgaccagcgcgtcagcgacaccatcgaggcactgagcgaccaggcggtgcacgggttcgcacccgcgatgcgctgcgagctcccttggcacacgcagcgcagtgcgacaagctttgcaggcctgctcgcaaccatgagcgacctgcttgcactcggtcacgaaggcgccgactgcgaggcgcaactcgctgaggccctgaggccgtacgagccgatcgacgtgcgctacgactgcgtcgtgatcatgcgtcagcggatgccctaaggtgacggacgtgctctccccgttcacccccgtcacgatcgatcgaacccgaaccgagttccccggtatcggagcggcctggcgcgcgcacgcgctccggatcgacgatcgcctcggcctccatgcgctcgctgcaatcgccgacgacccgcagccagctgcgcacggaccactcgcaggcgtgccggttctcgtcaaggacaccatcgacactgccgatctctccacgacggccggctccctcgtcctacccgaagagccccctgctactgacgcctggatcgtggatgcgctgcgcgccgctggtgcgaccatcgccgccaagaccacctgttcagagtgggcgaactttcgcggcgagggatccatatccgggtggaatgcgcgctacggactcgcccgtaacccctacgacccgacgcgctcggctgggggctcgtcgagcggctcggccatcgccgtcgcggctggcatgagcccgatcgcgatcggtaccgagactgatgggtcgatgctctgcccggcatcgctcaatggtgtcatcgggttcaagactgctccgaagcgcctcgaccggagcggcgtcatcccgatctcgtcgacacaggactccctcggcatcttcgccacgagtgccgacgacctcctcgtcgtcgcgagcgtcctcggcatcgaagccaccaccctgacagaacctgtccgactctgcgtggtcgaggagtccctcaacggcttccatcctcgtacgctcgcacgctttcacgacgtcctcgagctgctctcgcgcgcgggcgtcgacgtcgtgacgctgagcgcaccgccgcgcggaacgctcgagccctccgatgaggacgagctcatcgtgttgcgcaccgagctgcatgtcgagctcgatcgctacctcgatcgtcgcgccatccccggccttcgctccctggccgacgtggtcgcggcgaacgacgcgctcgccgaccgagagctcgcctacttcggccaagagcacttcgtggcggcactcgaggccgacccggccgatcccgcctaccgggccgcgcgccaacgcaacctcgagcgcacgaccgaaggaatcgagtcctcgctcgccgcgacggacgcactcgcgatcctcgcaccaaccatggacgtcgcgtggcccatcgatctgctccgcggcgaccccaactccccagctggctatcgagccgccgcagtcgccggcgggacttcggtctccgtcccggcaggtcgcatcgggcacctccccgtcggcgtgtgtctcagcgcgccggcaggtcacgaggaaacgatcctcgagctgacggcgctcctcgagcgcgctctggccccactcgcgggcctcgcgggacgcgagaggcccacgacgctgttgcccgaagcgtgagcgccaccatctcgatcagtcgccaagttcccttccgtgccgatcgcgtgttccgggaactcgccgcgctggaacgacaccacacctggatggcggatgcagaagcggtcgagatcgtgagcgcccaacgccgcggcgtcggcgtcgagatgatcgcccatactcgcatcggcccgctgcgcacagccgaccgaatggtggtcgtcgactgggacgaaggccgtgccatcggcgtccgccacgtcggactcgttcgcggagtcgggcgtctcagcgtccaagccgacggtcccgaccgtgcgcgagttcgctgggacgaagagctcgtcttcccaggcgggcatctcggtgagctggcagcacacgccgcacgaccagtcctcgagtggatctggcgaggcaacctcgcccgcctcgaggccgcgatcgcctcggcagggcccattacgctgggcgctccgtgagtacgacggcctcgaactccatcgccgcacgctttggcgcgctcgcgcgccacgccgtggccgacacgccgtcacgttccgaggacgtccacctcgaccgtgacgtgatcgcggccatgctcggcctggaggatgagccggaagcgctggttgcaaccgttcgactcgagggccacactgcacgtttcgcaacgcctcgcaccccgctccccccgcgtctcagccgcctcctcgccgagaacccgggtcagctctacacgcaccaagccgccgtcaccgaccacgccctggcgggccaccacgtggtgctcgccaccccgaccgcgtccggcaagtccctcgcattcctcgtccccgccctcgctcgcctcgagcgcgatcccgcagccaccgttctcgccctctatcccacgaaagcactcgcgcacgatcaactggcgcgcctcgtcgagctcgagcgagcgctcggcatcgacatcgcccctgccgtctatgacggcgacaccccggccccggaacgcgctcgcatcaaggaccgatcgcggttcgtcgtcaccaacccccatggcctgaacctctacctcggatggcacgaaggctgggagcgcatcctcgccaacctggcactcgtcatcgtcgacgagacacacgcctacacgggagcgaccggcggtgcggtgggctggttgctccgtcgactccagcgtctcgccgaggcgcacggtgcggcaccggtctacgtgggggcatccgggaccatcgccaatccggccgagcacttcgcacgactcatcggcgatgacgtcgtcctcgtcgatgacgatgggtcggcccagccgacacgcacgatcgccatcgtggatgcaacacgatctcccgatcacgccccgatcgctcaggccgcgctcctcgtgcgtcggctcgtccgccaccgccgccacgtcatcgccttctcgaactcacgatcgcacgccgagctgctcgcgagactcgcgaccgatcgcgcggtccgcgtcgaaccctacagggcagggtacgcggcccaacggcggcgggcactcgaagccgacctccgagccgggcgccttcgcgccatctcagcgacgagcgccctcgaactcggcatcgacgtcggcgtcatcgacacggtcgtgctcaacggattcccgggctcgatcgcctccctcttccaacgcatcggtcgagccggacgatcgggccaggacgcactgggcgtcgtcgtgctgggggccgaacccgccgcccgagcgctcatcgccgatccagaggagttcctcgtccgcccgcccgagctcgcggtcgccaacgtcgaccagccctccgtggtccggcgtgcgctcgagctcgctgcggccgaacgacccgtcacccccgacgaactccgtcactggggcgcgcccgcacgcgacgctgccgccgcactcgtcgaggctggcacgattcggcacgacgccgacggccttcgagtcccgggccgccgcccgcatcgcttccgaccactggtcgagatggagccgacgtggcgcctccagttcgaggggacgcgcaccaccatcgcgccagagagcctgtcggagagtcaggcactgcgcgaggcctatcgcggtgccatcgtgctgcatggctcgcagccctaccgcgtcgtccgggtcgactacgctgcgcgcgtcgcggtcgcacgaccagaacccgaccgaggccaccacacccaagcagcctggtatcgcgcgatcgctccgacgcgcgtacggtctcatgcgatcgcggggtcgctcacgttggacctggccgatgccgtgctcgtcgagcaggtcacctcagccaaggagttccggggatcagtgctcgtccaccaacgcaaggtcactgccccctcacgttcggtcgcgggcgaggccttgatcctctcgaccaaccaactcgtcgatcccgccgaacttccagccctccacggcgtcgagcacctcctcgtcaaggcgctcgcgccgcttgccgtcggcgcaagcgatctcaccacgctgacccaggccacgccggcaccgcagatcctcttcttcgcgcccgatgcgctgggcggcggcacgatgcttgcgacggtggctcgccagctcgatcgtgcgctcgccgtgtccgagcgcatcctcacgacgtgccgctgcaacgatggctgccccttctgcaccctggacgctcgctgcgacggcgacgttgccgccaagtcgctcgtcctggacgtgctcgtgcgcctgcgcgaccaccacgcgcggcacgcttagcacaatccggcgcgatgcgcctcgcacaggtccgcgagccggcagccggcgcacagtggccgcctcgccgtgcacgtctcccgaccgtgcaggatcatgcgcaacgagaaggtcccccagcgcttcggtgccaagaccgcacagagctcctgttcgatcccctccggggtcgacgatcgggcgatcccgaggcgacgactcacccgtttgacgtgcgtgtcgacggggagccctggcaacgagaagccgaccgaacgaacgacattggccgtcttgcgtccaaccccgggcaagctggtcagctcctcgagtccttggggaacctctcctccgaagcgctcgacgatcgcagctgccagcgcgacgatgtgacgagccttcgttcgatagaaaccggtcggacgcaccagcgcctccacctgctcgatcggagctcgggcgagagtctcggcgtccgggtagcgagcgaacagtcctggcgtcacgaggttcaccgcagcgtcggtggtctgcgccgacaagaccgtcgccacgaggagctgaaacggggtctcgaagcgcagggcacacagcgacaccgccgtccctggatagagctcttcgagtcgttcgtcgaccgcgagagcccgtcgggtttcgtcctgcaccgccaacctccccaccgctagcctagagacgtgcacgcgctcacgacggtcgagaacccgtctgcgcgcctgctcccgggggtgcttgcactcatacgcgatgtcgaggcagccgacggccacgaggtactcgaggctcatcgctggatcgacctcgccaacgcggacgccgagagcctgcacgggatcgcggtgacgctcgacgacgacaccgtcgtcggctacgtccacctgcggcggcaccaccgtcacgggatcgagctcgagctcttggtcgcgccagaccaccgcgacgaggccgcgagcatcgtcggcgcgctcgtcgaggccgcgagcgcgagtctcgagaccctcggcccccacgagatcttcgcctgggtacccagacactctcgacaggtcatcgatgccctcgagggcctcgggttccgtgccgaccgcgcggtacggcagctccgacgtcccctcccactcgagtcagaccacccggcacggccgattgactgcccgccgtttcggacctttcgtcccggcgaggacgaggatgcgtggctcgaggtcaacaatcgcgccttcgcatggcatcccgatcaaggcgactgggatctcgagaccctgctcgctcgtgagcgcgagagctggttcgacccagctggtttcctcctggccgaacaggacgggcgcctcgtgggcttttgctggacgaaggtgcatgcgccgcgctcgtcgtcagcgctcggcgagatctacgtcatcgccaccgatccagaacgcgcgcctcgcggacttggctcatgcctgctcgtcgccgggttggactacctcgcccaccacgacatccccaccgcctcgctctacgtggaggacacgaacgaacgtgcactccgcctctatgaccgcttcgggttcgtggtcgatcacgaagacgtccggctcgtgtggcgtctcccagcagcgtcgtagactcctcgacgaggaggatcaatggatctgaaggaagcgttcgtcggtggccccaggttcctcgacaccgcgagctacggattgccaccccgtcgcgaggtggccgcactcgaacaggcgctcgctcggtggtcgagcggcacggccgattggtacgacgagtggctgcgcgcgacggatgtcgcgcggggccaccttgcgcgcctgctcggcaccgattcgaccgcggtgaccaccggtccgaccacctcggtgctcgtcgccctcctcgcaaccaccgtggagccgggcagtcgcgtcgtcgtgccggacatcgagttcacctccaatgtgttcccctggcttgtgatcgctcaacgcaggcagctcgatctgcgtttcgttcccgtcggatcgctggcacgtgcaacggctgagggggccgacgtcgtgagcttctccctcgtgcagtcggcgacgggtgaggtcgccgatctcgacgccatcgtcgatgccgcggagtccgtggacgcacgcgtcttcgtggacgccacgcaagcgctcgggtggcttcccgtcgacgccacccgcgtcgacgcggtggtcgtctcgggctacaagtggctcctcgctccgcgcggcgtcgcggccatggctacgagcgaccgtgtccgtgcttccatgcggatcgttgccggcttttcccatcaggcctcccgagcggaaatggggaagaggcggacctccgtccccaccgcctcggccagtacacggcgagagaagtgctcgatcgcggcggtgtcggcttcctgcaggatgtcgatcttgttcaacaccaaaaagatacggccggcgtacttccggacctctcatggaggaactccagttcggcctcactcaccgcctggtcggcggagaggacgaacagggcggcatcgcactgcggcacgcgcgcccaggcggtgtcggtgttgtggcggaacaccgagccgacgccgggtgtgtccacgatgcgcacgccattccccaggagcggcgagggcgtccggatcagacttcccgcacgcccttcgcgttgcccgggttgcccggctcggtgatgtaatccgcgagcatatccggacggatgtcgaaggggctgccttccagcggctggacggtgatccgggggggatagccgtaggcgagcacggtcaccaccgaggtcagcggcaccgcccgcgtgggcagcaggttctcacccagcagcgcgttgatcaggctggtcttgccccgtttgaactggccgaccgtcaggacgtcgaaatggccggcctgcagcttgtcacgcagggcgagggcggggcgcagagcggcggggaggcgtccgccagctcgtcgatcaggctcaggagttcggttttgagatccgcatagccggtcgttggcgcctcaccggcgatcggccaacgggggatcgcgttcattccgcagtggtcggatcgatgacggtgcggatttcgttgatcgcatcggcgggaaagccgccttccagtgcgtgctgtaccagcgtggcggcgtcgggggcaatgtagacgcagtacaccttgtcgtcggtgacatagctctcgatccactgaacctgcggtcccatggcgttgaggatcgaacaggattacgggagatctgccgcagttcgtcgcgcgacaggtttccggcggccgcgaatcgtgcgctctatgacatatttgggcatggttatcagccttacggttctggtaaggaaaaaataggcttgtattgtgcttatccgaagataagcgctttccgcgcagcccgattctttcatggatcacgattccattgaatgcggcgaaagtctcagggtccggtcatgaatgaagagttatggcggcccagtacgtcaccgttatgtccgatggctgtatcaaacaaagacacgtgtagtgatatcggacaactcgtccatccccgtcggagcattcggataacgtgctcatcgttccaaaatattgatatacggtatacgtatccgaagaataaagttggcacgatccctgtaactaggttgtcacgacctcgtcggaggttgtatgtccggtgttccgtgacgtcatcgggcattcatcattcatagaatgtgttacggaggaagagccgctgtacgccaattggtacgccggcgaacccattccgacctcgctctacggaccaccgctgcgactggctccggatgcgcggcgcttcgacccctcgcctgcgtggttctcctgggtcggcgcggtcgccgcgctggaactcctcgacgaggtcggcatcgacgcgatctgggcgcacgacaccgacctcgccgccgccttccgcaccatgctgggtcttcccgagcccacggtcccaagcgcgatcgtctcggtggcgctcgatcgagcaccctacaagtaatggcacttagcaccgcaaccaaggccgcgacggacgcgctggctgccaatcgggcacccaccagcgtgaatgcacaggaagtgcaccgttggctccagagcttcaactgggatttcaagaacaaccggaccaagtacgccaccaagtacaagatggcgaacgagaccaaggaacagttcaagctgatcgccaaggaatatgcgcgcatggaggcagtcaaggacgaaaggcagttcggtagcctgcaggatgcgctgacccgcctcaacgccggtgttcgcgttcatccgaagtggaacgagaccatgaaagtggtttcgaacttcctggaagtgggcgaatacaacgccatcgccgctaccgggatgctgtgggattccgcccaggcggcggaacagaagaacggctatctggcccaggtgttggatgaaatccgccacacccaccagtgtgcctacgtcaactactacttcgcgaagaacggccaggacccggccggtcacaacgatgctcgccgcacccgtaccatcggtccgctgtggaagggcatgaagcgcgtgttttccgacggcttcatttccggcgacgccgtggaatgctccctcaacctgcagctggtgggtgaggcctgcttcaccaatccgctgatcgtcgcagtgaccgaatgggctgccgccaacggcgatgaaatcaccccgacggtgttcctgtcgatcgagaccgacgaactgcgccacatggccaacggttaccagaccgtcgtttccatcgccaacgatccggcttccgccaagtatctcaacacggacctgaacaacgccttctggacccagcagaagtacttcacgccggtgttgggcatgctgttcgagtatggctccaagttcaaggtcgagccgtgggtcaagacgtgggaccgctgggtgtacgaggactggggcggcatctggatcggccgtctgggcaagtacggggtggagtcgccgcgcagcctcaaggacgccaagcaggacgcttactgggctcaccacgacctgtatctgctggcttatgcgctgtggccgaccggcttcttccgtctggcgctgccggatcaggaagaaatggagtggttcgaggccaactaccccggctggtacgaccactacggcaagatctacgaggaatggcgcgcccgcggttgcgaggatccgtcctcgggcttcatcccgctgatgtggttcatcgaaaacaaccatcccatctacatcgatcgcgtgtcgcaagtgccgttctgcccgagcttggccaagggcgccagcaccctgcgcgtgcacgagtacaacggcgagatgcacaccttcagcgaccagtggggcgagcgcatgtggctggccgagccggagcgctacgagtgccagaacatcttcgaacagtacgaaggacgcgaactgtcggaagtgatcgccgaactgcacgggctgcgcagtgatggcaagaccctgatcgcccagccgcatgtccgtggcgacaagctgtggacgttggacgatatcaaacgcctgaactgcgtcttcaagaacccggtgaaggcattcaattgaaacgggtgtcgggctccgtcacagggcggggcccgacgcacgatcgttcgatcaacctcaaaccaaaaaggaacatcgatatgagcatgccgacctcacgacgaagatctcgttccgcgacggccgcgctcgcgtctccttccacctctacaacgacctcgccgacgccgagacgctcgcagccgagcttgcccccttcggcgtccagcgcccacgtcggagctgatcggccggctcgaccgtgccacgaccgagccaacaccagcgcatacgagcacgcacgggcatcgtgcactgccttaggagaaagacgccgcggtctgaccgatccggaaatggcggccgtcattttgaaggcgcttcctgaagctccgctggacggcaacaacaagatgggttatttcgtcaccccccgctggaaacgcttgacggaatatgaagccctgaccgtttatgcgcagcccaacgccgactggatcgccggcggcctggactggggcgactggacccagaaattccacggcggccgcccttcctggggcaacgagaccacggagctgcgcaccgtcgactggttcaagcaccgtgacccgctccgccgttggcatgcgccgtacgtcaaggacaaggccgaggaatggcgctacaccgaccgcttcctgcagggttactccgccgacggtcagatccgggcgatgaacccgacctggcgggacgagttcatcaaccggtattggggcgccttcctgttcaacgaatacggattgttcaacgctcattcgcagggcgcccgggaggcgctgtcggacgtaacccgcgtcagcctggctttctggggcttcgacaagatcgacatcgcccagatgatccaactcgaacggggtttcctcgccaagatcgtacccggtttcgacgagtccacagcggtgccgaaggccgaatggacgaacggggaggtctacaagagcgcccgtctggccgtggaagggctgtggcaggaggtgttcgactggaacgagagcgctttctcggtgcacgccgtctatgacgcgctgttcggtcagttcgtccgccgcgagttctttcagcggctggctccccgcttcggcgacaatctgacgccattcttcatcaaccaggcccagacatacttccagatcgccaagcagggcgtacaggatctgtattacaactgtctgggtgacgatccggagttcagcgattacaaccgtaccgtgatgcgcaactggaccggcaagtggctggagcccacgatcgccgctctgcgcgacttcatggggctgtttgcgaagctgccggcgggcaccactgacaaggaagaaatcaccgcgtccctgtaccgggtggtcgacgactggatcgaggactacgccagcgcgatcgacttcaaggcggaccgcgatcagatcgttaaagcggttctggcaggattgaaataatagaggaactattacgatgagcgtaaacagcaacgcatacgacgccggcatcatgggcctgaaaggcaaggacttcgccgatcagttctttgccgacgaaaaccaagtggtccatgaaagcgacacggtcgttctggtcctcaagaagtcggacgagatcaatacctttatcgaggagatccttctgacggactacaagaagaacgtcaatccgacggtaaacgtggaagaccgcgcgggttactggtggatcaaggccaacggcaagatcgaggtcgattgcgacgagatttccgagctgttggggcggcagttcaacgtctacgacttcctcgtcgacgtttcctccaccatcggccgggcctataccctgggcaacaagttcaccattaccagtgagctgatgggcctggaccgcaagctcgaagactatcacgcttaaggagaatgacatggcgaaactgggtatacacagcaacgacacccgcgacgcctgggtgaacaagatcgcgcagctcaacaccctggaaaaagcggccgagatgctgaagcagttccggatggaccacaccacgccgttccgcaacagctacgaactggacaacgactacctctggatcgaggccaagctcgaagagaaggtcgccgtcctcaaggcacgatggatcgggttgccccgttgcgatcccagcaccacgagagaggtccgcgatctcggcccggcaggtccgcgccttcaacgaggtggacttccgtcataagaccgctttcggcgaggatgccaagtccgttctggacggcaccgtcgcgaagatgaacgcggccaaggacaagtgggaggcggagaagatccatatcggtttccgccaggcctacaagccgccgatcatgccggtgaactatttcctggacggcgagcgtcagttggggacccggctgatggaactgcgcaacctcaactactacgacacgccgctggaagaactgcgcaaacagcgcggtgtgcgggtggtgcatctgcagtcgccgcactgaagggaggaagtctcgccctggacgcgacggcatcgccgtgaagtccagggggcagggatgccgttccgggccggcaggctggcccggaatctctggttttcagggggcgtgccggtccacggctccccccctccatctttcgtaaggaaatcaccatggtcgaatcggcatttcagccattttcgggcgacgcagacgaatggttcgaggaaccacggccccaggccggtttcttcccttccgcggactggcatctgctcaaacgggacgagacctacgcagcctatgccaaggatctcgatttcatgtggcggtgggtcatcgtccgggaagaaaggatcgtccaggagggttgctcgatcagcctggagtcgtcgatccgcgccgtgacgcacgtactgaattattttggtatgaccgaacaacgcgccccggcagaggaccggaccggcggagttcaacattgaacaggtaagtttatgcagcgagttcacactatcacggcggtgacggaggatggcgaatcgctccgcttcgaatgccgttcggacgaggacgtcatcaccgccgccctgcgccagaacatctttctgatgtcgtcctgccgggagggcggctgtgcgacctgcaaggccttgtgcagcgaaggggactacgacctcaagggctgcagcgttcaggcgctgccgccggaagaggaggaggaagggttggtgttgttgtgccggacctacccgaagaccgacctggaaatcgaactgccctatacccattgccgcatcagttttggtgaggtcggcagtttcgaggcggaggtcgtcggcctcaactgggtttcgagcaacaccgtccagtttcttttgcagaagcggcccgacgagtgcggcaaccgtggcgtgaaattcgaacccggtcagttcatggacctgaccatccccggcaccgatgtctcccgctcctactcgccggcgaaccttcctaatcccgaaggccgcctggagttcctgatccgcgtgttaccggagggacggttttcggactacctgcgcaatgacgcgcgtgtcggacaggtcctctcggtcaaagggccactgggcgtgttcggtctcaaggagcggggcatggcgccgcgctatttcgtggccggcggcaccgggttggcgccggtggtctcgatggtgcggcagatgcaggagtggaccgcgccgaacgagacccgcatctatttcggtgtgaacaccgagccggaattgttctacatcgacgagctcaaatccctggaacgatcgatgcgcaatctcaccgtgaaggcctgtgtctggcacccgagcggggactgggaaggcgagcagggctcgcccatcgatgcgttgcgggaagacctggagtcctccgacgccaacccggacatttatttgtgcggtccgccgggcatgatcgatgccgcctgcgagctggtacgcagccgcggtatccccggcgaacaggtcttcttcgaaaaattcctgccgtccggggcggcctgaaccggggaagtaccgtgaccaccgagcagttcccgccccaattcctgcgtgaaatgatcgagcagctggacgccagcatccaggagctcgcacgcaaggaaaagggacttgcggcatccctgggcacgggccgggtcgccgagctcaaggaatactgggaccacgttctcactcccgaggaggaatgggagctcaagcgaccatggacttccgcgaccgggaactggtgtggatctggtcccgtctcaggcgggcccgaacctcccgcgccaatgccggggaggcctatatcgccagctgtcgccggcgccgcgaaaaaacgaacaatcctgaaacggagtcgacgggtatcgttgggaaaaaggttatctgtcgccctattttgtaacgttccgagcccatcgcctggcgccctgtgcgacaaccgttgcaccgtgactcaggcgagcgactcgagttgtttgccctcatgtggtcgggccatgctcgccaacagacaatcgtcggaaggtgcggctcgccctgggagcatgaggccgatgtccccgcacgactcctgggagcccgggacgagctccgtcacggcaccgagccagggctcgcagcaagacccgcgcgagcgctccgatccgatcgtcgcatcgagcgcacgagtcggagcgcagacgatctgctctgcccgtcactcatcgagccgcggtgctgccgcgacgattccacgccagcgtgacctcgacccgctgcgtggcggggatgcgcgcgccggggcgtcgctgtgcccgaacagccggggcacacccgagccatcggtccaccaaaccgccctcccatggtgatcgacgccgccacgctcagacgcccacccaaaggcgcccacgcctggccctggccatcaccggctcggcgctgcgctgcaggctggtgcgcactagcgaacgagcagatgccagccgagccatgcccacccgagccacgccacgacgcgccacagccgcgagcgacgcaggcctcccacgaactgtgccgggcccgcgccgacacggttcagcaccacccacgccccgatcacggctccgacgaggacccaagccgcccacgcgctcgtcacgacgacaccatcatggcgcgaggagccaccgaccgagcacgacccacgcggccgccagcacgctccgaccgagtccgaagccatcgaccttcgaccgcagcacgaccgcctcgaccatcgacgagaaggtcgggtagtgcccgcgcggtccgtggaccaactccaccagttcgaccgccgtgaacacggtcgcgacgaccaacgccgccaccaccgcagaccgcacgacgcgggcgatcccgtcggtcgtcgtccagggacgagcgacaccgagaccccacgcgatcagcgctccggtcgcaaggcgggcaggccacgtgaacggagtgctcacgccctcgacgacgatccctgcggcgacgagcgcggcccctaggagccagatggcgcgccgaggcgcgcgaacgtccataggccccccatcacccccgcaagcgcgagcgccccgaccgaggccacagcgacgacgaggctgcgcggacccgtgctcgccgcaacgccgatgccgagcgcaacgagaaccgcgctcacgacgacgacaccccggcttgccgatgcggctcgcgcgatgcgagcagcatcgaactcggccgcacgagccgccagctccgcctcgagacggcttgcgcatccccctccacggccctcgcacgcctcgcacgcttgggcgcagccaggctcgggtggcgccggacgtggtgcgctcgatctgacgactaccgcgccgacgacgacccatgcaaccaccaagcccccgatggccacgctggacccgacgccggcaagtgcgcccccaacgatggccgcaaggacacctccgaagccgaagccaagcagccaacgaccgctacgaacaccgcgctcgagcgcacgaaacccggaggtcgtcatgccaggcagtctaggcaggtgattcgccagtgcccaaggcgggagcttccggtgcgcacgaggcgcagctcgtaggccgacgaccgtgtgcgccagcgtcgactgtccgaccctgtccggggctcaccgtaggatcatgctcgtggagcagctcggcctcgacgacgacgggaccgatctgcgaaccgtgcgcttcgccatcctcgacgtcgagacgaccggagccgcatccggtgcggacgagctcaccgaggtcgccatgatggtcgtccaagagggccgtgcgctcgctcacctccaaagcctggtacacaccgaccgccccattcccccggcgatcgtggcactcaccgggatctccaacgagctggtcgccgacgcaccgagcgcccgcaccgtcatcgagcgcacggctcgactgctcgagggcaccgtcatggtcggacacaacgtccgcttcgaccgcagcttcctcggcgccgctgccgatgccgccggcatcacactgcccgaggtaccggtcctcgacacgctcacgctctcgcgcgtcctcctcgacggagaggtgccgaaccaccgtctcgccaccctcgctcactaccttcagctcccaccgccgagccatcgggcgatggcggacgtcgtcaccactgtggcgctcctccaccgtctcatcgagcgggccggtgcgctcggcgtcaccaccctcgagggactcctcgcactgcgacgcccacgtcgcagtggcgccgacctcgagcgccaggccagacgtctcccgcatcgacccggcgtctactacttccacgacgcgggccgggtgctctacgtcggtgtcgcgaccgatctccacgatcgcgtgcggtcgtacttcagcgccgacacacgcacgagcgtgcggcgcctgctgcgacgcgcctccagcatcagtgcccggccggtgccctgcgacatcgctcggcctctcaccgagttggccgagatccagacactgcgaccgcccttcaaccaagtcggcgtccgacgcccgcgcacgcgatcattcgtgacgcccgagggacgcgtcatcgcgccatggcccctcaaccaacccgatccgcccccgtcgatctcgacgtgcttcgatggcgacgcccacacggttgcgagagcgctcgaggaggccatcaggcaccttcaggccgagatgatccaagcgagcgacgacggtgagtacgaacgggccgcggcgcttcgcgacctcggcgccctcgtcgcaacccgtgtaccgacgagcctgctccacgaagtccaccgggagggtcgcaggctcgggctcttcgacccccgctgcgacgcccgacacgagttgacgggccccgagggactcctcgatctcggcccggacgatcctgagcttcgaagctaccgagcgctcctcgtgctgcgtacgatcgccgaacgtcgtgacctcatcctcgacgacgagctcgcccccctcgtcgccctcgttcgtgagagcgtcaggttccgccgcggctcagtcggcgccgcctcggatccgagcaagggtctcgcccgctcgtcctgagctgatcgcgtcgaccgccagctcgaagccgtcgacgatcgtcgccgaccgcccgtcgacccacaaggccaccgcggcgttcagcacgatgatgtcgcgcaccggaccgcgtacccgcccctcgagcacgccctcgagcaccttggcgttctcctccgcgctgccaccacgcacagctcctgccgccgcagtcgcacaaccgagcgacgttggatcgagcacgccagcctcgagctcgacggcgcccttgccatcggaacggagttccacgaagcgcgtcggcgccgacaccgacacctcgtcgagtccatcgtcggagtggaccacgagagcatggcgcacgccgatcgcggccagcacgtgcgcgaccggctcgagcagcgacggactccacacgcccacgagctgcgctcgagcacggccgggattgaccagcggtccgagcacattgaacgcggtcgggacgccgagggctcgccggacgggcgcgacctgggccatcgctggatggaagcgtggcgcgaacgcgaaaccaaagccggttcgttcgagctcccgacggagctcgtccgctccgagctgcgtcgggacgccaagggcctcgagcacgtcggccgagcctgctcgcgacgacgaggcgcggcccccgtgcttgagcacgagcgcaccacaggcggcagccaggagcgccgcgccggtcgacacgttgatcgtgaacgcgcgatcgccacccgttccgcaggtgtcgaggaccgggcccggggtcgtcaccggaaccatgtggtcgaccatggcctcggcgaaacctgcgagctcctccggcccctcgcccttggcgcgcagcgccaccagcacgccggcgatcacgaccggctcgacctggccgtcgaggaccgcgtcgagaaagtcgcgcgcgctgcctcggtcgagactgcgcccagcgaggaggtctccgaggagatccgaccaggagtgcgaatctggcgtcacgccccccaggctagcgaagggcacgtcggcgctgacggagcactcgtgcaaggccgcccggactgagcggacgaaagaagtagaacccctgcgccttcggcacgccaagctccaggagacgcgcggcggtgctggcgtcttggacgccctcggccaccagctcgacaccgagacgccgcgcgagcgagacgagcccgtcgagcatgctcgagccgttcttcgtacccacgttggccacgaagcttcgatcgatcttgacctcgtgcacggcgagcgtcgcgaggtggcgaaacgacgaggtgccgacgccgaagtcgtcgagggccaccttgatgcctgctcccgcgagtgcctcgagggtgcgtcgtagctgctcgagggccgaggcagcgatctcggactccgtgagctccacgacgacctggttcgcggcgatgcccgatcgttcgacgagttcgatcaggcgtgacgcgatgccgcgccggcgcgcactctcggccgacaggttgaacgagacccgaagccctcgtgccaccccggtgcgctcgagctcgacgacctgacggagcgcgagcgcgcgcaccagttcgtcgacgcgctcgacgaggcgaagatggacggcgatcgggaggaaacggcccgggagcaccgtaccgagcctcggatgctcccaccgagccaacgcctcgacgccggcgatctggccggtcgcaagctcgacgaccggttggaacacgacgccgaaggtgcccgcctcgcgatcaccctcgagcgcgcgtaccagttcgggcgcgagcgcgatgtcggccggctcgagcggcgcggtgacgcgctcgacacgagccaccccccgacgctcgagatcggccacgaggtcgcgctcggcgcgttgcacggctgcgagcacgtccccgtcctgaatactggccgcgccgagcgacaccgcgaccccccttgccccgagtacctcgagcatgtcacggcggatcgtgccgaaatcacgcgaactcgtcgtgccgacgatgagagccgcaaactcatcgccaccgatacgcccgacgaccgcctccggaccgagagcctcgaggaccccagtgacggcccgtaccaggtagcgatcacccgctgcgattccctcccgttcgttgacgtcccacagctggtcgagatcgatcagcagcacgtacgcgcccgaacggggcccttcggcttccagtcgctcgctcgccctggccaggaaggcctgccgatgccagacaccggtgaggggatcgcggtcggcgctctctcggagtgcgtcggtggccgctcgacggaccgctgcactcccagccacgacaagacaccgatccaggccgagatcgatcacccactccggatccctcgcggcagcggtcgcgatctcgatgcgccgttgctccgtctccagcacgatcgacatgccaaggctgttggcgagaggcagatgctcctcggcaccgaggtgtgcgccaagaagacgtccacgatcgcggacgtcccagagcgcgacgagtcgggcgaggcgctcgagcgccaacacgtcgccgacgtcgaagcgatacggcaccgcatccagggcggcgagcacgcccacaggcccatcggcaccgacgagcggcacgacgagcgcactctcggccgagacgacgccccgaatggcccgcacggcctcgctggggacgcccacgccagcctcggcagagccgacgaggacgctcagctgattccgaagcacccatccggcgaccccggcgcccacgtccagctcctccagcaagccgaagtcacccgtccccgccgcggctcgcacgacgaggctccgcccggcgacttcactcacgaccacctgcgatgcgccgagcaccgacgcgccagcgcgaccaaggaggcggaggcgatcctcccgagactgatccgagactcgttcccctatccggagcgcccggcggagccgatcggcccgccgccgctcatgatctgccatgaagcttgccgcagcgatccgaacggccggtgcaagccgctcgacgagggccaacccagccggatcgacgccctccgcagcgcccgcaaggaacagtcgctctccgagcgcgaggacccagaaggacgcagcgtcaaccccgacctcgacaaccgtgccatcagcaaccgctgcgagcgccgcccactccagaccgacgaggccacccatcgccgtgggaccacggaccacgcgcaggcgcgagaatccttgatgcacgccgagcaccgcgcacggcacaccgagcgctgcggacaggactccgaggagctggtcgagcacgccgtgcggtgatgacggcgcggcgagcacgcgcgagatggcaccgtagagctcaccttggcgctcgcctggagatggtggtgccggcagctcgggccgagtcacccgaacctcggccacgctgcccctttggcatcaacgctcgttcaatatcccgaccgttcgcaacgttacacggtgctaccatcccggtgtgcgcgacatggcagcgaccgacaccacctctcgcgagctgttcgcccgcatctccgccatcgtcggcgcaccggaccctccctacgcccgcctcgccaggctcggcgagctcgccgagcaggtcggggcccgactgatcgttcgtgacggcctcggcccaggaacagcctccgtccgcgcggccccctcgccagagctggggagggccatgggtgacgccgccaacctgctcctgcgcctcgactaccgggcacgtgctgccgagcgcgccaacgagcacctcgccgagaccgtgaccgcactcgagctcgcgatcgatgcggcgacgagggaaccgccgatcgagacccacgcaccggcgttggcactgtggcatctgccggtcgcgctactcgtcgtggacgagcagcagcggatctgcttcctcaatccgcaggcggctcgcctgctccagctcgacggtgccgacgtcctcggctcggtgtggacccgagcgctcgcgagtctcggcgaggcccagctcgatcggatccgaggtcactttcgtgcctccggacactttcgcggcgtggccaccgtgccatcaggcgatgacggccgtcggtacctggccatcgacgcagcgacggtccacgcaacgtcgtcgcacgcggcacgtcccctcgtgcgtgtcatgctctgggatgcgacgcacgcggccgtggaggcgagctggctgcagtggaccgcgacccacgaccctctgaccggcctgttgaaccgagcgggcctgaccgaacacctgcgaacgtggggagagcgacccctgcccggcctcatctggctcgacatcgccggcttcagcgacctgaaccgagcgctcggccatcgtgtcgccgacgagatcctccggcatgtcgccgacagcatcatgaccgaactcggacccgacgacctcgcggcacgcgtcggcagcgacgagttcgccatcctcgtggccgacggggccgccgccaagcaacggcggtgggccatcagccagagcgcaagcagcctggggagagccgcgatcactgcggacatcgcggtctcgctccggagcgccgtcgcgacccatccacgtcccggcatcgagcgatcggcggcagacgccgtgtgggaagaactcgggcgcctcgcgaggatctcgcgggagatcagccatccggccgctcgcggccgtcgacggttcgcgccacggggaagccaccaacccgccgacgagctcgaccatcccagcgtgcggtggatccgcctcatcgacgttgcgacctcctctccgagagggcacgaactcgtgctcaccgatcggaccggtcgcccactacgcgacgacgcccgacgcgaccacgcggccggtcgctacgaccgcgccctcctcggtgcgttggcgaggaccgcgcatccaggtggggtggtcgcggtgcgtctcctcgagccctcccacgagctcctccgcgctctgaagaccagtgaccgcgggtccacggtgcaggtcaccctcgaggcagacgacctcgtcgcgaccccggagcgccggcgcgttgccgcgaccatcgctcgcgaggcccatgcgctcgcgctccgggtgggcctcgacctcggcgaacgccacggcggtgaactccagctcatcgctgcgctcgagcccgagcagatcgtcatgccgctccaccctcgccgaacccgcccacgaggaccgctcgcagaacccacgactcgactcgtggagggtctggccgccttctcggctggtctcggctgcgagttcgtcgtgaccaacgcacgagtccaggacctcgtcgtgctgcgcgagatcgctgagcgtgcagggggcaccatcatcgccgcgctggcgtcgacctttgctaccagcccgtcgtgaatgccccctcgggatcatcccaccacaggtgctgatcgagcacgccacgggcgatcaggttcaactgcacctgcgaggtaccctcgacgatggtgagctgcttcgcgtcgcggtagtagagctcggtcggatgatcgctcatgtaaccggccgcgccgagcagctgcagcgccacggagctcgcacgcaccgcaagttcggtggcgtagtacttcgccatcgacaggaagggcacccactcgcgggtgaaccgcccctggtcggcgagccaggctgcccggtaggtcagcaacctcgccgcctcgatctcggtcgcgagcttcgcgagctcccactggatgccctggaagtccgcgatccgaccaccgaaggctggacggtttcgcacgtacgtcgtcgcgtacatgagcgcgccctcggcgagcccgatcccccgcgcagccaccaccggacgcatcgcgttcagtccgagcatcgcgaggcggaaccctcccacctcgccgatcacgttctccggaggcacacggacctcgtcgagcagcagctcaccggtgtcgacgccgtgcacacccatcttgtggtcgaccctcggcacatccacccccggccaggaccgttcgacgatgaacgcagtgatcgcatcgtgccgacgcgatgtcggatcccctgtcttcgcgaacaccgtgtaccagtcggcctgccgcacgccagagatccacgacttccgccccgacaggatccaaccgcccggacgatcggggtcgggtactgcccgcgtccgcatgccgaccacatcggagcccgcctccgcctccgagaggccgaacgaggcccgctgggttccatcggcgatgccgggcaagtagcggcgcttctgctcctcggatccagcgatcatcaccggacccgtcggcaggcgcgacagcaacagcatcaagcccgcggtctgcgagaacttcgcgacctcttcgatcgcgatcgtcagtccgaggatcccagcgccagaccctccgtactcctcggggatgcacaggccaaacagacccgcggaacgaaagacctcgaacagatcgtccgggtacgtcccctcggcgtcgatcgcccgcgcgcgcggtgcaacgtggtcgcgtgcgatccgacgcacggtcgcctggaggtcttgatagacgtcgtccaactcgaagttcacctgcgactcctcgctcggatgccgggagcagcgtagccgacaccatgtggtggcgccagctcaccgacgtccccagcgccgtcggcgacaggcgcgggcagcgagcagcccggacccttgcgctgggactaccctgggtcgcatgctcgtcgcggtcctcgatgccggcaccacgacgcttcgcgccagcttggtcgacgacgacctgcgcatcctcgccaccctcgaggacatcacgcccatgctccgaagccgctcgggtgaggcgtcgttcgacgccaacgaactggcacgccgtgcacgccacctcctcgacggtctcgcacgccgcggtcgagcagatctcgtggcgctcaccaaccagcgcgcgagcgccgtcgtgttcgacccgacgcaccgggtggctctggccccggggatcggttgggaagatgctcgaaccgctgcgcgctgtctcgaactcgcacgccacggcgtcgtggtctcaccgagcgaatcggcgaccaagttcgagcgcctgctcgccatcgccgaactacccgaccacgcccaggtgggcaccgtcgacgcctggttggtcgtgacgctcacagggtccgcctcgaccgacccgacgaacgccgcggtcaccggcctcagcgacaccgaggcactcgcctgggacggtgagcgactcgcactgcttggcatcgcgcctgagcgactcgtcccgatcgagccgagcgtggggccccggggccacgtgcgcctcgggggtcgcgacgtcccgcttgtcgtcgtcatcggggaccagcaagccgcgcatgcgggccatccggagctgacgaaactgaccatcggcacctcggcggtcgccgatcactggctgggcgcagcaagtccaccattcgcacgacgtggcggcgccgggagcttccccgtcgtgctcgtcgacaccaccgagccacggacgttcggcctcgaggcgttctggcctgcagcgggctcgacggtcggctggctcgttcgccgcggcatccttgccgacgcagccgaggccactcggctcgccgagcgagctggctcggccgtaccgctggtcgtacccacgttccagggcgcgggcgcacccctctgggacctcggtgcccgaggtcgcatcgagggtctctccgcggcgagcggcccggcagaactgacggccggcgtcctcgagggtctcgcccacgtgggggtcacgctgttctcggtgctcgcagccgaccgagcagccgcggggtacgctccagatcttggcgacgtcgcgctcgatgggcgcgcaggccacaacccccgagtcgcaggcgtgctcgcgagcctgctcggcagaccggtcgcgctcggtgtccagccggaggccaccacgatcggggctgcgcgactcgcactcggtctaccccgtgaggcggttccgcgtgggcctctggtcgaaccaggtcgcatccggccggtccacgaccacgacagctggcgagcagccctcgaacgatcccggggcgccgtacctgccctctcagcggtcgccttctaggccctcggacaacgccgtcagcgggccgacgagtccgacgagcgcacagccggccgcctcccggtcgttcgcaccttacgcagcgtgaaggctcggaaggtgccgagggcatcgatcacgccgtcctgctcggcggtgaggaaatcgcgcagcgtcacgacgcccgcgatgaaccaaggaaccgctccaaagacccacaagatgcctgccgcgatctgttggtcagcctcgagcgagagcgtgcggagcgtccccatccattgctcataggcgctgtaccagggttgcgtcgacaacccgaggacgatcgcgaggatcatgcacgacatcgacacgatcaccatgtgcgcaaagcgcacgatgggcgactcgtgctggcgccgaggattcggatcgaccgcgacgtaccacatccagatccccgaggtgaagaagctgaacatcatgagctccatgcgcccgcccgaggccatggcccaatcgaagggcccagggagatgccagatccacatcgcagcgtcgaaggccacgaccgcagaccacggcgacgacaccacgccccacacgcgggcgatcggcgcatgtgctccgagccggccccacagacgacgcacggcttcccgaggtccctcgggcaccccggcgacgatctcaccccaggggtccgcgcggacgatgagcggtggcgcgaggatcatgagatcgaggtgccagatcatgtggacccactgatagaccatcgaccacgccgcgatcggcgagaacagcccgatggcgagcgcggccatcccacccagcatgagcagcgctcgccgctcgtagcccctgcgaagctccggatcgtcgagggtgcgcatcacgatgaggtgaccacgccaatagagcgcgatgggcagaccgaagatgatcaatccccaccagtcgacggaccagttctccaggacgtacgcaaccagaccatgtgccggctggatggccatgctcatgccaacgatccccacgtccacctcccaagcccgacggccgtggccccagtcctcaaggctagcgcagctaggctcagagcagctgagcgacgagtggcgcgcaggaggatcgggtgacccggacgatcggcgtcgtggggggcggccagctgggccgtatgctcctcgaggctgccctggccctcgatctccgcctcgccttctacatccgccccggcgagcagggagtcagcggctgggcgacgtcggtcgtcgaggggccactcgaggcaagaccactcgcgagcttcgcgaacagcgtggacgtgctcaccttcgagcacgagctcgtcgatccagccatcctcgcagcactcgaggcccaaggggtccagctcgcgcccggggctgtcgccatggcgaccggctcgaacaaggaacggcaacgagctctcttcacgacactcggcttgcccaccatcccggcccagctcgtcgaccgcgacgtgggtgaggtgcccacgctcgaacccccgtacctgctcaaggccgtccgaggcgggtatgacggacgagggctactgcgcgtcgacgcgacggttgagctcccgcgcaccgggcggtggcttgccgaaccgctcctgcccatcgcgtccgagtgcgcggtcgtcgtcgcccgagcggccaacggcgaggtcgcgacctgggatccggtcgccctcgtgcatcgggagggcatctgtgtcgaggcggcctggcccagcggtctcgaacctcgactcgagcgagacgtcgtccgtgcagcacgaaccatcgccgatgcgctggactacgtcggcgtcatggccgtcgagttcttcatcgtcgacgacgccatcgtcgtcaacgaaatggctccgcgagtccacaactccggccacctcactatcgaaggagcagtcacgtcacagttcgagaaccacctgcgcgccgtcgccggtctgccgctcggctcgacggagtcgatcggaccggccgtcatggtcaacctcatcggcgcccgacacctcgagcgggtcccgacggccgcacgcgtgcatcgctacgggaagacaccccggaccggccgcaaggttggccacgtcaccgccgtcgccgcctcgctcgacgacgcgcgtcggcgcgcctgggccgcagcgcgcgacctcggaggcgagctcctcgatgcgccctgggagcttccatgacaccccccgtcgcgatcgtcatgggttccccgtccgactggcccgtcctcgggcacgcagcgaccatcctcaccgaactcgaggtggagtgggacgcacgggtcctgtcggctcaccggacccccgacgacatgctcgccttcgcccgcgacgctcgcgacctgggattccacgtcatcgtcgcgggcgcaggtggcgcggcacacctccccggcatgatcgcggctgcgacaacgctcccggtcatcggggtgcctgtccgcctcgccgccctcgaggggctcgactcgctgctgtcgatcgtgcagatgccacggggcgttcccgtcgcgaccgtgggcatcgacaacgcgacgaacgcaggcctgctcgccgcacgaatactcgcgatcggtgaaccggggctcgccgatcgcctccaggcgtaccaggccgccaacgcggagcgctcgcgaggtgcggtactgcccccaccctcaccacactgaggaccaactacccaccagatggtcggtgtcctcgagcggctccggcgactggccgaccgatcgtcggcgcactgcgacgacgcacggcacccatacgcgctcctcgtcgagagaggaacgctcacgagcgttggctctatcaccgtcggtcggcacgacggatgcgggcaggtgcgtcgagccttcccggagatcgtcgaccgatggagcgctgtggtgcgaagcgatccacagctcgcacgcgccgagtgggcgcggggagccctcgctctcgagagcgccacgggcgcaaacgatcgatcggccatcgcgacaccgatcggctcctcaccagcgtggttcgctgtcgtttcggtcctcagcactcgaggacctcgcctcccaatcgagcggggacgaggcccccgcgaccgaaccgaccgccgccgaggccatcgtcaacgcctcgcgcgctgctcgcgagcgatataaccccatggcaactcgccggcccgatgaggcgtccgctcgcgccaaggaacaacgcctccgagtcaaggaccgcgccacacgggctcatggccgatggggccagacggccccacgcccagactcagcccccgatcgacgggcgcccgctcgaggcgtagccagcttgcaggtagagctgagaaccgacaggcgcacccgcataaccgttcaccgtttggccaaccgctggctgctgccacgaccgtgagccgatactcagctgctcgacgagagcgcctgcggccatcgtgatcaccagcgccacgacagccacgagcaaccacgccgtgactggggggatgcgatggatgggccgatcgtcgcttccacgacgcatcccgacacgccttcgcccgatcgccgccaacctgacctcctcagcacccagacaccctcaggctgcacgacgccgatgcctgcgccgtcgcacaaaccccgctggacacgaactcgttgcttccagcagccggctgccacgatcagcggacaggatcaccgacgagactcacaacctcgtgccgaggctaccaaacacgctcgtcgacgaccaagtccacagctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtgaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgggacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatgtcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagttcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagaacgtcaacctgcacgtcgacagcggcgacctcgtcgagctcgcgttggccaaccgactaggacgatcctctcgatcgcgatcccctgtcagcatgcacgcctcgctaccgtaggacagcacccggggaggtgctagcgcgactcccttgcgtgcatcgtggtccttcgccgtctctgtctggctcgggttgcgaaacgcgcgactcgagacgagacaactcgtgacggttccgcctgggctccgcgaccccctcgagcccagccgtagtcgcactacgcgcagccgcctcgttctcggttgcgatggctttcaggagttcgtctcgcacgatgcgcacgtcacgtggcgcgacgatgccaaggcgcacgccgccatatggatcgatcgcaagcacggtcacgacgatgtcgtcaccgatgacgatcgattggccgagcttccgagccaagacaagcactagcgagacgtgccacgcatgagaccaacgacgtcacgagtggtcgcgacgaagatcccggcactgatccccaccaggaggacgccgatcgctccgaggaagagcatggccaagccgagggcccattgaccaacgagtcgttcgcggatcaccttgtcgacgccagcacctgcaacgaacgcgaggaggcagcctgcgagtgttccaccagcaagcgtcgccatcacgatgaggagcatgggaacgagccacgccgccgccactatgaccacgaactagggtgactgaagacgtcaataatgcaaagccaatgaaccacggccaactatgccgaagccacgaacggcgtgcgaggcgacgccggcgtcgcacgcctgtcggaatcacacttacccgcacacgcgaccccacttcggaaatggaggattacccgaccctccatactggccgttcatataccagtagagatcgccgttgggactttctaatggctgatcagcaacagcatgcgcggtagggaagctgaaatagtctgcccatgtcggcgtcgcgagcgtgacgttgagcttgccattcaccatgacccaagacgacgacgatttacacaccacgacgtcgattgcgttcttcgtcggatgcaccgcgaactgcttgttggagatactctgctgataaaacgtcttcggtgaaggcagataggtctgattggtcggcgtgatgctggcaaagaacgatgcagtcggtgcgacattggcgttcgcggtcgagaggtactgcgacagcatcgtcgacgccgggattggtccgttacccgcatacgggtcgaagagctgcgccacatccggcagcacggtgacctgaccgttctgctcggtggtggcatagctcgagctgtagagcccgcccatcaccccgagggtgcgcgccgtgtagaccgcatcgcgctcgagcggcgtgagcttcgtgccgacgtagaccgggccgacatacggcacgctggtgtcgttcacccatgcgccgagcacgctcggcttcggcacgcgcaacggcaccgggatggccgggtccttgggcggaatgagcaggttcgacagcggcaccgagttcggatcgccctggtagatgggcagatcgttcgcggcgtcgaacggatactccttctcgagctgcgcgagggtgaggttggtcggcgcaggggccgtctggctcgagctgctcgacgaggcgttcagcgagctcggcacactgggctgtgacgatgagccacacgcagcgagcaggatggcgctcgtgccgatgactgcgccggctgttgccgtccgcaagcgagtctttctgtgcatcactcccctccttgacttgcactcagtataacgcgctgaccatagtgcgtgagaagcaccgcatgatccgagtgtgacacacgagacttgcgaacgcaagggccggaggtccgtgcgtcatccctcctaccgagagatatgcgtgtgcaacgaccgttgcccgtagtaaccacaaccgatgccatcgacctactgtccgagcaggtgcagcgcgttcgagaggccagcgttgccgaggaacagaccaacgatgacagtccccacgaagacgaccatgtacgggagcaggagcaacgaagcggtattctgtcgcgagcgaagcgtctgatccacgagatctgtggtctgacgccaggtttggtcgatgagcgaccgcaggaccggcaccagaggtgcgccggtgcgctgagcctgcgcgagcgcagagcccagcgtgaccatgatcccgacctggtaggtgcgtccccagtcactccagacctcagccagtgtgcgcttggcaagaccggtcatccagtcgttcagccaaacacgcccacgagggttggcatacgtgccgtagacgcgaaagtactcgctcatagccgactccattgtgccggcgccggcggtgagagccagccggaggtaggacaggatcggtgcgatgagcagggcgctctcagcacgagcagccttggcctgactgcgaaggtatgtctcggcgaagacgaggcccccagggaacgcaatgatgatgccgacgatgccaccgatcaacgcgaggttcatggacatgagcttgatgaagacgagtaccccgagcgtcgcaacgatgagcagtaagagcatgagcgacatgcgcatgacgaaggacgcgaactcgtcggtatccatcccgagcaagtgaagatcgacctggagcagctcagaggtcgtacgccgttcgagggcgttcatcacgaagcggacggtcgccgagccgctgcgagtacgcgaggggtggtcatgccatcgcgtgaggcgtcgagatcggcggtatccaatcaagccacgtacgccggcgacgagcgcgatcgcgaacaggccagcgagaatcgagatcccgagtggtgacgagaaccaagccattgacgtctcccgaactcaaacaaaccacgtcgacagcgcgaacggcctgcgagagaagccgacgacgacgatcgtgatgaccagcaggatgccgaacgcaagctgcatgagtaggctcgcaaagagatggtgctggtagacgctggcgtagtaggcaccggcaccaagcgacgtcaagatgccaaaaccgagcaggatgcgcgccaccgtgatgttgggcacgatgtaggtgcggtaggccatctcgaacgtcgtgagctgaggcgtgatggcctcgaggaggtcctgcacgagcggcgccacactcacaatgcgcgatccagccgtgaggatgacgacctgatcgatgacgcgactcggtggatcgtcagcggtggcgatgagctgctcgatgttgcgctcgtgatcctcggggtcggtcgcatcgaagatcgcctcgtagatgcgctgacgactgcgtacgaagaggttctccgggttcgcagcaagtgccatgcgaacgatcgagaccagcgagacgttaccaccgctcgtcgcggtcgacgcgagtgatgccgcgaaggtctggaggtcgcgcagtcgttcgatctgacgttgcgcgaatgtcggcgtgacgtaggtgtcgacgaagatccacgccgctaccccaccggcgatcgcgaggatcaggtagtgcaagagaccaaaaacaacgccaaccacggcagcgatcgcgagacgaatgtcgatgctaggggatccaaaggtctgataccaagcaaccttgacctgaccaaccgtaactgaggcggccttgatcggttcctcgagcttggggtcggtgggatctgcgcgaaacacgaggagcatgccgaccacgatgacgacaacgccaaccacggcagcgacgacgagtgctccggttggggtcatggtcgaacctccgtggactcggtgagctcggtctcgagaagccgggcggtcacgaggagttgctcgagtgcgccgtggcgccgacgccggcgccggtcacgggagtcgaagacgagtgactggatatccgggatcaagacgtcgccagagagcggtggcgtcacgagcagagggatctgactcgcgccgagcgacgcacgaaccgcatcgacgaaaccgagggcccggtcagcaaggagcacgatcgctgagggcgtgagcccgtcgcgcacgagctgagtgagacgaccgaggtcgctcggcgtgggagccgtgacgaggaccaagcgctcacaactgctgagccacttgagcggtgctgacgtctcgtcaaagatgtaacctgcgtcaacgacgctgtggacacgacggtcttgaccagcaagccaatcggccatcgcggtgagcaccgtcgcgagatgagaccgcgtcaagatcccggccatgggatcggccaggagcgtcggaagagatcgggcctcttcccaccgttcgagggaatcgagcacgacaccactggcaaggtccaccgtggcagcaaggacgatgccggcggacagcgatgaggcgtgttcactgatcgcggcagcgatcgcacgctgacctggcggctgaggagcatgctcgcgatcacggatcgcccatgtcgattccatgccggcgatctcgatgagcaggcgtcgtccaggaacgctgtcagcaagcatcgttgcaaggacgcccgtcgggagatcggtgctcgtggcgacgacggcagtacgcatagccctagttgaccgtatgcgtgtggaccgacggctgaagctgcacgatggggacgggctttgcgttcggcggagcgaaggcgatgaccaggttcgaagtgtcagcgacggcagcgatgtcgctcgcctcgttcggtgggacctcgatctcgagctgcgacgaaccaccgttgctcgacgggatgacagcaaggacgggaatcgctgtggcgaccggaatgtacggtgcaggggcggtgtaggacatgggcgcgttcgacgacccacttgacgaccccgacgcctgggcctggagcggagcgtaaatgtccaccgtgtcgccagccgtgagattcggggggatgacagaaggcgtcaacacaaagacccggtagttgccacgcaggtgcggcgcgagctcgctcacgagcacgggagcgttctgtggaatcgtcgtcgtcacgacttgattgttgagcacacgcacgttggcgaccgggatcatccccggcgtgaccgactgctgtggcaccgcctcgacagcgaggtctgacttcgtcggcacttcccctgggacgagtggcttggctgccacgacgatgtcgaccgtctgcgactgcttggagaagaacgagtagaccccaagagtaacggcggcaccgagcgcgacggtaccggcaatcttgagagctacagaccgacgctggcgagcaagtgtcatgcgggtctcctttgttggtgtgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcagtgagttgcgctcagcctaatcgcaagggacatgtcgtgagttgcagtgatgtgcgtgtgcctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtgaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgggacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatgtcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagttcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagcatggagtgcggaggtggccgggcggccgcgggtgacctcggtcacctgaggaaggtcggggctccagagggcagggtgctcgcgagaggcgagtcggggtgacccgcaggacagtgcaacagagagcagaccgccgatggatcgacgatcgatcacaggcaagggtgaaacggtgcggtaagagcgcaccagcgacttcggcgacgaggtcggcttggcaaaccccacccggagcaaggccgcagtggagcagggtggcccgcccgtcacgctcctggtaggccgcagagatggatggccgcacaggcggccgtttgggccgctggacagaaccccgcctataggccacctcccgccaatccttcgcccacgagccaggcgccacacgattcgcaatcgacgtcccgccctgccgcgaccgcgccaaggaccgcacccgagagctccatgtgacaggccgaacaacgaccagcgatgctgagcgccaacgcgcgcccacgcttggcccgagcttcgatacgcgccctgagaccagggtcgagtcctgcgagcgcctcggcccacgccgcctccgccgtgcgcacagcctctcgacgctgctcgcgctcgacgtcaagggccgcccggagttcggcaacggtcccaccgacggcgtcacgctgggcagttacctcatcgagggaggccacgaccgagtcgcgctcctccatcgcctcgagctcggcctcgtcgagttcctcgagcctggagcgcaccatggtcgactcggcctcgagcctggattgatcgcggaagccggcatggtcgccctgtccacggaggcgagccaggcgttcaccgagttcgtcgcgttgcgactcgagcgcagcgatgcgtccctcgacctcacgacgttcggcttcgagagccgccacgcgctggacgagctcagcgtgttcggcttcagcagcacgcagtgcggcagatggccggaccgcctcgagcgccgctcgcgcacgcgagagtcgttcctcgacggtagcgatctcgatcagctcctggcccatgggcaccatcctacgccaggcagcaagagctgcccccgaacgcgcgacagactcggtcgtgccgatcgcagcgcatgcgtcacgccgccacggctctcgaggccagcgcggcggacggcctcgccaccttgagtgcacggtcagtggggcaaggcgctagctcccctcacgagggaggaccgcctccacgacgacccgggtaccagcaacgcggtcgtggagggtctggcgagaaggatcgagaaatgcgacgagatagcccgtgaagagcatgacgaacgacagcagtgagacaacgaagcgaatgctcgcgcgtcgcatgccgaccgggccaccgtcttgagcctcgacccgaaggtgcgcagccgcctggccgagcgtttgggaacgcagtccgatcagcacgacgaagtaggcggcgatggcgagtgcgttcaggacgtagtcgaacaccggcagctcgaagcggtcgacctggaagatggggttcgacaggccagcaagcccgccgaggatcagttcgaagatcaccgagccgagaaacaccacgatcaggtcgacgatgagtccccacaaccgtcgccacggcgacgcgagccgcgatccgccatcagccgcactcataccctcgacctcccgcaccacatccgtccgccacgtcgaaccgcacagctcgaccacgagcccgggaaaccacgaccgcgccagtcgatgcaccatccgggagcgcgaagtactcggcacccgtcgacctaggccacctcatcaagcctagcgacgccaccctcgggagttcctgaggtccccgtcgctcgcgcccgttcgcgccagcgtcgctcggcgaacccagctgccgccatgatcacaagaccgaggacgccgacgacgacacctgcgaccgcaacggttcggaacccgcccaccccatagaggagcgatgcgctcgacgatccagcgacgccgccgaggaagtagcacaccatgtacaccatggtcacgcgcccctgggcgcccggtgcgagcaggtagatcgccgcttgattggagagctgagccccttggatcccggcgtccagcgtcgccgtgagcaccacgaaccagagcaacgacgaccgatcgaccgccaaggcgagccacgagagcgcgatcaggctgaacgaagcgaccgtggtgaccccggcgcgtcctcgatctgcctggtggccaacgacgcgggccgccagcacgcctgccaggcctgcgaagccgaacagcccgatgacgccggtcgagaggtggaacgggggccccgagagtgcgagtgccatcgtcgtccagaacatcgagaacgcagcaaagctcaagaacccgagtccggcccgcagtcgcagcaacggctcgcgccgcaacaacgccatggccgtccgatacaacacgacgagcgatcgctccttcgcaacccgctcgtgcggcaaccatcgggcgatcgcgagcgcgagcacgatacaggcgacgcctgcgacgacgaacaccgctcgcacgcccgccacctgcgcaagccatcccgcgtaggtgcgcgcgaggacgatcccggagagcaggccagccatcaccgccgcgaccgagcgtgcgcgacgagccggctcggctgccgcagctgcgtaggtcaccgcgagctgggccaccgacgagaagaccccaagtccgagcaggccgatggcgaacacgacgacgttgccggcgaaggcgaccaggagatcgaacgcggcgctgacgacgatcgtgatcagcatgagcctgcgacgatcgaagcgatccccgagtgggaggagcgtgccaagcccgatgacgtagccggcctgcgtgacggtgacgagcagccccgggctcccgccgcgaagaccgaaggtgtccgcgatcacgtgcagcaacggctgcaggtagtacgtgttcgcgaccgtgacgcccgcgacgagggcgagcaggacgagcggaagccgaggagcgcgttgccgtggaatagttgcagtctacgaggacttcatcgccctccggaggtctctacactgaggtggcccgagcttggaggtgtccatggacgcactgcactgcgtgatcgagatcccgcgtcactcccgcaacaagtacgaggtcgaccatgagacggggaccgtctggctcgatcgcacgctgttcacgccgatgggctacccgcttgactacggctacatcgattcgacattgggcgaggacggtgacccactcgacgtgctgctgtatctggatgtgccgacgtttccagggtgccatgtgaagggtcgtccggttgctgcgttcgtgatgagcgacgaggccggtcgcgacgtcaagatcctctgcgtgccccatggggatcctcgctacgaccacattcgtgacctcggcgacgtccacacgcacctccaacgggaagtcgctcacttcttcgagcactacaaggacctcgaaccgggcaagtcggtcgcgatcgaagggtgggcccccctcgagcaagcccagcgtgagatcgatgcagcgctggcgcgcttcgagcacgcccacggcaacgcctcgccgagccactagcctggcaggtgacgtccacccactggtcgcgccagcgaccgcgagctgggaaggaggcctgcccatggactcgccgaacgacgaacgcgatcccgaggccgtccgcgacctgatcgagcagctgcggccggcggtacagtacgacggtggcgatctcgaactcgtcgacgtgaacaccgagaccggcgtggttcgcgtcaggctgaccggcgcctgctcgagctgcgccatctcgacgtcgacgattcaactcggtgtcgagcggatcgtcaagggtcgcttctcgtgggtcaccgcggtggagggcgaactcgacgaggagttcgacttcgccgcctcggcagccctcggacgcggcggctgggtaccgcttcggccccccaccaccgcgtgaggtgcacgcccactcctcgcactcggtgacgcgcgaggcgtcggccgcgctggtagagatcacgcggcccgagcgcgccaatgcgttacgcgtcgacgacgccgaggcgctcgccgcgaccctggtcgcactcgacgacgaccccggcgttcgggccatcatcctcctcggatctcccaggtacttttcggccggcgcggacctcgcagacctcgcagacgaggatgcactcgcccatatcgaccgcatccaccgcctgcttcgacaggttctcgcactgcggaccccgacgatcgccgccgtacggggcgcagccgtgggcgccggactgaacctggcccttgcgtgcgacctcgtcgtcgccggcaccagcacgcgcgcgagcgagatgttcatccaccgaggcctcacgctcgactttgccggctccgccatcttgagcgcgcggatcggtccgcatcgggccaaggcgctcgccttcttcggcggcacgctgaccctcgacgagctcgccatgctcgtcaatcgcgtcgtgcccgacgacgaggtgctcgacgtggcccgtggctgggctcacgatctcgccgagcgctcgccacgcgccctgaccttgagcaagcgcctcatcgaccaagccgcgccgtcactcggatcggcgctcgatcgcgagatcatcgcccagctcgccgcagccagcgatccagcaacacgcgcagagctcgagcgatggcgctagccccacgttggatcgaagacccgctgacaggcctcgaggccgagctcacggtcgtccagccgtaccaggcccacaagtggtatcgctgcccgggatgcaacggcgacatcgcaccgggaaccggacacctcgtggtcgtcccgaccgacgcaaacgacctgcgccgtcattggcaccgcagctgcctcgactgggagctccgccacggccatcgccgccggcaccgacgaacgtgagcagtgtcctcctagagacccgctctcgtgagcgctcggtcgagatcgccccagagatcctcgacgtcctcgagaccgaccgacagtcgcacgaggccctctccgatacggtcctctccggggtagcgtccccggcgctcggccaggctctcgacaccccccaacgacgtcgcgtggtggaagaggctcagaccatcgagcatggcgtcggcttgctgggcactctcgagttcgagggccaccaacgccccaccagccgactgctgccgtccggggccgacgagctcggagtcgaagccgggatagcgcaccgtgtcgccaaggcgatcgcgaagccgcatcgccaaggtggtcgccgtcgcgctggctcgttccactcgcacggcaagggtgcgcagaccccggaaacacaggtacgcctccacgggaccgatgatggcccccgtgagctcgcgcacctctcccacgcgcgcaacgaggtcctcgtcgctcgccacgagcacacctccgaggacatcggaatggcccgagaggaacttcgatgccgagtgcaccacgacgtcggcacccagcgtgagcggccgctgcagcaccggcgtcgcgagggtcgagtccacggcgagcagacctccgcgctcatggatccgcttcgcgagcgtcgcgatgggataggtcaccaggagcgggttcgatggcgtctcgatcagcaccaccgagccgggagcaaggcgatccaggtgcgcatcgaggtcggagggctcaacgagctcgatgcccgggatacgcgcaccgagccacctggcgagctgtcgcgttcccatgtacgagtcggccacgacgagggccctcggaccaagggcgagcagcaacgcgaacgttgcggccgcacccgaaccgaaggccactgcggtaccaccctcgagctcaccgatcagggcttcgaaggcctcccaggtcgggttcgtgtggcgcccgtaagcagaacgctggccctcgtagtaggtggcattgagcgagaccgaaggattcggcccgaagagacggtcctcgctcggcggcaactgcaagagggtcgcgatcgaacgccgttcgaccacgtcgtcctccggagtggccatgctcagctgggatcccgtcgaggaagctcctcgacgttcacgtctcgaaacgacaccacccgcacatgatcgacgaagcgcactggacggtacatgtcccacacccaggcgtcgtgcagttcgatctcgacaaagctcaatccggcctccgccttcggctgcacaacgaccgagttcgccagatagaagcggcgctcggtctcaaccacaaagcgaaacagcgggagtaccgccttgtattcctggtagagacccagctcgacctcggtctcgtaccgctcgagatcctcagcactcatcgagcaacgccgtcacgctggcggtcagcgcttctccttgaccttcgcggcgcgaccgacgcgcccgcgaaggtagtacagcttggcacgacgcacgtcgccccgggtcaccacttcgatcttggcgatcgtgggtgcgtgcacggggaagatgcgctcgacaccgatgccgaagctcagctttcggaccgtaaaggtctcctgcgcgcccgacccgtttcggccgatgacgatgccctggaacacctgtacccgctcgcgagatccttccacgacccgcacgtgcaccttgacggtgtcacccggggcgaactcgggaacgtcctcacgtagcgaatcagcatcgacgagatccgtggccttcatcttcgaccctcttgctccttgacccagcgtgcaaccaggtcagcatagccgtagcgctcgaggagcgagacctcttcgtcggcgagtccgccccgtgcgacgatcagatctggacgatgtcgtaacgttcgagcgagcgcagcggctcgccgccaacgagccacctcctggtggtcgccactgagcagcaccggggggacctcgaggccctcgaacgaacgcggcctcgtgtactggggatattcgaggagcccctcggcgccgaaactctcctcgaccgccgaggccgtgttgccgagcacgtgtggcaccaggcgcacgaccgcttcgatgaccagcagcgccgcgagctcaccgccttggaggacgacgtcgcccaccgagagcagctcgtcgaagacgctgtcctcgaggcgcgcatcgaagccctcgtagcgcccgcacaccaacgtgaatgcatcgaggtcggcgagacgctcggcctcgcgctgcgtgaatctccgcccagcaggagacatcccgatccagggatggggggcgtcagccacacgcagagccgccgcgaagggctcgggcttcagcaccatccccgcccccccgccaaagggagtgtcgtcgacggatcggcgaggatcgtccgcgaagcgacgcacgtcgatcacctcgtagtggaccgcttcgtcacgtgctgcccgcccgaggatcgactgcgtcaagaccccctcgacgagcgccgggaagatcgtcacgaccgcgatgcgcatggccgtgctcagtcgtccaggagcccgggcggaaggtcggcgaccacgtagccgtcggcgacctgcgtgatgaagatggaggggaccaaaccacctccttcgaggaccagcaactcgctggccgggttcgcctcgaccgcaacgatgcggcctcgatcgacgccatcggcgtcgacgagtcgcgcacccacgagatccggaacgatcaccatgccgtccggcagtgcgacacgctccgcccacagggagtgccctcggagctcctccgcggcttctcggctctccacgcctcgaaggcgcacgataggccggtcgggttggccccgcacctcagtgatcaccatagcgacctcgtcatcgagccacacgtgggcgtcggcgacgaatcgtcctgggacatccgagacgtggtgaagcgtcacagcgcccttcacgccgtgcgggcgcccgatgaccccaatgcggaccctcgaactcacccgcggccgcgacgccctccggatcggccccgaggcccacctcgccgaggtcgatcgtgaccatcggagaacgacacccgcgtcgacagaccagaccgctgcgcaagcgccgcgaccaccgtgcgcaccgccgtcgcggtacgaccaccgcgaccaatgactcgaccgagcgcttccgtgggaaccgtcaccgagagcgacagctcaccatcgcgcaccggctcgtggcgcacgacgacgcgctcggcaacctccggcgcgagtgatctcgtgaggtacaggacgagcgacgacgctcgctcgattgcgagcccctgcgtcggcgagatcgacggctcgctcgtcgcgggcacgttcgcggagtcgtccactactcggccgcctgcgctcgcgcgagctccaacagcttcgcaacgcgctccgatggggtcgcccccttcgcgatccacgactcggccttcgccagatcgatcgagaagctcgacggctcctggcgtggctggtaccaaccaaggatctccaggaaccgaccatcgcgaggggtccgcgcatcggcagcgacgatgcgatactgcggctgcttcttcttgccggtacgagtgaggcgtagccgcactgccatcgagagggactccttccgttccaggtgcgccaactcgggcgctcggtcgaacagtctagacgcaccgacctcgccgttacttccgcttgcgccgaggaggcttgcgtcgcttggtcgcactcggcgcgccaacacccgcttggcggagcaccttgtgcacgtcgcgaaactgcttgagcagcgcggcgacctgcgctggttgtgtgcccgagccacgcgcgatccgagctcgcctcgatgcatcgatcatggtcggattgctccgctcttccctcgtcatcgacgagatcatcgcctcgatgcgtgtgagctccgcatcatcgatgtcctggttgcgcaactccttgggaactccgggcagcatggccagtacccccttcaggggcccgagccgacggacctggcgcatctgctcgagcagatcgttgaggtcgaagcggccctggcggagacgatccactcctcgctgggctacctcgtgatccatcgtcgactcggcccgctcgatgagtgagagcacatcgcccatacccaggatgcgcgatgccatgcgatcggggtagaacggctcgaagtcttcgagcttctctcccaccgaagcaaaggcgatcggcttgccaaccacctcgcgcaccgagagcgcagcgccccctcgtgcgtcgccatcgagcttggtgaggatcacggccgagatcgagaggcgctcgtcgaacgcctgagccactcgtaccgattcttgacccaccatcgcgtcgacgaccaggaagcgatagtgcggatcgatagcctccgacaccatctgcacttcgcgcatgagggcttcgtcgatggccaggcgacccgctgtgtcgacgatgacgacgtcgcgcccaagtcgtcgcgcctcggcgacaccgtgacgagcgaccgtcacgggatcgtccccgtcgctcacgacggcgacgccggctcgctcgcccaagatccgtagctgctcgatcgcaccagggcgctgcaggtcggccgcgaccagcaacggcgaccgtccctcccgtagctgcgcgagcgcgagcttcgcagctgcggtggtcttgccgacgccctggaggccggccaggaggatcacggtcgggggtgtcgaggcgtagcggagacggaagggctcgccgccgagcacccggaggagctcatcgtgaaccgccttcacgacctgctgcccgggggtcagcgatgccgacgccatcgcaccgacagccgcctcttcgacgcgggcgaggatcgtgtcgaccacacgcaccgcgacgtccgcctcgagcagcgcgactcggatctcggcgagcgcttcgtcgacgtcgcgctgggtcagtcgactcttgcggcgaagacgacccagcgctccgtccaacctgccactcagcgtctcaaacatcggcctcgtctcctcgcatggaatcgggtcccgcctccgatccactcatgtcgagcaaggcatcgacgaagtcatcaggatcaaacggttgaaggtcctcgagggcctctcccaccccaacgagcttcaccggcaccttgaactcgtgctcgatcgcgagcgcgataccgcccttggctgatccgtcgagcttggtgaggacgaccccggtgagcccagtcacctcgccgaacacgcgggcctgactcaacccgttctgtcccgtcgtcgcgtcgaccaccaacaagacctcgtcgacgtggccggccgccttctcggcgacccggcggaccttgccaagctccgccatcaagttcgccttgttctggagacgccctgcggtgtcacacacgacgaccgcggcgccacgcgccttggctgcgtcgaccgcatcgaacacaacggcaccgggatcggcaccctgctggcccgccaccagccgaaccccggaacgctccgcccagaccgcgacttgttccgttgcggccgctcggaaggtgtccgcagcagcgatcaccacatctccccgctcgcgcaagcgcgctgcgagcttgccgacggtcgtcgtcttgcctgccccgttgacgccgaccacgagtatcacggtcggtagctctgccgctaccgcaagcgatcggtcgccactcaggaggcgagcacgcagggctctccggagagcctgccagaggtcatctgccgacgcgccgcgtcccgtctcacgtcgaacctcatcgaggaccgccgccgtcaacgtggggccgagatcactctcgagcaggacctcctccatcgtctggaagagcgcgtcccgatcgagcccgccgattcgccgacgcaggtcccggaaccgacccgatgagcgtcgcatcgcaccctcgagggtgcgcggacgagactgaccgatgaccgctgcggcttcgtccggcgctgccgattcgctcgccggaatcgactcttcgcgcgcatgcgggcccacgcgtggacgacgacgaacaagcagtgccgccgtggcaatcgcgaacacgagaacgaccagcaatacgatgtccaagaccatcgccaaagagcgtaggcgaccggcacaggagcgtcgccgaccaggcagacgccgtgctggccgcgacgtcaatcaccattggtcggtcgggcagcgccaggaccatcgctacgaattcttcctcggcaactgcaacgctgggctcagtcgtagcgattgcccctgttgccgccacaggggcgcggccctaggacaaggaggaactatggcactcggagtcggctcactgagcaagctactcagcatgctctcggcaaaggccgccatcgcgaccgcatccgccgtcgttgcgacaggcacggtggcagcagcggccactggaaaccttcccgcatcagcccagaacgtagcgtcacagctcgcggcgtcagtgggcatcacgatcccaacagccacggcagtagccccgaccgcgtcagcgacgccagccactccggcgacgccagccactccggcgactccggcaacgccagccactccggcgactccggcaacgccagccactccggcgactccggcaacgccagccactccggcgacgccggccactccggcgactccggcaacgccagccactccggcgacgccggcgagtcacgacaactcccctgacaccgcacagcaagagctccagtcttccaacgaccatcagcagagcacggatcagcagagcacggatcagcagagcacggatcagcaggtcgccaatcccgggaccacgctgacctctcctgctgggacaacgagccaggacggctcgagcagcgactctcaggcgagttcaagcacgcagagcagttcatccgacaactaaccgagcggacgctgcacgcgccacaccacaccatcgcagcgtgcaggcccagtggaacgaggagcgaacatgccggaggcggcgatgtcgaccgacgacgcgcaacgcgagtccgtcgacatcgatcgcctccgtacaggcgacccggacgaattcgggcgatgggtacgtcacgttggcccggccctacgaggattcctccgcgcctcaggagttgcagacgtcgacgacatcctgcaggatgtgtggcttcggctggtccgttctctcagtcgcttcgacggcgacgaagacggtttacgccgcctgacgttcacgatcgcctatcgatcgcgtgcggatgcactacgcgcgcttggacggcgccgcgaggtcgctttcgatcctgccgaactcccacatccgacgttgtcgccggaggacatcgatgacggcaccgtcacagccctcctcagacggctaccggagcagcaagcgctcgtgatcggccttcgtgtcttcggcggcttcgctgccactgaggtaagcgacatgctcgggatacccgatgcgaccgtacggagcctcgcacatcggggactcaaggccatggcacggctcctcgagcaacaatccccgtcgtcgctggaggcaccctcgtgagcacttccaccactttcaccgaccgcctcacggcgcttgcgagcgaggtcgcgctcgagaccagggaacaagagctactggcgacggtctgcgcacggtcgtctgcttggccgacggaactccccgacagctacgttcgcaacgtcacggagctggtcacagcagagttccgcaatctcgcagcatccaccaccagccagcgtcgtgccacacatgcgtgggcctcgtggttccgctctcgctggctcatcgtcgcggcggtcctgagtgccgcaagtgggggcgtcgcgttctccggtgccctcgcccacgctctccaccgtgtggagtcgatcgtcctcgccccgacgccaagcacccaccaagggacgctgaacggttcgcaaccagccattggctcatcggccggcataccaccgtcgggtcttcgcgaacaggggggccaacagtcctctggctccgcgacagcgacggcaaccccagcgcagagccgcgacaccggcgacgaacaccacccgcttggaacggtacgatcaatcccttcgtcatcgccaccggtcgaatcgcctacgccgaacgaccaagcacccccatccgacatcagccagcaagctggcgacgcttcctcgtcgcctgctccatcggaccacacggacagctcctcgagcccctccgaccagtcgaccagtacgaccgggtcatcgaaccagtcaaacacgacatccacgtcgcaggaccagtcgagcagtgcgaccgggtcatcggaccagtcgaacacgacatccacgtcgcaggaccagtcgagcgccgctacgtccagcgccagcagctcgaacccagacaactaggcgacgaagacccgtcggagtccgcgagcgacacgggacgtcgcgtggctagtccgtcgcgacctgaacgccctcaaggcccgcctcgccaaggtcatgacgcacgaccgtcgatactccgctcggcgcaatcgagacaccaagcagcacatcggcggcctccatggtccgtcgctggtgggtcaccacgagcacctggctcgagcgtcccacccggcgcagcagttcgaccagacgagtcagattgcgctcgtcgagcgcggcgtcggcttcgtcgagcacgagaaacggtacgggtcgaacctccagcatggcgaacaacagcgcgagccccacgagcgagcgctcgccgcccgacagcaacgccaaccgacgcacgcgcttggttggcagatcgacatcgacacgaaccgtcgccgccagcggatcggcaccagcctcgagctcgaccgaaccgcctccgccagggaagagctccccaatgatgctccgaaacgccgacccgacctcctcgaccgtggtcagcacgcggcggcgcatctcctcctcgagccgctcgagtccctcactgatgacagcccgcaccccacgggcctccgcaagcaccgcgccgagctcctctcgtcgagcgtcgagctcgcgcaactggacactcgcgagaccgttcacctcgccgaaggtccccaaggcatcttcgacctcgtgcaacgtccgctcaacgtcgttcggtgcgacatccgagggcaggcgggcaccttcgatgtcagcgagctcgacgtggaggcgaaggcaccacatctcttgctcggcggcgagccgggctcgagctcgctcggcgcgccccatcgcctcgagcaatcgctcacgcgccgtcacgagcgctgcctcggccgaccgacgttgcatccgcagccgctcggcctcggcacggtgccgcgactcccaagcaagcagcagctgcagctgctcgtcaagaccgcgcagcgtgagggcaactgcgttcgccaaagcgtgggcacgctccacgagctcacgtggtactggcgtcgcacgaaccctggcctcgtcaaggcgcgcacgttcgcgctcgagctgatcgaggcgctcccgagccgccaacgcccgctgctgctctcgagtcgcatccagtcgcacgccgacgagctgctcatcaagcgcttgccgagcccgctctgcggcctggccagcttcgatggccatcgccagtcggtcggccgccgccgcctctcgcgcttgaagttcggcggcgcgacgtccgacatcctcgtcgacgtcctcgatgtcgacagtcgggagctctgtcgcgaggcgcgcgacgaccgtcgcgcgatcgcgatcgatccgcgcctgctcggtcctgatccgctcgagatcccggcgcctcgcttcacgacggttgagctcctcgacatgcgtgctgcgacatcgctcgacaacggctcgcgcctcccgaagcgccgcatcaacggccgcgagctcctcgccgacgccctggagctccgcggcgatcgtcaccgcctcatcctcgagctgacgccgtcgtagccgcagcaacgcacgaatgctgcgaccccgccgaatccacccatcgtcgctcacccagccggcagcgtcgacgaggagaccgtgcgctcggccgacacgcacctcctcgagcacgctctcgacgactctcgcctgtgcgagtcgcgcacccagtggtccgggcgcccaacccaccgccgcactcccgtgctccccttcgacctcctcgatgacgacggcgctttccacctcgaccgtcgggtcgagctcgccgaccgactgaacgatccgcgcctcggcgagctcgccgagcgcagcaagcgcgacgtcaatgccagctgtccccgaacgcacgacatcgatcgtcagtcggccctgcccctcgtccccgacggcctcgagcacgctccgcagctcaacatcgatgcgacgtgcttcggccgtcaaactgctgtgtcgttcggcaaggactgcacgatctcgctgaacacgctcgaccagctccccggcctcggcgagctcgcgggctgcgtccgcgagcgcctcctcggcctcggccaacgctgcctcggccgccgcacgctcggcggccaacgccgcatctcggtcgttcaagtggcgctcgagctcgcggtcacgcgcccgttcgagccgcacccgctccgcctgcgcgcgcgcacgctccgcggcccgctcgcgctcctggagaagcgtctcgagacgcacgcgctcgcgacgcacctgatcgagctctgcccgcagcggctcgacgtcgacggtctcgatcgcggctcgttcctgctcgagacgctcgcgcatcagcgcgagtgcgcgtgcgcgctcctcgagtccggtcagggtcgcgaccacctcatcatgctcctccgcgatcgcccgccgtcgctggtcgcgagcacgctcggcatcgacgaggcgctggtgctcatcgatcgacgcgatcgcccgtgtcaagcgcacctcgagctcgcgaagacgccgcgcaccctctgcgaccggctccgggtccacacgaggcgcatcgtcgacctccccctcgaggagtacgagtgccgcctcggcatcggcaacgtcgcgactgcacgactcaacgtcacgctccgcagccgcaagctcttcggcacggcgctcgagcgctcgacgagccgccgcgagcgcgagtacctgccatcgggcctcgagcgcgcgacgtgcctccgcgcgctcgacctgcgcgaccagcggtcgacgttggcgtcgaaggtctcggtcctcgcgctcgagctccgccagcgcctcctccgcacgccggagttgctcgagggtcacctgccgttggcgccggagcagcgtgaccctcgatgcgtcctccagcatggtgcgcaggacgtcaccggacgccccagcgagggcatcgatctcgccctgggagacgacgacgtgttggctccgaccgatgttcgccccttggaggacctccaccacgtcctggagacgcgccgcacggccgttgattcgatagctcgcctctcccccacgctcgactcgccgggtcagagcgatctccgcgacaccaagtccgctctcgtcgtctgggtcgtccaaggtgagttcgacctcggcccgaccgagcgcaggacggtgcgcgctgccctggaagatcacctcgtccatgcgagcgagtcggagcatcctgggactctgggtgccgagcacccaggtcagagcatcgacgacgttcgacttcccggatccattgggcccgacgatcgcgttgatccccgatccgaatcgcaccgtgaccggatccgcgaacgacttgaaaccgcgcatcgtgagcgcacgtagtcgcactcagccccctccctgctggcaccgcgggcaccagtgcgctgatcggccctgcaagaccctccggacgatcgacgtagcgcacctggggcacggactgcccgcacgttggtagacggcgaggcgcgcgccaaaggcgccaggccgatcgagcgggtcgcgataggcccgatccgcgaaggtcgtaccgcccgctgcgagcgcctcccgggcgacatcgcccgcagcctcggcgatcgccacgaggcgtcgccccagcacgttcatcggggtgctcggatggacaccgacacgaaagagggtctcgtcagcgtacatgttgccaagacccgccaccacgcgctgatccaggagcgccgtcttgatcgcacgccgagacctcgcagcgtgccgttcgaggctcgctgcgatctcctcctcgggaccgaacacgtcgggaccgagccccgcgagccgacgcggccgcccgtcggtgccgaggacgtcaacgaaggcctcggagaacgtgcgcggatcgaccagtgtgatgacggcgcgacggaagtcgagaacgagctggacgtgggtcgccgtcgccgaggcgtccgagacgacgagacgtccagccatgccgaggtgcacgaccagcgcgtcggtgccgagatcgaacaccaggaacttgccgatgcgtcgcatcgacacgatcgggcgccccgacaccgtcgccaagagctccgggtcgtgccggcgcacgaggcgccgtccaaccatgcggatcccctcgagcgtcgccccctcgacacgtgcggccagcacctcgcgcacccgctcgacctcaggcgcctccggcacgctccggctccgatgggcgtggcgaggcgcggcggctactgcgacgccgcgggggtcgcgagggagcctccgtcgttgcctgagcgaggccggcagcttctgcccgacggttcgcctcgaggatcgcaaggcggcacgcctcctgctccgcctccttgcgcgacgccccttcgccggctgcctcgaagcctccaggaagctgcacgacgacccgatagcgacggtcgtgatcgggcccggaccacgagactttgtagcggggtggctggtggtgcagcttggcgagcgcttgatggagcagggacttgtagtcaccgagcaccaggtcgccatcgacgcgctccagcgagggcccgaggatcgcgaggacgaacgcgaccgagagctggaatcctccggcgagatagacagcaccagcgagcgcctcgaccgcgttggccgccaggacagggccaagagcatctgcttggccgaccgtgatcgcctcgagcagcccgccttggaccccgacggagccgagcgagcgtcgagagacgagagctgagcgcacctgggtcaggcgaccctcatcgacgtccggatagcgccgatagagatagtcggagaccacgagctcgatcaccgcgtcgccgaggaactccaaccgctcgttggagtccagcggatcgcggctcgctgacttgtggacgagcgcttgacgtacgaccggatggtcgcggagcgcagcgggaatgagctcgaggatcgaccgctcccgccgcttcgctcggctcacgcctctcgggtcacgccgagcacctcggcgacgtagtcaacggcgtcacgcaacgtacggagatcctcgagatcctcgtcctcgatccggaaggtgtgatcgccttgggagaactcggactcgatggcctccaccagctcgatcaacgccagtgaatcggcgtcgaggtcgtcgacgaacgacgaactctcgctgatgcgcccttcgtcgatctccaagatgtccgcgagctgcttgcgaatgacctcgtagatcgcggctcgagtcagttcctcaggcacggttcgactccttcgcttcgtagtgtcgaatggtcgagacgacgtctccctctgcgagctggaccgcgttgcgaatcgcactcgcgactgcccgctcgttcgaggcgccatggccgatcagcaccaggccgtcgacaccgagcagcgccgccgcgcccgtggcatcgggcgtcagctcgttccacagcgggagcagtcgctcgatcgcggcgtcggcgaccgcatcgctctcccctgctggtgccaacgccgacagcaccgcatgcgcaaaggtgcgggccgcgccctcgagcgccttcagcaccacgttgccggtgaaaccgtccgtgacgacgacgtcgacgcggtcgctcatgacgtcacgcccctcgacgttgccgaggaaggtgatccgcgcatcgccctcgaggcgcgcgaaggtctccttgacgagcgacgtccccttcccgggctcctcgccgatcgacaacaggccgacgcgcggcgcctccagcccgagacgcgctcgagcgtacaccgtccccatcaaggcgaaatcgtgcagccacgccgcttggacctcggtgttggcgcccgcatccaacagcaccgtcggggtcgcgcctggcaccggcaactcgaccgtaatggccggtcgcgccacgcccttgatccgacccaacttgagcaacgcggtcgccatcgcggcgccagagttgccgaaggtcaccgccgcaccggcgcgaccttgcttcacgagctcggtcgcgaccaccatcgaggcgtcgcgcttacgccgaggcgcgctcgcagggtcgtcggtcatctcgatgacctcgctcgccaccacacgctcgacgccgctcggcaacgccgcgagtgcctcggcggtgccgaccgcgatcacggcggctccctcagcccgcgcgatgccctccgcgaccaccgctgagccgaggtcggtccccatcaggtcgaccgcaatcggcagcacgagcccctagccctggatctcgaccgcgggacgaccgcgatagtagccacactgcggacagacggcatgggagcgcttcgccgcaccgcaactcgggcaactggccgcgccggcgaccacgaggcgccacgccgatgcgcggcgagaccgggacttcgccttggaagtcttcttcttaggaacagccatcgtctctcactcttccttgccaccgggaccgggggatcatgctagcgccccgagccaccctcaccttgcgactgtcccagctcgtcgaggatcgcgaagggaccgtcgacctcgggttggcactcgcacggaccctcgttcaggtccgcaccgcagcgcgcacacagcccacggcactcatcgcgacacagaggcagaacggggagctcgagcaccagcgcatcgtgcacgaactccgacacgtcgaggacgtcgccgtggtaaccatacgcatcgtcggtggtggggccctcgcgatagagctctcgcccttcgacgacgagtggcccttcggctggtgccaggcatcgcacgcactcgcctcgccaccgtgtggttgcacggagggtcaccagcatgccttcgccaaccgcctcgacgtgaccggccacctcgatgggctccgtcggctccacgcgcgacgacgtcaccgcgatgtcatccaagctgccgacgaatccgaagcgctccaaggcggcgctcccgtgtcgcagcgcgaccaccgacaccgcgaactcacgcatcgccgacctcctcatccagcgcctctcccgacgccagcgcactcggcaccgtaccggagcccgccgcttggagccgctcgcggccgcgccgggtcgcggtcaagagctcgtcgagcgcgatctccaccgctgccagacggcgatccaggaagtcctcggtctgcaaccggagccgcgcagcacgctccttggcatcgagcacgatgcgcgcggcttcgtgttcggccgctcgaacgatctccgtgtgcgacacgagcgcctcggcctgctgacgtgctgcgtcgaggatcgcctcagcctcgagcgaggctcgcgcaaggaactgctcccgctcgcgcagcagccatcgtgcctcgcgcagctcctcgggcaacgactccatcgcttcgtcgatgagcgcaaggacgtcatcacgtaccacgatcaccgacgccgagaggggcaccccgcgcgcctcgctcacgagggtacgaagctcctggagcgccgcgagcgtcgtgctgccgtcggagccaaccgccgtcaaggccgacccccgaggcggccatcgagcgccttggcaacgacgacgggcacgaacgaggtcacgtcgccgccgtaggctgcgatctccctgatcaacttcgacgacaagaacgagtgttcggacgatgtcgggacgaagagggtgtccacgccggacagcgtgcgattcatctgcgccatctggagttcgatctcgaagtcgctgaccgcacgcagaccgcgcacgatcaccgttgcgtccactgcccgtgccagatcgacgaccaagctcgacaacgctaccacccgaacgttctcgaggtcatcgaccgccgcagcgatcaacgccatgcgctcatcgagcgagaacagctgcgacgccttctgcgggttacgcatcgccgcaaccaccacctcgtcgaagagcgcactcgctcgctcgacgacctcccggtgcccgttgtggaacgggtcaaacgaacccgggaataacgcgcgcctcactgtgcctcccgcgctcggctcgtctggtaggcccgagcggctcacggcgccggaacgaagagcccgacctgggtaccaccatagcgccgccagcgctccgctcgccaacgctcgccgagttccaccggagaggctgcctcgacgacgacccaacgagcgttcgggagctgggggccgaggtcctcgaaggagcgccggacgtagggcggatccacgaacaccacgtcgacgtccatcgaacgcccctcggacgcgaggaaccgctcgacgctcgtcggacgaacgctgagacgggaggcgacctcgagtgcgtcggcggcacgccgcacgtcggctgcgagtcgcgcatcacgatcgacccacacgacgcaggcggcaccgcgcgagagcgcttcgaacgtgaggccaccggccccggcgaagaggtcgacgactcgcgcaccctcgaggtcgacccgcgcctccaccatcgcaaagatcgcctcgcgcacgcgagctgcggtcgggcgcgtgccgctcggcacccgcaccgggacgacccgaccaccgagggatccgccgatgatacgcagcacgcctagctccggagcaggtatgccagctggtcggggtcggcgaccagtgcgagttcccgcgcgagcctcggatgctcgcggaggctcgggtcgacctcgagcaatcgggtggcgtggtggcgtgccgcctcgaccaaggggcgatcgcgcacgaccgaggcgagcttgaggtcgctcctgcccgattgacgcgcaccgaggaccgtgccctcgccgcgcagcacgaggtcgacctcggcgagctcgaagccgtccgtcgtacgttcgagagcctccaggcgcgccgccgtcgggccctggtcggtctcggcgagaaggaagcacgccgacgcgtgctcgccacggcccacccgaccgcgcagctgatgcagctgggcgatgccgaagcggtcggcgtcttcgatgatcatcacggtcgcgtttggcacgtccacgccgacctcgatcacggtcgtcgcgacgagcacgtcgatgatgcccgctcgaaacgccgccatctgccggtccttctcgcgcgccggcatgcggccatggagcagtccgagccggagtccggcgagctccgagttgccgagcctggcgaactcttcctcggccgagcgcgcctggagccgttcgctctcttcgacgagagcgcagacgacgtaaccctgccgacctcggccgacctctgcccgcaggtagtcgaaggcctcgacgtaggcgctccgttcacgcagccacttcgtgcggatcggcgtccgccccggtgggagttcgtcgatcacggagaggtcgagatcgccgtagaccgtcatcgccgcagttcgaggtatcggtgtggctgtcatgacgagcgtgtccgccacacgcccggcgatctccgcatgacgatcgcgcaacaacgaacgctgctccacgccgaagcgatgctgctcgtcgaccacgacgagcccaagcgaagcgaggttgactccctcggtgagcagggcatgggtcccgacgaccagatcgatcgttccgcgggccaacccctcgacgatgtcggctcggcgcttcgaggccacagtccccgtgaggagggcgacctcgatcggcgctacctcgtcatcgaagaggcccggtgtgcgctcccgagcctcacgagcagtgccaagcagcgacaggatcgtgcggaagtgctgttcagcgagcacctctgtgggcgcgagcaacgcggcttgatggccgccttggatcgcgaacagcgcagcaatcagcgcgacgagcgtcttgccggctccgacgtcgccctggaggagccgatgcatgggccggtcccgctgcatgtcaccggcgatatcggtgaccactcggcgctgggcagccgtgagtgagaacgggagtcgggcgagcagttctgccacgcgccgaccggtcccaggcccgaacggagcaacgtcgtgggcgaagccacgctggtgagcatcgcgctcccgtcgtacgagaccgagcatgacctggatgcgaaagagttcctcgaaggcgatgcggcgtcgagcttcgagtcgctgctcgagcgtggccggcgcatggatggcgcggagcgcttcctcgcgcccgagcagacccagcgcatctcgcaccgccctcgggatcgtctccgcgatcggggagaagcgctcgaggagtccgagaaccgcactcgcgatggcaccagagtcgatcccggccccgtcgcgcagcggatagagcggcacgatccgacccgtacggtcgccgatggggtcgacgagcgggttgacgagctgacgctccttgcgaaagagttcgaccttgccgaacacggcgatgtcgccgtggagccgtccgagctgcttcgcacgccacggctggcggaagaagcgcagcccgaccgaccccgtctcgtcgaccagccgcgcctccaccagcgtcatggagcgcttgcgcgtcggcacgacacggacgctggcgatgcgtccgatcagcacgacctcttcgcccggaaccgcgtcggcgatcatgacgtggcgggtgcgatcgacgtagcgccggggatagtaggtcacaaggtcgtaggccgtcacgacgtcgagcgcctcgagacccttcacgaccttcggtgacagccacgcaaggtccgcaagcgccgtcgctgcgagatcctcgagtccgacgccactcattccacgccaagcaggtagggatagagcggctgccctccctcgatcacctcgagttcgacaccgtgatggcgatcgaacacgcccgcaagggccgcctccacgcgttcacgatgaccccgctccccgacgatcacggtcacgatctcgcctccgggctcgagcaagcgctcgcacaggccgacgagcacggcctccgggtccggtcccaccgacacgatgccttgatcgctgataccgatcgcagaaccggcaccgaacaccccgccctgccaggatccatcgcggacggcaacggtgacctcgccccagcgaacccgtcgcgcggcctcggtcatgcgccgctcgttctctgagagccccgactctgggtcgtaggccatgagcgcggcgaagccctgcacgaggtggacggtcggcacgatcgcgacctcagcgtcgacgagtccgatcattgccgaggccgcagcgaggatgttggcgttgttgggcaggacgatgacctgcttggcgtgcgtggagcgcacggcatcgacgagttctgcgatcgacgggttggcgccttggccccctgcaacgatgctggcgacaccgaaggaccgaaacagccgcgcgatcccgctccccgtgccgacggcaacgaccgcggtcgccggaggcgacggctcggctgctggcggcgcgtcgcgcacccaggcgacttcgccggtctgctcacgcagatcggtgacggagagatcgcgtacccgacccgcgtcgatgccgccttggatggcggcagcgatgtcgttcgtgtggacgtggcaacgccagacggtgccatcaccgacgatcacgatggagtcgccgaggccggcccagaccacccggagcgcgtccacctggcgctcgggtgcctccagggagaacatcacctcgtagcgcagctcgtcctcgcgatcggacgccaccagctcggccgccgacagatcacggacgctcgcgaccgggaccgcgatgtcgtcgagccatggatagggaccgacgctcgtcgtgagtccgagcgcagcgctcatcgcctcgaggacgacgaccaagcccgcgccgcccgagtccacgacgccagcggctgccagcaccgcgagctgggtaggggtgcgctcctcggcggctcgagcagcgtcgatcgccgcggcggggtcactggccccagcggcggcgtcgatgacgctgagcatcgtgccgggcttcgggtccagcaccgccgcgcgagcgctcgccgacgccgcctcgagcccacgcatccatccgcgcgctcgatcagggtcgctggcgagttctcgtacgagcgagcccaggatctgggccaggatgaccccagagttcccacgcgccgcgagcagagcgccacgagcgacggaaccggcgaacgccgcgcagtcgtcggtatcgcctcggcgagcagcctcggccatgccctcgagcgttcggagcatgttcgaaccggtgtccccatccgggaccgggaacacgttgagccgatcgaccgcatcacgcaccgacgccaacccggcgacggcagcctcgatcgcctgcgtgagctgtgcgcaggcactctgacgttctgccaccgcccgcatgctagcctcgaaggcccgagacgtcgccgagcctcgtcgctcgcgccgtcctcacgatcgtaaaggagaccgaatggcgagcgtctgcgagatctgcggcaaggggccgcgcgtgggcatgaagctgtcacattcccaccggcgcaccaagcgtcgcttcctcccgaacgtccagcgcgtgcgcgtcctcgaaggagccacgacccgtcggcggttcgtctgcacgtcgtgcctccgagccaacaaggtcgtcaagccatagccacgatgggcccgacgcgagcgctgctctggctctcgtttggatcacccgagcggccggaggacatctggccgttcctcgagcgcgtggtcgctgggcggggtgtcccgcgcgaccgtctggcgatcgtgcacgaccaatacctcgccactggaggctcgagccccctcaacgcactcaaccgcacgttgatcgaacgcacccgagcagcgttcgacgcagccgacatcgacctgccgatcgtgttcggcaaccgaaactgggatccactggtcgacgaggcggtcaaggagctagggaggctcggtgcgaccgacgtcctcgtgttcgcgacctcggcgtacggctcctactcggggtgtcggcagtaccgcgaggacgtcgaacggacgaatcccccattcacctggacgaaggtgccaccgttcgctggccatccccgcttcctggcagcccaacgcgagatcctcgcgtcgttccttgcgacccacgatctcgaccccgagcacaccttcgtcgtcgccacggcgcactcgatcccggtcgccatggccgccaacagtcagtaccagcgccagcttgccgaggttcgagcagcgctcaaccaggttgctcgcacctacggcctcgtcgtcgaggaggcctaccagagtcgctctggcgatccgcgcacgccgtggctcgagcctgacgtcggcgatgcgatcgaccgcgccgccagcgagcgcacgctcgccgacgtcgtgtgcatccccatcgggtttctctcggaccatcaagaggttcgctacgacctcgacatccttgcccgcgaacgcgcagaagcccgcggcgcgaggttctggcgcctcgagaccatcggcgaacacgggccgatccccgagatcgtcaccgacttcacccaggcctggctcgaggggcgagacctcagatcgctcctcccgtctgagccggccctgtgcaccggcacctgctgccagcccctgcacgctcgacccagcaggagtgtgtcgggcgcgtaacgactcgatgacacctccggccgacggcgcgggatcgttgcgggtcgagttgctcgtggcctaccatggtcgcacgacatgaagagtgcgaacgaagtgggggcatcgtggttcagcgacgtcgaagtcgggtcctgaccgtactggcaggcgcagccctgttggcggcgtgcggcagcactgcccagagcggttcatcgagcacgtcgagttcgtccgccgcgaacggcatcatcaccttcgccgaacaacccggtgcgagcccgaactggatcttctggctcacgcccggatccgacttcaccgttgcgaacaacgatcagttccagtatctgctgtggcgtccgctctacgtgttcggcaatggagcaaaggccgagatcaactacgcgctgtccatcgggaatgcgccggtgtactccgatcacgaccgcgtcgtcacgatcacgctcaagcattggatgttctccgacggccagcccatcaccgcacgaagcgtggtcttctggatgaatctcctcaaggccaacaaggccgactggggcggctacgtacctggtcagttccccgacaacgtcgcatccgtcaccgcggtcaacgcatcgacggtccgcttcgacctcaccggctcgttcaatccgacctggttcacctacaacgaactcagccaggtcgttccgcttccgatggcgtgggaccgcacctcgctcggcgccccagccccgaccgcctcgaccccgaacctccccgacaccacgacccaaggcgcccaagcggtctactcgttcctcgccggccagtcgaaggatctcgccacgtacgcatcgagcccgatctggtcgatcgtcgacggcccttggcgcttgaaggccttcaccacggacggtcaagcgaccttcgtccccaatccggcctactcggggccgatcaagccgaccgcgaaggagttcatcgagctgccgttcacctccgacagcgccgagtacaacgtcctcgcgagcggccaagggcagatcagctacggctacatcccgagtaccgacgtcgagcagaccgcgcacatcacccagctcggctaccacgtctcgccctggacggtgttcggcttcaactacatcccgatgaactaccacaacccgacctacggcgctgtcttcgggcagctgtacttccgccaagcgctcgaacacctcatcgacgaaccagcgtggatctcgaccttcctccacggtgacggaacgccgacctacagcccagtgccggtcagccccgccaatccgttcatcgataccacgacccgccgtccggcctacccatattcgccggctgcggcacgctcccttctcgagtcccacgggtggcggctcgtcaacggcatcatgacgtgcgagtcgcccggcaccgctgccaacgagtgcggcaacggcgtcgccaaggggacgagcctctcgtcggtttcgctcgcctacgcgagcggcgtgccatcgctcgcccaggagatggaggcgttcgcctccgcagcccacagcatcggcgtcaacatcgtgctgtcctcgaagcccttcgacaccctcctcggaggactcggtgcatgctcaccctcgcaagcactgtgctcatggcagatggtgaactggggcggcggctggacgtacggtccggactacctgcccacgggcggcgagttctacctgccaggagcaggagccaacccggagagcttcgcagaccccaccgcgacctcgctcatcgacgccacccacaccgccacgaacctcaccccggcccttgatgcctaccagaactacatcgccaagaccctgccggtgctctaccagcccttcccggcctaccaagtctcggcgatctcgacgtcgctccacggcgtcgtccagaacccgtacgggatcttgtatccggaggagtggcgccagtcctaagcgccgagccacggatcgcgaaatccgcggtggccgcgcgtgagggcgacgacaccgtccggcccccaggatccccgacgatacgggacaaccgggttgggatgcgcgaggatcggatcgacgatccgccaggcctcctcgacgacgtcctcccgggcaaaacgtgctcggtcgccttcgagggcagcgaggaagagcacttcgtacggctctggcgaccgaccgagttctgcccggaacgagaggtcgagatgcaccggcgcgagatggcgctcctcagcgtcgagcgactgcaaggtcacacgcagcgccgaatcaggatcgatccggaggatgatctcgttggcctcgaggtgctcgggcagccccaaggccccgagacgtggagggcgccgcaggacgaggcggacctcggtcgcggtcaccggcaaagccttccccgctcggaccacgaccggtacgccatcccaccgccatgaatgcacgccgagcgcgagcgcaatgaaggtctcggtcgtcgagtcggccccgactcccgggatggaccggtaaccctcgtactgaccccgcacgacgcgactcggctcgatgaggtccatctctcgcaggaccgccacgcgtgcgtcccacagtccatcggcaccaggccgactcggcggctccatgagcacgagcgccaagagctgcaacaggtggttgacgaccacatcgcgaagagctccaactgggtcgtagaagctgcctcggtcctcgactccgaagtcttctgccatcgtcacctggatctcctcgacgtgttctcgacgccacaacggctcgaggacctcgttcgcaaagcgaaggtggacgaggtccgcgagcggttgcttgccgagaaaatggtcgatccgcaggatggattgctcatcgaccacgcggtggagtcgttcattgagagcctgcgctgaggcgaggtcatggccgaaaggcttctcgatcaggtaggtgacctcgctcgcgatcggctcgcgctggagattctcgatgaccggcgcgaacagagcaggggggatctcgaggtagacgagagcctggtggacccgtcccacggccgaacgcagcgcatcgaccgtgtctcgactcgtgaagtctccacgcacgtagcgcaagcgtcgcccgagccggtcgacgaccgagggcttggcgtccgcgatctgcgagctgacggactcgcgcatcctcgtctcgagatcgcccgtgctccagtcgtccagcgcgacgccgacgatcggaaagtcgagcgccccacgctcctcgagacgatagagcgaggggaaggtcatcttacgagcgagatcaccgctcaccccaaagatcacgaagacatccacgaacgagcctcctcctaggggcgcagctgcgccccccacgtcgcctccagaccttcgccggccgtgagctgccagatatcgttgcccgtagcgagcgcgttcggcggcgcggtcatcggctcgacggcaagcccgcaccgacggcgctccgacgcgagcgtgtcgccgctgaagagctgaaggtatcgatacggcggtgcagcccatagtgcagccaccgcaccgtcgacgccggtgagcaaggcccacgcccgatccgcgccgagaagatcgagccggatggtgtggtcgagccgccgaccagcgagcgcgatgcccgagccgacgtctgcaagttctcggtcctcgctcaacgcagaaggcacctgaagccacgcgccatcgatggaacctgcgcccggagagaggtacgggtgatgtccgatcgcgacaggagccgactccgatccttcgttctcgacgatggttctcacgacgagtcccgcgtcacggagctggtagtgcaccgtcacggcgaggtcgaagggataccccggtgttggcgggatccgggtcgcgagcaccacttcgttcgttcgcgcgtgctccaacgtgaagggtcgccaccgaacgagcccgtggatcgcgttgcccgccgacggctcggtgaggtcgagctggaattcggacgtggccactcggtaacgaccgcccagcacgcgattcggccacggaaccagcacggcaccgtgcgcgccatcgcagacggagtcctcctcgtacggatcgagcaccgctcgattgccgcgcgtgaggacccgaatacccgctccgacctcgacgacgaccgcacggtactcgccgctcaccagcacgaactggctgccggacggtggtcgatgctgggtccctcgcacgcgcccaccctacatcggtcgccacccgacctccaagtgccgcgcatcgaagcgccctgctgtcgcccaggacatcgctcgacaccctcggccgggccgagcacctcggtcacgacagccgacagcgtgagagcagcgttgaccctcacgacggccacgagtaccagactgcgcagccgatctcatcgtctcgccgaactcgcaccgagcaacttcggagctccgcgatggacgaggctcctccgacagcgcggtggccctctgcccgatccatgacgttcggcaggcggaaccgacatacccgggagcacgcagcgatggcaccttgtccgcgagccggtgtgacgaatcgcgggcccagagcccgaggctcggggcggtcgcaccctcttcggcgatcaccctcccgatccgctcactacagtggctccacaagacggcccagcgcgcgatccacgtgcgacaacgggatactcgggacctcgacacacagcagaactctcgagacaccgcagagccgacgactcgcagccgtgcctgagggaagaagccgccccttcgggagtcagaacgagcagccccaacgggattcgaacccgtgtctccaccttgagagggtggtgtcctaggcctctagacgatggggccagagtgctcgaagcagcatagcgggctctggccctgcgagacgctactcgcagggccagaggtgcagagcgaatcaggacgacggtctagcgggaatccgaagctccaccctgattactgatgcttcggtagtacgagcgccagatcgcacggtagagcggcacgtgctcggggagtcgacgcaacccagggatgtagggcacgaacgcaaaggccaacgtgaggaccgccatgatcgccatgacctcgacgtcggcgttggacgaactcgccatcgggttcacctgataccagaacgtgtacagccacagccaggactgtcccgggaagttgccggtctcgttggtcatgccccactgcggggtcccgaggaggtgtcgctgggccccgaggttggcaaagtactgaccatcggcgaggaacatgagcggcttcgtgtagttcgttccgtagaaggcgctgtgcgattcgagggccgcgtccagcccaccgctccgtgcgatgacgagcaggtcactcaggagcgtcggaatcggcccgtacgatcctcgcggcacgatgagccgtgagcccacgacacgtagatgggcatcggccttcgcgaacgcggcgttccaagcggcgcgctgagcggcggtcgcatcgttgtacgtcgccaaggctggcgcaagcccaggagtcacggcctcagccaggcgcagcggctggaggacgaaggtctgtgccgcattgatcggttgggtgacgcccgcgagcttctggagggagatcggtccgaggttctgcacgaagccggtcccgttgttgtagggcggaccgtaggtggccgtctccgacgtacccgcaagctcggtcgcggcggtctgcacgaagtccaccggatctgccgtcgcccactgacggatggtcaccgctggatcatccggcgagccgaacacgatcgacaggccgagcgtcagcactgcaaccaccacgaacgcaatggtggcctccttcaggatgtcgtacggccgcacgcgtccgcgccacggcttcgcctcggcctctcgcggcaccgagccgatcggtgggaccacaccgcgataacgaaccaggaggacgtgaatcgccacgacgagcacgacgagcagcggcagcagcaagatgtgccacatgaacatctggccaaagttcatgacgttgaagaaggccccgataccggtggcgttcatggcgtccttggcctgcgtcgagatccattgtgagtcgaagttctgttggctcagatacccggtgaacgctgctccgatggacaggaggaacgcgagcacgccggtgatccacgtcatcgcgcggcgcccgcgccacgccgccatgaagaacttcccccacagatgcacgaccatgaagaagaagaacagttctacgctccacaagtggagggaattgacgaaatggccttcgggactcccatgccaccagtccgggcccttgagggcgaggatggcaccagagatggcgaccacgaccagtgcggacaacgtcaggacgccaaagacatagatccagcttgcgacgtagatcggctgtgtatctggcagcagcttctcaggtggcagcttccccgtcagggtctggcgaagccgatgggtccactccctcgacaacgtctcgggcgcgacgccgtcctcggtcgagatcggctggtcggtcttcatgaccgcctccgatcgtgcgacggaaacggcagtgcgagagccacgatgaacacgacgatcatcaacgcgatgatcaccgcgttcgccaccgtgatctggatcacgccccattggatgtagtgctgcttgccgttgagattgatcaacgcgccaagcacgagtggcaacaccaccccacctcctcatattcgcatgctgagaccaccagcacaggacggataataggcgatggcctcgtcgatcaacagggtcctaggtccccgacagaccgggaccctgggcagatcacggctacagagcgctgggggggccgtacgccgcagcccgtcgcgcatggtcgatcaccgtccgaaggtccgcgaacgcatataccagctctgcagtaagcccgcgaccacgccagagagctcgacgcgctcgctcccaccctggcgcgtcagcatatgctcgccccggtccgtcgaaccagtgctcgagcgccagcttctcgcgtggcgcaatgccccgatgccgttcagccgccgcaagggtcgagagcacgatcaggtcgtcgacacgccagcgcggaatgtcgatcggtgtgaaccgagtggactggatgagggcctgcaccgaggcgagcgaacccgggcgcgcatagcgataaccctgcacacaactaccaccgagacggagccacagaccgatctcctcgtcgacctcgacgccctcggcaaccacggacacgctgcccgtctcctcgagcgtcgcgagcgcagcaagcaccgaaaaggcatggtggtcctcacgcgcccgttgcacgaagctgcggtcgaccttcacctcgtccacctgcaagcgcgccagtgccgacagcgacgaagccgcagtaccgaagtcatcgagggacactgcgatgcgacgagcgcgcaccgccgccacttgcgccgccgcaagctcgaggtcttcgagagcgacgtcctcggtaatctccacgaccagtagggagccgcgaggcacgagctcgtccagatcgtcgaggaactcaccgtgcagaaagtgtgatggcgtgatgttgacggcaacgggaaccccgttgagcctctcggaatagtccgcgccggtcctgagtgcagcacgcccgagcgagcgtgcaagctccggcgcggcgcgaagctccgcgacgacatcgacggtcgcgatctcgggccagcgcaggagcaactcgacaccgaccacggtgccgagacgtgcatcgaccttcggctggcacgcgaaggtggctgcgcctgacgccagcgcatcgaccagcccatcacgcacccgccgacgccgctggacccgctgcgaaacgtcgccgccgtagcgaacccaccgggccttccccgccgccttggccgcgtagagcgcctcgtcggcggccatcagaagctcgcgagtcgtgcgcacgtcgtcgggcgccagtgcccacccgatcgacccggtgatgcgccaccgctgcccgatcgtgcgtaccatcacgctgatacgctctgcgatctgatctaggcggtgacgtgccgatccaaccagtgcgaccgcgaactcgtcgccaccgaggcgtgctacgaacacgtcgggggcggcgagccgagccagcgcgcgcccgagcgcagcgaggagttcgtcacccttcgtatggccgagcgagtcattgacgtccttgaagccgtcgagatccaagaatccgaccgctaccggctcctgcgcgacgagtgcgttcaatcgaacctcgaaggcggagcgattcatgagccccgtgagcgtgtcagtctgagcaagtcgctgctgcagcgcgcgctctcggtcgagtcgatcacgaagcgcgacctccgccataccgaggccgaggagttgggcaccggtgccgatgaccgaggccagccgcagctcgtcgacgccagcgtgagccaggccgactccgagcgtgtcgtggggcccatcggccgagccactcgtcggaacctgaacgagtaccgcgtggcgccacccgcattcggtgactgccgcgccagcaccctgctcgacggcgacgagctgcccgtgggcaagatcacggactcgacccaacgtgtcgaccacgattccctgcgatggccccacggcgcgggtgagtgcggtcgcagcacccggcggcacgcgcagcgctcgcacgatctcgctcgcacctgcgcgagcatcccagcgagagagccatgcccccgccaccaccccagagttcgcgagcgcccgcagcacggcctcctggacgtcctcgggtgcgcccgcagccaccacagcagcactggcatcgaggagtgatcgcgatacctgcgcgaccgcctcagtggtacgcaatccctgattgcgctcgaggcgagctcccgcagcgccaatcacgtcaccgagctggtcgaagagcgcatcggtgagcggtccatgctgctcgtcggcgacgctcaccatcaccacgcccatgagctcgccttggctgacgacgggatagcggaccaccacctgcccatgggcgaggcgcccagcggtgcgatcgagacgatatccagcccagctggcggcgacgccagcggtgagaacgcgttcgcgatgcaccgcagcagcgatcagcggcgcctccgctgcgcgcgcggggtcgaccacgacctcgacgacctcgagctcgcgacgaacgtcgtcttccgcctcgacgtggacgagtcgaaggacctcgaggccgtcctggcgacccgcgtgctcgtagaacgcagcccggtcgaccgcaccgcagccgaccagcgacgccgtcaccttggcaaagaactcacgcgacgaggactccgcactctggaggatcgtcgctcgcacctggtcgagcgcctggcgccgacgctcgagtcgcgccatcgcacgggcgcgaaacagccgtgagagctcgtgaccgagtgccgcggcgatgtcctcgacgtcgtcgggaagctccgctccccgtggacgatagagcgcaatgacacccgatcggtgcagtgagatcgacaccggggccacgactgcggagccgagtccccacgcgtcagccatcccgcgccaaagtgcaaagcgcgcgtcgtgcggcaatccggacacggtgacgcgcccggtccgcagtgcacgcccaaccggcccctgaccagcaggcagttgctcatcggtcgagagcgtcaggcctagggcatagggcgtcgcgacccccgctgccgcccgtaccaccacgccgggtccgagaccactgtgaggggtcccctctgcttcggcccagtacacgagcgggagaccggtgacacgaaccaccagatcacagatgcgctcgatggcgtcttgctcggggaggcccacgaactcgtcgaaactgttcgcgagctccacgatcgcgcgctcgagcgcatcgcgcgcctcgagtcgctcttcggcgagcatgcgcatcgagcgagagagtgcgcgctcgtgcgcgacgacgaggagcgcctcggtgccgagtccctgctcgacgagtacctgctccagcagtgcgtagatctgggccgcccgatcgaactcgacaccgatacggtgatgcatgcgcgcgatctgcgcaacacgctcgtcatcgacgtgccctcgctcgagggtcgaggcgatctcatcgaggactgcgtcggtcaacccggcgacgtcgacgacgttctcgtcgtcgagctcgagcgccgaatggacgagccgatcgagctcggcacgaaccgtagcgcgcacggcagcgagcaccgctgcgatccgtgcctgccccatcagctcgcttctcctacgcgtcaccttgcgacgagccgcccgacatcaacgcccgtggagtcgggcaccatggcgaagcgtagtgcgggctcaccgactcgactgagctatcggctcgaaccgcccgttccttagacggctgctcgatggcggcctctcggtctcaagtggcacccccacccgagaccgagcagaatgtgggtatgactgccttcgagctctcgcaagagcaagacgcctttcgtgccgtcgtgcgtgccgtcgcggaagagcggatcgccccgcacgccgccgacgccgaccgttctgcttcattcccatgggagagcttcaaagctgctcgcgaactcgagctgcccgcactcggcatcccccaggcctacggcggccagggagccgaccacgtcacccaggcggtcatgatcgaggagatcgcgcgggtgtgcgcgtcgacctcgctcgcgctcctcatctccaagctcggcatgaccccggtgatggtctggggttctgaggacctgaagcgacgctacctgccgcgcgtcgccagtggcgaggcccaggcgtcctactgcctctccgagccagacgctggatccgacgtcgcctcgatgaccacccgtgcggtccgcgacggcgacagctacgtcctgagcggcacgaaggcctggatcacgaacgccggcatctccgacacctacaccgtgttcgccaagacggaccccagcgctggccatcgcggcatctctgccttcgtcgtcgaggccgactggggcgtgcaggtggccaagctcgaacacaagctcggtgttcgcggttctccgacgggccaaatcgtcctcgacgaggtacgcgtaccggtcgccaatcggatcggtgaggaaggtcaagggttctacatcgcgatgggcaccttggatcgctcccgtccgatgatcggagcgcaagccgtcggcatcgcgcagggcgcgctcgacgcagcggtcgcctatggcaaggaacggcgtcagttcggtcgccccatcaccgacaaccagggcatccagttcaccatcgccgacctcgccacgcagatcgaggccgcccggggtctcgtctatcgggcctgcgctcggatcgacgccgacgagcccggaaccgagctgactcgcctcggcgccatggccaagctcttcgcatccgacaccgccatgcgagtcaccacggacgcccttcagctcctcggcggctatggctacaccatggacttcccgctcgagcgcatgttccgcgacgcgaagatcacgcaaatctacgaaggcaccaaccaaatccaacgcatcgtgatcgcgcgccaggtcctgaaggaggtcggagcatgaccgtcacacagctcggcgtcgtcggtggtggcctcatgggatcgggcatcgccgaggttgctgcacgacgaggcatcgacgtggtagtcgtcgaggccacggacgacgcggccaaggcggcactcgggcgcatcgagcgctccatcgcccgcggactacgctcgtccaaactctccgaggcagaggccgaggcagcccttgggcgcatcagcgtgacctccgacctcgaggcgctcggcgatcgcgacgccgtcatcgaagcggtgatcgaggacgaagccaccaagctcgcggtcttcgccaagctcgaccacgtcgtcacccgcgccgatgcgctgctcgcatccaacacgtcgtcgatcccgatcatgaagctcgcgatggcgacccaacgacccgagtacgtcatcggcattcacttcttcaacccggttccggtgatgcccctcgtcgagctggttccgtcactgctcacctcagaggcaacccaggagcgcgctcacgccttcgcggccgatcagctgggcaagcacgtcatcaaagccaaggaccgcgccggcttcatcgtcaacgcactgttgattccctacattttgtcggcggtcaggatgctcgagtcggggttcgcgaccgcagaagacatcgataccggcatggtcgatgggtgcgcacaccccatgggccccctcgcgctcgccgacctgatcggcctcgacacgaccatggcagtcgccgaatcgctctacgaggagttcaaggagcccctcttcgcgccgccgcccctcctctcgaggatgtgcgaggccgggctgctcggccgcaagagcggccgtggcttctatcgctacgacgagccgagcgcaccgaagggaggctcctagactcgtcctccgcgccctacccaaggccgaggaggtgtcatggcccctgagcgcgtacgcttcgcgccatcaccgacgggcatgttccacgtcgggtcagcacgcactgccctgtacaactggctcatcgcgcgccagagcggaggtacgttcatcctgcggatcgacgacaccgacgaggagcgcaatcgcgaggcctgggtcgacggcatcctgcgcgccatggagtggctcggcctcgactgggacgaaggtccgctccggcagtcgtcgagggccgagcgctaccgtgccgtcgccgaacggctggtgagcgaggggcacgcctattggtgcgattgcacgcgagagcgcgtcgaggcccgcaagcaacccggcgaagcgccaggctacgatggcttctgccgtcaccgagggctcgggcccggcccggggcgcgcgctccgctttcgtgtccccgaccatgacgtggtcgtgacggacctcgtccgaggggaggtgcgtttcccggccggctccatcgaggacttcgtcatcgtcaagtccaccggtcagccgctctacgtcctcgccaacgtcgtcgacgacatcgacctcgccatcacgctcgtcctgcgcgcggaggagcacctccccacgacgccgaaggcggtgttgctgcacgaagcgctggcagcgccgccgccgcgcttcgcccacctctcttttctcgtgaacgaccagcgtcgcaagctctccaagcgccgcgatcgagttgcggtggaggactaccgtcagatgggcatcctcccctgggcgctgctcaactacgtggcgctcctcggatggagcccaggcaccgacgaggagttcttcagccgtgaggagctcatcgctcgcttcgacctcgctcgagtccagcactctcccgccttcttcgacgagcgcaaactcctggcgttcaatcagcactacctccaggcactgccacttgccgagctcctcgagcaaggccacgaccacttcgcctcgatcggcgcgttcgccacccaacaggcaaccgagctgctcactcagctccttccactcgtcgtgcctcgagcacgaacactgtccgaggcagcagcgatgagtgcctttctctttgcggacccacccatcgccccgaacgagatcgaggcactccggtcggagtccgcgtcgtggctcggggcgatcgccgcacgtctcggggagctcgagcgcttcgatgccccctcgatcgaagcagcccttcgggcgctcgccgacgagctcgggacgtcgctgcgccatctccaagcaccgctgcgcgtcgccgtcaccggcagtcgtgtcggacccccgctgttcgagtcgctcgcactcgtcgggcccgaggccacgctacgacgcatccatgctctccgcgtgaccctcgaggaccggacccaagcacacgccgggtaagctcagctctgcccttcgggggtggtgtaattggcaacacagcaggttctggccctgccattgggggttcgagtcctcccccccgagccgaaggctgcgcacgctccccgcgagcacgctccgaactgcgcgtgccgctggtcgagcgtgcgggccaccgaatggcgtctggccgaggcgatcgatctggcaaaggtgggcaactcggccacgccatcgatgacgaccgtgtagaacgtcgcgtccactgtcgtcgctcgtgtgccctgacgcctccgtgctgcgaccgcgtggaacgggtgagccgacgcacgcgccgcttctgcgagcctcgcgtcgaggcacacccgcaccgcgcctctcggccacgagctctcatgagccaggagctggtcgatgacgacggggacaggtgagacaacgggagcgccagctcgacgcggactcgcgacgagctggcgccgacaccctcgatcccccgacgctcagggcgtctcgcggttcgatgccttctcgcgcacccgcgctgctcgattgagcgcattcaagagcgcacgcgcagaggcctcgacgatgtccgtcgacacgccacgcccactcacctcgtgcccaccgacgtcgacggtcaccgcgaccgatcccagcgcatcggccccgcccgtcaccgacgtcaccgagaagccggtgagccgtgcctcgagggccgtcgcctcggcgagcacccgaccgagcgcgtcgaccatgccgttgccggaggccgaggcctcgaccggggtcccatcgacgagcacggtggccgacgccacggcctcgcgacccgttcccgcctcgacccgaaagctcacgagctcgaaccgatcggcgagcgtcgtgccgagctcttcggcaacgatcgcctcgagatcggcctccgacaactcgaccttgcggtcagcgagctccttgaagcgctggaaggtcgcgttgagcgcatcaccctcgagcgcgatccccatgcgcgccaacgcttcttggaaggcgtgccgaccagaatgcttcccgagcacgatttgggctgcctcctggccgacgctggcagcgtcgatcacctcataggtggagcgatcggtgaggacaccgtgctgatggatgcccgactcgtgcgcgaaggcattccggccaacgaccgccttgttgtactgcaccggatagccggtgagccgcgagacgagtcgagaggttcgcgcgagctcgcgcgtgtcgatcccggttgtgacgtcgccgatcacatccgaacggatcgcaagccccatcacgacctcttcgagtgcggcgttccctgcacgctccccgatcccgttgatgcagcactcaacctggcgtgcacccgcggccacggcggccagggagttggccgtcgcgagaccaaggtcgttgtgacagtgacacgagatcacgtaggaaccggcgacctcccggcgcaccgactcgaccatgcgcgcgaaatcccagggaatgccgtagccaacggtgtcggggatgttgagcgtgctcgcgccctcgtcgacggcgacctggagcacgcggtagaggaacggcagcggcgtgcgcgttgcgtcctgcggagagaactcgacgtcgtcgacgagctcacgtgcgcgagcgatcgcgcgacgcacggcctcgaccacctgatcctcgctcatgcgcaacatgtgctcgaggtgactcggcgacgtcgagatgaagacgtggatgcggtggtgctccgcatcgcggaccgcttcgtagcagcgctcgatgtccgccacgtgggtcctcgacaggccgcagatcacagggccgtgcacctggcgcgcgatctggcggaccgcgtcgaagtcgccctggctcgcgaccgggaatcccgcctcgatgatgtccacgccgagtcgagcaagctgctcagcgatctcgagcttctccaaaggatcgagcgagatgccgggcgcctgctcaccgtcgcgcagggtcgtatcgaagatccgaatccgctcttgcgttcctacctcgtccaccatgttcctccccaacgtcgatcacccaatcgtctgtgcgttgccgctcggagcctcgctcccccagcgctccgagcggccagtgttgcccgaatacgagacgaccctcctgccggaggcaaggagggtcgggccagccgcgatcgcggctggcctaggtaaggagctgctcgctacgacgcgcacgcacgcacgacaccctagaggccagcgacggcacacgtgaccgtccgggcataaatgatgccgtcggtggcatccagctcggtcaacacctcgtccgggatcgggccgtcgacgccgagcaccatcagcgcagtgccatcgtcggtgcgcggcgagaccgccatggcgtcgatggagcgaccggcctgcccgaggagcgagcccacgaccccaaccatcccaggtcggtcgacattgcgaaccaccagcatccatcgcgacggaggaacctcgacccagtggccatcgacaaggacgacccgtggctcgctcgcccgctgacccgcgagcgtcccccccaccacgtgcgcaccagagcgcacgacgaggagagagtgatagttcgccgaggcgacttgcgtcgactctcgtaccgacagcccacgttcggccgcgagctgcggcgcgttgacgtaggacacgggctcttcgaccgcaccggagaggatcccacgcaagacagcgagcgacgcgagtcgcgtgtcctccgaggccaactcgccctcgtaggcgatctcgagctgctcgggaagcttgccctcgatcgccccgagcaatacaccgagcgcctcggcgagcgggaggaacgagcgaacgagctcggatgcttcgcccgcattgacgttgaccgcgaaggggacgaactcgttcgcgagcgcgagcaggacctgttcggcgatcgtgacgccggccttggactgcgcctctgcggtggaggctccgagatgcggggtgagcacgacctgatcgagccccacgatcggcgagttggtcggcggctcctcggcgaacacgtcgagtgctgcgcccgcgacgtgcccacgggcgatggcctcggcgagcgctgcctcgtcgatgatccctccacgagaagcgttcacgatccggatgccgggcttggccttggcaagcagcgccgcgccgacgagccccacggtctccttcgacttcggcagatggatggtgacgatgtcggacgtcgccatgagttcgtcgaggtccagcagggtcacgcccatcttgcgcgcgcgctcctgcgagatgtaggggtcataggcaacgagccgcatgccgaacgcgttggcgcgctgggcgaccaacgccccgatccgccccaggccgatgatgccgagcgtcttgccgtagagctcgacaccctgaaaggcgctgcgccgccactcaccgcgctgcaccgacgcgtgggcctgcgggacgtgtctcgccagcgccagcaggagcgccagcgtgtgctcggcggccgacacgatgttcgactgcggggcgttgaccaccatcaccccgcgcttggtcgccgtctcgacgtcgacgttgtcgagtccgatgccggcacgacctaccaccacgaggtggtgagccgcctcgagcacgtcggcggtgaccttggtcgcagagcgaatgatcagcgcgtcggcgtcggccaccgcctcgaggaggccatcgtggtcgagcccggtgcggaccaccacctcgtgacccgcgtcagagagcagctggaggccctcctcagcgatcgtctccgtcaccaacactctcgccatcgcgcgctccttctccctgctcagccctaaagcctaccaatgaactcagcaattcggcgaaccccctcctccagggcatcgtcgccgagtgcgtaggagagtcgccacgccccagggccgtcgaaggcttcgccgggcacgaccgcgacgtgcgcctcctcgaggagccgagtagcgagctcgagcgcgctgctgcttggcatctgcacctcgaggacgcgcgcgagcgacgggaagacgtagaacgccccgtcgggccacagcacgtccaacccttcgatgccagcaagagcgctcacgatcgtcgtgcgccggcgcgcgaacgcatcgcgcatgggcgccgtcgcctcgagcggggcctcgagagcggcgatcgccgcacgctgggacacgttggcgacgttggacgacagctggctctgcaggttcgccaccgcggacgccaccggtgccggggccacgatccaaccgacgcgccaacccgtcatcgcaaaggtcttcgcaacgccgttgacttggatgagcctcgcctcgagggcctcggtgcccacctccgcgagcgacgtcgcgcgctgccccgtgtaggtcaggtgctggtagatctcgtcggtgagcacccagatcccggcccgctcgagaacctcggccagcgctcgggactcgtctcggctgtagaccgccccagtcgggttcgagggcgagacgtggatgaacgcaacggtgcgatcggtgatcgccgcctcgacctgctcgggggtcaccttgaacccgttcgcgagggtggtcggcactgcaacgggcacgcccccaaagagtcgcacgatctcggggtaggacacccagtagggcgcggggatcagcacctcgtcgccgggctcgacgatagcggccatggcctcgtagatggcgtgcttgccgccgttcgtgacgaccacgttcgaaggactcaccacccgtccgctgtcacgcttggtgacctcgacgatgagctctcgaagctcgcccaacccagccgctggcgtgtagcggtggttccgaggatcacgtgcggctgcggtggcggcctccacgatgaagtcgggggtcggaaagtccggttcgccggccgcgaagctcacgacatcgatgcccgacgccaccatggccttggctcgctggtcgatcgccagtgtggccgacggtgagagctcggtgagtctggtggcgatacgacctcgtggcatggacctcggcctcctcacgccccgtgaagggaatccggacggttacagtgtcccttgccaggcaccaagcgagcctcgaggcagcgaaggtgaccaagggccacacgaaggaggagcacccatgcccgacgcggacgccatcagactacccagcaacctgctgcccagcgacggccgcttcggatctggcccgtcacgcattcctccgtcccacctcgaggcgctcgccgcgaccggcacgacgctcatgggcacgagccatcgacggcctaccgtccgcggcctcgtcgcgtccgttcaagagggcctggccgagctcttcagcgccccagaaggctacgagatcatcctcggcaacggtggcgcgaccttgttctgggacgccgccgcgtactccatgatcgagcacaagagccagcacctcgccttcggggagttctcctcgaagttcgccagcgtggtcgccgcgacgccccacctcgacgaaccggacgtgcgccgagccgaggccggctcggcacccgccgccgagcccaaccctgccgtcgacacctacgcgctcacccagaacgagacctcgaccggcgtcacgacccaggtgacccgccccagcgaggacgggctcgtcctcgtggacgcgacctcggcggcgggtgcgatcgtcttcgatccctcccaggtcgacgcctactacttctcaccacagaaggccttcgcctccgatggcggcctcttcgtggcgatgctctcgcctcgggcgatcgagcggatcgagcggatcgccgccagcggccgagcgatcccggccacgctctcgctcctgaccgcactcgagaacgcgcggctcaaccagacctacaacaccccggcgatcgcaaccttgttcctcatggatctccagatcaaggcgctgctcgagctcggcggcctcaagggggccaacgaacgctcgcgccaagcctccgacgtgctctatgcgtgggcaaccacgcacgcgcacgcgacaccgttcgtggccgaccccgcactgcgctcgcccgtgaccgtcacgatcgacttcgacgacaccgtcgacgccaaggcgctcgctgcggtactgcgctcgaacggcatcgtcgacgtcgagccctatcggaagctcggccgcaaccagctgcgtatcgcaacgtttcccgcgacaccggtggcggacgtcgaacggctgcgcgacgccatcgactgggtcatcgagcgcctcgccgacgacgctcgagccccccagacggcctaggcgaaggccctacgccgacgcggagccttcgaggcgaggcagccaggacggtcgtcgtgcctcgaaggcttcgatctcggcctcgtgctgcaggctgatgccgatgtcatcgaggccgtggatgaaccggtgccgaaccgccgggtcgagggcgaaggatgcctcaaggccaagttctggcacctcgaagcgacccgagaccacgtcgaccctcgccacgatcgtcggatcggacgcgctcgcctcgaggaggcgctcgacgatcgccgtgtccagcacgaccgggaggagcccgttcttggtggcgttctgacgaaagatatccccgaaccggggcgagacgacgacccgaaacccgtaatcggtgagcgcccacacggcgtgctccctcgaggacccgacgccgaagttctcccgtgccaccaggatcgtcgcaccggccatgcgcgggtcgttcagcacgaacgtcggatcctcgcgccactcggagaacagtccctcgccgaatccggtgcgcgagatgcgcttgagccactcgctcgggatgatctggtcggtgtccacatcgctgcgcccgagcggcaccatccgcccggcccactcacgcatgggttccatgctcagccctccacgtccgccggtgtggcaaagtggcccgccagtgccgtcgcagccgccacggcaggcgacacgagatgggttcgtccgccgcgaccctggcggccctcgaagttgcggttcgaggtcgacgcagagcgctgaccaggccggagctgatcggggttcatcccaagacacatcgagcagcctggttcgcgccactcgaaaccagcagcgaccaagacgcggtcgatgccttcggcctcggccgcctccttgacgcgccgtgaccccggcaccacgagcgcctgcacgcccggggcgacccgtcgtccacgcgccacgctcgcgacgacccggaggtcctcgagacgggcgttcgtgcacgagccgatgaagacgacgtcgacgggcacctctcgcatcggcgtcccgggctcgagccccatgtaggcgagcgctcgctcggctgcttggcgctcgtgctcggtcgtgaacgacgaagggtcgggaacgacgtcatcgacaccgatgacctgcgaggggttcgtgccccagctcactcgaggggtgagcgtcgaggcgtcgatgcgaacgacgcgatcgaagaccgcgtccggatccgtcgcgagcgctcgccatgcagacacggcctcgtcgaaggcccggccacgcggggcgtacgggcgaccttcgagatacgcgaaggtcacatcgtccggggcgatcaggcccgcacgcgcaccggcctcgatggtcatgttgcagaccgtcatgcgagcctccatcgacagccgacggatcgcctcaccgcgatattcgatgacgtgtccgatccctccgccggtaccgatctggccgatcaccgcgaggatgaggtccttcgcactcgccgactcggccaaggtgccctcgacctcgatcgcgagtgtgcgcggtcgacgttgcgggagcgtctgcgtggcgaggacgtgctcgacttcgctggtgccgataccgaaggcgagcgcgccgaaggcaccgtgggtcgcggtgtgcgagtcgccgcacacgatggtcatccctggctgcgtcagtcccaattccggaccgatgacgtgcacgatgccctggttctgggaccccatcgggaagtacgagatcccgaactcggcacagttcgtcgcgagtgcatccagctgcgccgccgagatcgggtcggcgatcggctggtcgatgccgaccgtcggcacgttgtggtccgccgtcgcgaccgtgaggtcagggcgtcgtacccgacgacccgcagcgcgcagcccgtcgaaggcctgcggcgaggtgacctcgtgcacgaggtgcaggtcgacgtagagcaggtccggttcgtcctcggttccctgggcgacgacatgcgcatcccaaatcttgtcgacgagcgttgtgctcatcggctgctacccccctcccgtcggccgctagcgagcggtcttgagcggcccgatctcgacgacctggaccttcagggtaccgcgtggcgcctcgtactccacccaggcaccgacgcgcgccccgagcagtgcctcaccgagtggcgaggtcggcgagacaacctcaagccccgggtgccgctcctcgatggagccgacgagatagtgctcgacatcgtcttcaccctcatagcgaaggcccacgaccacacccgggcgcacctcgtccgtcggaaggtccgccgacaccacccgagcgctctggaggatctgctggatctggcgtatccgcgcctccatcttgccctgggcgtccttcgcggcgtggtagtcgccgttctcgctgagatcgccgagcgcacgggcagcctcgatcgccttggcgatctcgatgcgcccctgggttgtcagctcctcgagctcctgaaccagggcgtcgtacgtcgcctgtgagatctctacctcgctcattgacgacgatcctagcggccggcgccgagacgccgaggcttgagccgaccagcatccgagggtacactgagctgccagcaggccgatcgacgcatcggtagcaccagcatcgtccgacggagcaccaccggtgcgacgactgatcgagaagcgaccgacctagaagggagcaacgtgggccaccgcgtagcggtcatcggcggcgacggcatcggccccgaggtcatccgagaagcgctgaaggtggtcgaggcgacgggcgtcgtcctcgaaacccgagcagtggagctcggtgcggcgcactatctcgcaacgggcgaggtcctcgacgacgccacactcgagttcctccgctcccacgacgccatcttgctcggcgccatcggaccggcgatcggctcgacggaggtcccgcctggcgtgctcgaacgtggcctgctcctgcgcctacgcttcgaactcgatctgtacgtgaacgagcgtccgtttcgcaccatcgacccctcggtcaccgtcacgcggcgcgaggcagacttcgtcgtcattcgcgagaacaccgaggggccctacgcgggcgaaggcggctttctctatcgcggaacggcccacgaggttgcccaacagggatcgctcaacactcgtcacggcgtggagcgcgtcgtgcgctacgccttcgagcgagcgcgctcccgaccacgcaagcatctgacgctcgtccacaagaccaacgtcctcacctacgctggcgacctctggagcaggacttttgcagaggtcgcggccgaatatcccgacgtcatgacggcctacaaccatgtcgacgcggcgtcgatctacctcgtcgaggatccggggcgctacgacgtgatcgtcactgacaacctcttcggcgacatcttgaccgaccttgccgctgcggtcacgcagggcatcggctacgcagcctctgccaacctcaatccggcgcgcaccggaccctcgctgttcgagcccgtccacggtgccgctcacgaccgcgtcggcaccaacaccgccaacccatgggcggccattcggtcggcgggagccatgctcgagttcctcggcgagcacgaggccgcgtcgcgtatcgaagcagcgctgtcggtcctcccgcccccgtcggcaacgacaacgcagatcggtgacttctatgcagaaagggtgcgtcatggcgatcgctgagggcaaggtcatctggatggacggcgaggtggtcccgtggggcgaggcgaaggttcacgtgctcacccacgcgctccactacggctacggcgtcttcgagggcatccgtgcctacgatacgccacgcggctccgccgtgttccgactgcgagagcacctcgtccggctgcatcgctcggcgcgcatgctgctgatggagatccccttcagcgtcgacgagctcatcgaggcgacgaggacggtcgtcgcggccaacggagaaccggcgtgctacatccggcccgtcgccttcaccgcctacggcgagatgggcctgtcgcccctgtcctcgtcgatttcggtgtcgatcgcgacgtggccgtggggggcctacctgggcgacgaggggatcgccaagggggtgcgtgcgaaggtgtcgtcgtggcgccgacacgacccgaacgtgatccctccggccgccaaggtgaccggaggctacgtcaactcggcgctcgccaaggccgaggcgatcaaggccggctacgacgaagccattctcctctccccgcaaggctacgtctccgagtgcacaggggagaacctgttcgcggtgttcgacggcgcgatcgtgacgccaccgatcgcggcgggggcgctcgcgggcatcacgcgacagaccatcatgacgctggcggccgacgccgggatcccggtgcgcgaggccaacttgctccggtccgatctctacatcgccgacgaggtcttcttgtcgggcaccgccgccgaagtcgtaccgatcgcctccgtcgacgatcggcccgtcggtaccggagaacccggtccactcgcccgagagctgcaacggcgctactacgcggcggtgcacggcgaagatccgcagcacgagtcctggctcacctatgtccacggctgacgtcctatgagcgcagggttccccgcagaggtcgagatctacgacacgaccctgcgcgacggttcccagcaggaggggatctcgctctcggtcgacgacaagctgaaggttgcgcgccagctcgacgccctcggtgttcactacatcgagggagggtggcccggcgcgaacccgaaggacgcagcgttcttcgccagggctcgcgacgaactcgcgctccacaccgcacagctcgtcgccttcggatccacccgacgagcctcgacgaccgcggagagcgaccccaacctggctgcactcaccaatgccggcgtcggcctggcctgcatcgtggccaaggcgtgggacgttcacgtcatccatgcgctccgcacctccctgccagaagcggtcgccatggttgcggactcggttcgctggctcgtcgaccacgggatccgcgtcatgctggacgcagagcacttcttcgacggttggcgtcacgaccggtcctttgccctcgacgtcctcgccgcagccgccgacgccggagccgaacgcttggtcttgtgcgacaccaacggcggcacgctgcctgatgacgtcggacccatcgtcgacgacgtacgagctgccgtcgcaacaccgctcggggtccacttccacaacgactcggggtgcgcggtcgccaactcgctcctcgcggtggcccacggcgtgatccaggtgcaagggtgcatgaacggctatggcgagcgcacgggcaacgcgaacctcgtacccgtgatcgcggggctcagcctcaagcgatcggtacgcacgattccgccggagaacctcgagctgctcacgaccgtatcgcgccacatcgccgagctcaccaatcaacccctgccgccacagagcccctacgttggggcctcggccttcacgcacaaggcgggcctccacgtcagcgcgatcgcacgtcgtcgcgacgcctacgagcacatcgatcccacactcgtcggcaacaccacgaggttcgtcgtctccgagatggccggacgccagagcattcagctcaaagccacgcaactcgggatcgacctcggcgaggacgacatcgccgaggtgctccgccgtctcaaggatctcgagcatcgtggctaccacttcgaagccgccgacggctcgctcgagctcctgctgcgacgcgcgagcggctggacgctcgacgacgtcgccgtcgagtcctatcgcacgatctccgactgcatgaccgacggaccccgggccaccgaagccaccgtcaagctcacggtgaacgatcggcgtgtcatcgcgaccgccgagggcaacggtccggtgaacgccctcgatgaagccttacgcgcagccctcgaccccgccttccccctcctcaagacggtcaagctgacggacttcaaagtacgtgtcctcgactcagaccagggcacggacgccaccgtccgtgtcctcatcgacttccaagacccagaagacacctggacgacgaccggcgtctcgaccaacgtcatcgacgcttcgttcgaagccctcctcgacggcctcatcgtggcgatcgctcgcgcccgcgaccgaggcgaggaatggtagagcaggaggaaccatggcccaaccagaccccaccatcgtccccgagcgcgacgtcgcacccgccttctgggccgaggaggtcgatcgcgccccgctggctcgccccgcggcgctgcgtggacgtcgactcgacaccgggcccgctcgcgggcgaccgggccccgatcaagggtggggctaccatctgttgaccctggtcgaaggcgagctcgatctcgtcgctggcgaacagcaccaggacatcacggctggggtcgccgccattgctgcagccctcgccgcgctcgaaggccgcgcgcccgtcctcgccgacgtcacccgagtcatcgacgcctaccatctccgcggaggcgcctcctcggacgacctgcgcaagcgagggcgcttccgcggcgtcgcccacgacgcgctccgtcgacgcctcctcgtcgacgcgaccctcgccgagctcagcgccgtccccacggcgcgttagaccgcggcctccgcgaccggtcggccggcactcgctgcgtgacggcccctcagccaggctgcgcccgcgaccactccccaagcgatctcgagcgcgagcagtaggtccgcggccacccgaacacgaaggacccatgagcgagccgtcgcgatccgccgctgcacggatgacacctctgcttcgaagacgacgacacgcccctcgaccgacgcgagggtccgaccaccggccgcgacctccgacgcgacagggccgaggccacggcacagcgaacctgcctgcggcaccagctgctggacgagcccgccgacaccacttgcgcacgccgcctcggcaacactgacctcgtgctcagcactcccgaccgcgacacgcagtccgcgcgcaccgttgctcacgcgctcgaggaccccagccacgcgcaccagctcaccgtgcccgtgatccagttcgcgaactaccgaccccagcaccggcgacggacccaccacgatcaagccgagcccgatgagcgtcacgaagaccaccccgagcacccgctgtagcacgcgcatcgcaacctccgaatccgggccagacacagtcccaacgcctcgacacagccccaacgcacgacgagccgggatcccgaaggatcccggctcgtcacgaaagcccggtcggcggcgccctactctcccagggggtctccccccaagtaccatcggcgctggtgggcttaacggccgtgttcggaatgggaacgggtgtttccccaccgccatggccaccgcccggacgatctgcggcgtcgagcgctccagagcgagcacgaggagctccaagtcctcggccgattagtaccggtcggctgaacacgttgccgtgcgtacacctccggcctatcaacgtggtcgtctaccacgggccttaccaggttgaccctgtgggaaacctcatcttgagacgagcttcgcgcttatatgctttcagcgcttatcccttccgtaggtcgctaaccagccgtgcccttggcaggacaactggcacacgagcgctacgtccgtcccggtcctctcgtactagggacagcctctctcaagtttcctacggctgcatcggatagggaccgaactgtctcacgacgttctaaacccagctcgcgtaccgctttaatgggcgaacagcccaacccttgggaccgacttcagccccaggatgcgacgagccgacatcgaggtgccaaaccttgccgtcgatatggactcttgggcaagatgagcctgttatccccggggtaccttttatccgttgagcgacggcgcttccacatgcgaccgccggatcactatgccctgctttcgcacctgctcgacatgtgggtctcgcagtcaagctcccttgtgccattgcactcgacgactgattgccaaccagtctgagggaacctttgggcgcctccgttactctttaggaggcgaccgccccagtcaaactgcccacctgacgcggtcccggacccggattcacgggtcgcggttagagctccagcaccgacagggtggtatttcaaggacgcctccagggaagctagcgctcccctttcgcaggctcccacctatcctacacaatcggaaccaaagctcaacatcaagctacagtaaaggtccacggggtctttccgtcctgatgcagctaacgagcatctttactcgtacttcaatttcgccgggtctgtggttgagacagtggggaagtcgttacgccattcgtgcgggtcggaacttacccgacaaggaatttcgctaccttagcaccgttatagttacggcggccgtttaccggggcttaggttcagagcttcgcccttgcgggctaacccctccccgtaaccttccggcaccgggcaggcgtcacagcgtatacatcgtcttggcgacttggcacgctgctgtgtttttagtaaacagtcgcttccccctggtttgtgacaccccctcgggctccgggcgcgaggcccttcaccctaccgaggtcttccttatcccgaagttacggaagtaatttgccgagttccttaaccacagttctcccgctcgccttggtattctctacctgcctacctgtgtcggtttggggtacgggcgcctcgatcactcgctagaagcttttctcggcagcatgggatcagtgacttcgcccgaagtgggctcggagtcgcgtctcaggcttcgtgaggtccggatttgcctggccctcgccctacacgctttccccaggaacgaccaacgcctgggatcacctaccctcctgcgtccctccatcgctcaaacgcgatcggggcggtaccggaatatgaaccggttgtgcatcgactacgccttgcggcctcgccttagctcccgactcaccctgggtggacgagccttgcccaggaaccctgaggcattcggcggaggggattctcacccctcgttcgctactcatgccagcattctcactcgagcgcgctccagctcggctcacgcctcaccttcacggcacgctcgacgctcccctaccgcccggtgacgtacgtcaccggacccgcagcttcggtgaccggcttagccccgttacattatccgcgcggaaccactcgaccagtgagctattacgcactctttgaagggtggctgcttctaagccaacctcctggctgtctgggcggttccacatcgttttccacttagccggtactttgggaccttagctggcggtctgggctgtttccctctcgaccacgaagctcatcccccgtggtctcactgccaggctctggagcatcggcattcggagtttggttgggatcagtaaggctgtgggcccccatagcccatccagtgctctacctccgatgctgaacacctgacgctgcacctcaatgcatttcggggagaaccagctatcaccgagtttgattggcctttcacccctatccacaggtcatcccccctgttttcaaccagggtgggttcggccctccacgggatcttacccccgcttcagcctgcccatggatagatcactcggcttcgggtctaccgcaggcaactctcgtcgccctgttcagactcgctttcgcttcggctcccccacgcatgggttaacctcgctacctacggtaactcgctggctcattcttcaaaaggcacgccatcgccctcgcgggctctgactgcttgtagaccaacggtttcaggatctgtttcactcccctctcggggtgcttttcacctttccctcacggtactagttcgctatcggtcgcctgggagtacttagccttacgaggtggtcctcgcagattcacacgggctttcccggatcccgcgctacttgggtggcgacggggaggcagctcgcttcgcctacggggctgtcaccccctgtggcgcgacgttccagtcgcttcggctcacgcgctgcttggtaactccctggaggggctggcgcaccctcctcgtcgctcccgctacccccggacggcaacgccgccaggcttgacaccgcccgggtttgggctgatccccgttcgctcgccgctactaggggagtcgcggttgctttcctctcctgggggtactgagatgtttcaattccccccgttccctcctcctgccctatgtgttcaggcaggggtgacgtggcattccccacgccgggtttccccattcggacatccatggatcaacgcttggtcgacagctccccatggcttatcgcagtcgcccacgtccttcatcggctccaggcgccaaggcattcaccgttggcccttcgtaccttggagttgtgatactcgtgctcgctctggagttctcaagctgccgcgcagcaggtgcttcgcgaagagggagccagtgcttcgactgggtgcggccactcgttgtggccactccttagaaaggaggtgatccagccgcaccttccggtacggctaccttgttacgacttcaccccaatcgccgaccccaccttcgacggctccctcccttgcgggttgggccaccggcttcgggtgttgccgactttcgtggtgtgacgggcggtgtgtacaaggcccgggaacgtattcaccccggcgtgctgatccgggattactagcgactccgacttcacgcagtcgagttgcagactgcgatccgaactgagaccggttttttgggattggctccccctcgcgggttggcgaccctttgtaccggccattgtagcatgcgtgcagccctggacgtaaggggcatgatgacttgacgtcgtccccaccttcctccgaattaactccggcagtcccctacgagtccccggcatgacccgctggcaacatagggcaagggttgcgctcgttgcgggacttaacccaacatctcacgacacgagctgacgacagccatgcaccacctgtgaagggccccgaaggacaccgcatctctgcggcttttccctccatgtcaagcccaggtgaggttcttcgcgttgcatcgaattaagccgcatgctccgccgcttgtgcgggcccccgtcaattcctttgagttttagccttgcggccgtactccccaggcggggcacttaatgcgttagcgtcggcacggagcccgtcgaatgaggccccacacctagtgcccaacgtttagggcgtggactaccagggtatctaatcctgttcgctccccacgctttcgctcctcagcgtcagtaccggcccagatcgctgccttcgccattggtgttcctcctgatatctgcgcatttcaccgctacaccaggaattccacgatcctctaccggactcaagccatggcagtatcggatggcgacaccaggttgagcctggtgatttcacatccgacttgccaagccgcctacgagctctttacgcccagtaaatccggacaacgctcgccccctacgtcttaccgcggctgctggcacgtagttagccggggcttcttctgcaggtaccgtcagtttcgtccctgctgaaaggagtttacaacccgaaggccttcgtcctccacgcggcgttgctgcgtcaggctttcgcccattgcgcaatattccccactgctgcctcccgtaggagtctgggccgtgtctcagtcccagtgtggctgatcgtcctctcagaccagctacccgtcgtcgccttggtgggccgttaccccaccaacaagctgataggccgcgaggccgtcccgtcgcgcccgaaggctttgctccctcgaccatgcggtcaggggagcacatgcggtattagcaccggtttcccggtgttatcccccacgtcggggtgggttcctcacgtgttacgcacccgttcgccactcggtggcaagccaccgcgtacgacttgcatgtgttaggcacgccgccagcgttcgtcctgagccaggatcaaactctccattggagatcgttccgagggtggagtccaccctcgctcgcctcgccccgggacacgtgggtctcgggtgggggagagtcgatcatggttggtgggtttggtcccaccgtttgtgttgtcggggtgacaccgagcttgtgctcgggtcgcccgcactggcttgtcttccctcttcgcgatgtcaacctgcgcccctgtcggggctctgccacgagggcacccgaagctgctcgtcgtggctggtgggttgccccacccccagcggtgctcttggagcacgtgggattcatcagtgtagcggggtcggaacgggtcgtgcacggttggggggcaaaaaatcgccacggaccctgtgcgaagtccggcaacgcggctctcgccgctggcgtcgcgcccccaatgcgagcttgggtgactcacccggccacctcggtgggcagcacagtgctgtcactcgccccgggaccaggctcgtcgagacctcgatcctcgcggccgaacccaccaactccttcagggagatcggcgttcacgatcgaactcggcgcgacacaccaacacctagccctcgccccccacaccacgccaagagggacggccccgaggcgaccgaagctgcggcgtagacgcctgcagtgcaatgccatccagcacgtgggctgaaggcacacacccggcggcggcatccatcggccagcgcgcgtcggcgcgcactccgaacgccatggtccgttggctcgagaacgtagaagcgcccacgaaatgccagaaggtgatgtcgccactcagggtcccggcgagtcgctcgttcccggagacgggtcgcctaccagatccagccgacactgcgcgacatcgagccgcccgcctggcgacgacccctcgtgcccggtgggacgacgctctcagtgctccatgacgacatgcaggcagccctggggtgggccgacgcccacgtgcacgagttcgagaacgatggcgtgcgctatgcgatgccggacatggctgacgactgggacacggaccgcgggtggccgatcgacgggttcgcctctctcgggtggccggcgaggacagccggttcctcgaccgctacgacttcggcgacgactggcgagaggatgtcctcatcgagaaggggttccccgccgaacccgacaggcgttaccttgcgagcatcgacgggcgccgcggcggacagcccgaggattgcggcgagcctctcgggtacgcggaacacctcgaggtccgagccgaccgcgcggaacctcggcaccgtgaataccgcgactgggtgggcgacttcttcgatcccgaggcgttcgaccccgcggacttcgacgagcacgtgcggacgctgcgcgcattgcgccaatggtgagacgacccattgcgtggcgggatagccaggtcgagagataggcgacccacaccgcaggccttcacggggctgccacaggttcgtggaggcctggccagcctgacggacgtcaactcgcgccaccgccaaccacgcgtctggtgcgctcccacgccaagactcggcacgctcgaagcgaccgcacgttcgatccgtcgtgctcccgagcccaccaccgttcaggcgatcttcaacccacgaccgcgacagggcgcccggcgcgaggccactcgtcgtcgccgaaccgctcagccggatgcgtccccgacatcggcggttcctcgtcgctagttcccacgagcgagctcgttcccttcgatgccgccttcgagctgcggtctaaccccccagaatgacccgcgggcccttgccccacgacagatagtgccacgaccagttcatgagcacggacgccttgttcctcgaaccaaggagaaaggcgacgtgcaacagcagccacgagacccatgcgggggttccgtgaagccgcacgcctcctgcaagctccgcgacggcagcgcggcgtccgatcgtcgccatgatgcccttgtcccggtagcggaacggctccgtctcgctaccagcgagcaaggcgaggatctggcgtgctgcgtgctcgcctccttgcagggcgggctgcgcgagctggggcaagggcgcgccgtcacgattcgtcgacagcgcgacgtccccgaccgcgaagatccgatccgatccgacgacgcgcagatccgagcccaccatgatgcgcccaccgcggcccgtgggcagaccgagcttcgacaccaccggcggaacggcgatgcctgcagcccacagcacgagcccgttgcggatctcacgtccgctcttgaggacgatcaagccctcctcaaccgactcgaccgtctcgttcagcagcaccgtcacgccacgcgctcgcagctctcgacgggcgtactccgagagatcctcgtggaacgcctcgaggagacgcccacgctgctcgatcaggacgaccttcacgtcgtccggccccagcatggtgaaatcggtgtagagcgcccgatgtgcgagttcagcgatcgcgcctgcgagctcgacgccggtcgcgccaccaccgacgacgacgaaggtcagcacgccgtcgtgcacgccgtggctcgctgcatactcgaagcgctggaagatatggttccgaacgtcgacggcggcgtccagcgtgtagatcgtgtgggaccgttcctccgcacccgggatgccgaagaacgatgcgctcgccccgatcccgagaatgaggtagtcgtagtcgacgatacgaccatcctcgagtccgatgaagcgacgcttagcgtcgacctcggccaacgtcccttggatgaagtgcgcgtgacgcgctctgcgcaacacggtgcgcaacggataggcgacgtcaccggcgttcagtcccgcagtcgcgacctggtagagcaacggctggaacgtggtgaagttgtggcgatccacgacgaccagctcgaccggcgcatcccgaaggacctcgatcgcggccaatcccgcaaagcccgcacccaccacgaccacccgtggacgagaaccctggcgcaggtcaccggactgtgattgtgtcgactgatcctgatccacggtcttgaccatcgcaactcctcacatcgtgcccgctcgctggagagtctacgaggaaccccgcccaggtcgcgtggcccgagtcagccgtgagccctgaaccgcgaagcgcaccgctcccgaaacctcgactggacgtcgaccgacgacgaggactgcgcccccgatcgactcgcgaaggacgcgatcgaacacctccggcaccacgtctgcgtcctcgacccacaacagcctcgcgaccgccgggcggaccagggccatggccagctcgagtcgcgcgcgcgcacgcggtgagagatcgaccgcgacggcgccgtctcgcccctccaatccgcttgcccgaagcacgtccgcgaacgagggaaccggcgccgaaccgactcggcgcgcgagcctgacggcgagcacgaggtgctcggcgaccgtcaggccctccaccggctcgaaatcgcgagccgcgaccgcacccatcgcgcggccttcgagcgtcccaagccgcgcaccccgcacacgaagcgccccgccggcctccgtgtcaccacgagcgagctcaaagaacgcgccggggtcttcgagcacaagcacggcccgctccttccccacgagcgtcagctccgtcagtgacaccggaccgccaggctgccagagctgcccctcgccccagaggagcgcatcacgctcgcgagtcacggccccaccaactcgcgaacgacacgcccgcgagaccgacgaccacaccaaacgaggccgcagcggccacatcctcgaggatcagcgcgtgctgcgcgaggccgaggttggcctgcacggcaggggccgtcacgaacagcgcgccagcgagcatggcgacgatcgggatgaccgggttccgagtccacacgtcgcgatcatggagcaccgcgatgacgcacgcgacaccggtcgtggcagcagcgatgccgacgaggccgaccacgaccaccgacgacgcaagcccgagcggcaccggagcgagcagaccacccgctagcacagcgacggccaggacgaggaggtccgctgccgcactcacccgaacgacgcgcgatcgacgcaccggcagcagggcaacgagccctcgcgagtcgaggaatcccccgagcggacgtccaacgacgagaccgagcgcgaggaccccgaccaccaccggcaccgcgcccgcagggtcgccacgtacgagcgccgccagccccgcaacggtcgcggtccccgctaggagcagcgcaacaccggccgcggcacgaccgcgtccgaggccgagccatgtactcgtggcgatcggggcacgcagcaggcccgcctccacgacaccgtgcggtcgatcggcaccgcgacgtggtcccgacggccgcacgtcaaggcgcccgacgccgatgcgcaacgcgagcgcgaggatcccgaggccgacgaccgccacggcatcggtgcgacccaacagccatgcaccgacgctcgcagcgagcgcaccgctcgggacgcgaccagccaccacgacagcgatcacgagcatgccgacgatcaccgcacgacgccgactccgcgcaccccggcgaacgatcccgagcacggcgccgagcgagacgccaaccgcaatccacgtcccgcgaaccacgtccgagcgatgtccatgggcaagcgggagcacgagtgcggcccccgcaaccacgccaacgatcagctccgcggcgaccgagcgcgcgctgtcgtgctccgcggctggcatcgcgatcccgatcgccacgagcgcgatcaccgtcgccgcgacgactcgtgccacccaagccaggctgtcaccgccgagcaggtggagatcacgctcgagaacggcctccccgacgacgagcgtcacgagcccccagagaccggggcgaaccagtgctctcgggctcacccacccgagacctggtcgagcttggtcgccgacgccaggaacggcatcattgcgcgcagatctcgaccaacctgttcgatctgggcctcgcgcgcctcacgccgcaaggcctcgaaacgggggcggcctgccgcgatctcgtcgaccagctcggaggcgaacgctccggagcgaatctcgtcgagcacgcgacgcatctcggctctggtctcgtcgttgacgatgcgcggtccgcgggtcaggccgccatactcggcggtctctgacaccgagaaccacatgccagacaagccgtgctcatagagaagatcgacaatgagcttgagctcgtgcaggcactcgaagtaggcactctctggctgatacccagcctccacgagcgtgtcgaaccctgcgcgaacgagttgcgagagtccaccgcacagcacgacctgctcaccgaagaggtcggtctcggtctcctcggcaaaggtggtgtcgagcacaccggcacgcgtcgatccgatcgcccaggcgtacgcgagcgccgtgtcgtgggcgcgaccactggcgtcgttggcgactgcaatgagcgacgggatcccgccgccctcctcgtaggttctgcgaagcaagtggcccggacccttcggggcgatcatgatcacgtcgacgctcggatcgggctcgatcaatccaaagcgaatgttgaagccgtgcgcgaacgcgaccgcgctcccgggctggaggttgggggcaacctgctcgcgccacaacgtcggcgccgtcgtgtccgggacgagcagcatgacgagatcggcccagcgaacggcgtcggccacactggagacctcgagtccactggcacgggccttgtcggccgacgcggacccttcgcggagccccacacgtaccggcacccccgagtcgagcaggttcagcgcgtgcgcatgaccttgggacccgtagccgatgatggcgacgcgccggtcagtgatgagagcgggattcgcgtccttgtcgtagtacatctgagccacgcgtcagctcacctttcctcgtcgtgccactcgtctgactggcttgggtagtctggccagcgcaatcctaccgctgcgctgcacctcgacgatcccgaactctccaaggagcgcctcgacgtcgtcaagtgccgacggcgcgagcgcgaacatcaaggtcagccgttcggcgttcacgtcgagcacctggccgcggaacaactcggcgagctcgagtgctcgtgaccgggacccaccctcggccacgatcgtcaccaacatggactcgacctcgacggcgtccgacgggtcgagctcggtgatcttgaggacgttgatgagcttgtggagctgcttcgtgatctgctcgagcggcgcggtctcgacgtcgacgaccatggtgatccgagagaagcgctcgtcgtccgtgggtgcgaccgctaacgagtagatgttgaacccccgtcgtgagaacaggagcgcgacccgagcgagcacccccgccttgttctcgacgaggaccgagagaatatggtgccgcccgtggacgggctggcgaattgcgccgatggggaccagattcgacgaggcgctcatcgaccatcccccacgaggtgaggcggcagcacgatgtcatcgttcgatgctccggccggcaccatcgggtacaccttctcgaaggtatcgacccgaaagtcgatgacgacgggccggtcgtccacctcgttggccttctcgatggcagcgtcgacctcctcgggggcgtcgacccgcatgcccaccgcccccatcgcctcggcccagcgcacgtagtcgggcaggtccggcgagagatagacctcgctgtagcgctcgtcgtagaacatctcctgccactgacggaccatgccgagatagccgttgttcaagatggccactttgatcgggatgcgctctgccgatgcggtgacgatctcctgcgccgtcatctggaagctgccatcaccatcgatcgcccagaccatctgccgaggccgggcagccttggcgccgaccgccgccggcacggcgaaacccatcgtcccgagcccacccgagttgatccactggcgtggcgcacggaacgtccagaactgcgaggcccacatctgatgctgacccacgccagccaccaaaatcgtgtcgtccggcgtcaatgctcgcaaccgctccacgacgaactggggcttcgtcgcagagcctggctcgctcgggacgtacgacagcggatagcgctgctgccactcggcgatcgtcgcacgccaggccccaaggtcggccggctcggccggcaagcgccgaagcagctccggcaagacgttgcgcaggtccccgacgatcggtacgtcggcacggcgcaccttccccaactcggccggatcgacatcgacgtggatgaccttcgcctcgggagcaaacgcgctgacacggccggtcacgcgatcgtcgaagcgtgctccaagggtgatgagcaggtcagcgcgctgcatggccatgacggcggcataggtgccgtgcatgccaggcatgccgagcgcgagcggatggtcgtcggggatgatgccccgagcgagcagggtggtcaccaccgggatacctgtgcgttccgcgagcgctcggagctctcgctcggcccccgcacggaccaggccgccccccgcatagatgaccggccgccgagccgcggtgatgagcgccgcagcctgttcgatcatcttggggtggcccttggtcacgggctgatacccgggcaggtcgagacggcgcggccagtaccactcgagctcgccagttgagacatccttcgggaggtcgatgagcacggggcccggacgtccagtggtggcgacgtggaacgcctccgccaccacgcgcgggatgtctgccgggtcggtcacgagccagttgtgcttcgtgaccgacatggtgatgccggtcgtgtcgacttcttggaaggcgtcagagccgatcgccccggtcgggacctggccggtgatcaccaccatgggcacggagtcgatcgcggcgtcggcgaccgccgtcacgatgttggtcgccgccggaccgctcgtgacgatggcgacgcccggacgaccgctcgcctgcgcatagccctccgccatgtggccagcaccttgctcgtgacgcacgagcacatgccggatgggggaatcgagcaacgggtcgtagaccggaaggatcgcgccccccggcaacccgaagaccacgtcgacgccctccatctcgagggcgcgcaccagcgcctgtgctcccgtcaaccgcatgtcgtgacccccttgtgctcggcgctcgccgccaactcctcctcagaccgtctaccgcgacccggatagcaaaagacctcccgcaagggaggtccgatgggcacgacgacggaggacgccgtgccctagcgaaggagtacgagcgaattcgtcgccatggcacccaacctagcgcgagtcgtcgtcgaatcctgccgaggtcaccgccccaacatcggcaccgcgcacgagcgccgcgaacttcgcgagcgcaccgctcgtgtagcgagggggcaagggcgcgaacgacgctcgtcgtcgctcaagctcgtccggggcgacgagtagatcgatcgcatggttcgggacgtcgatgcgaatccggtccccgtcgcgcacgagcgcgatcgggccgccgtcggcggcctcgggagccacgtgaccgacgcacagtccatgggtgccccccgaaaagcgaccgtcggtgacgagcgccgcgtccgaaccgcgtcccgcccccttcatcgcaccggtcacggcgagcatctcgcgcatgccgggcccgcccttcgggccctcgtagcggatcacgacgacgtcgccagcgcggatctccccggccaagatggcggtcagggcagcttcctcgcggtcgaacacccgggccgtcccctcgaagacatcctggtcgatgccggccaccttcacgaccgatccgcgcggcgcgaggcttcccgtcagcacggcgatacccccgacggcatgaatcgggtcgtcgagacggtgaatcacgactccatcggccgctggcggatcatacgcatcgagttcatcaccgagggttcgccccgtggccgtgagtacgtcggtgtggacgagacccgcctcggccagctcacgcagcacgaccgggaccccgccgacgcggtcgatgtcggtcatgtagaacttgccgtgcggcttggtgtcggcgaggtgcggaaccctcgcggcgatccggttgaagtcatcgagccgcagctcgacacgggcctcgttcgcgatcgccatcaggtgcaagacggcgttcgtcgacccgccgagcgccatgacggttgcgatggcgttctcgaaggcctccttggtgaggatgcgtcgcgccgtgatcccgagctcgagctggcgcatgacgagttcgcccgcctcgaacgccgcgtctgcacgacggcgatccaccgctggcgcggacgccgacccgagcggcgccaagcccagcgcttcggacaccgaggccatggtgttggcggtgtacatacccgcgcacgaaccgggcgtcgggcacgcgttgcgctcgatcgcgctcagttcgtcctggctgatctgtccggcagcatatgcaccgaccgcctcgaacaccgagacgatgtcgagccgctgatccttcagatgacccgggaggatggagccgccgtagacgaacacgctcgctaggtccagccgtgccgcggccatcatcatgccggggagcgacttgtcgcacccggcaagcgtcacgagtccgtccatgcgctcggcgtgcaccatgagctccaccgaatccgcgatgacctcgcgcgacacgagggacgagtgcatcccctcatgacccatggagatgccgtccgataccgcgatggttgcgaactcgagcggcacgccgccggctgaccgcacgccagccttgacccgcttggcgagctcaccgagcggcaaattacatggtgtcacctcgttccacgatgaggcgaccgcaatctgcggcttgtcgaagtcctcctcgaccagcccaaccgcgcgaagcatcgcgcgcgctggtgctcgcgtcggcccctcggtgacgtcccggctccgaaccttcagctgccgccgctccacgttgacaccccctgctctgcgacgtcggcgacaacgccgacagctcgtttgccgtgcgggcccgcccgaaccgcttaccctacgtcgaactacgctccgacgaggcgcgctcgtcgagcgcacggcgggcgagctgaccagggaccttaccacccgaacggcgcaccacctgtcctacgaggaaccccgcgatcttggcgtcgcccgccacgaagcgcccccactcctcgggcgccgacgccgcgacctcctctgccaacctcgcagcctcggcttcgagcccttcccgtccgcccgccacggccgcgacgagggcctcgatcggatccgaacgctcggcagcgatacgcagcacctctcggacctgctgggcgagcagcaggccgtctgcctcggccttgaggacctcgaccacgcgcgcgggatcgatctcgacgccctgcgagcgcacctgcgcgatctcgttggcgactcgcctcgcaacgagtgtcgctggaagtccggcgtcgagcgcaactcgggtgtaggcccacagctcctccgacaccgccgtctcgcgcacgtctgggctgacggccgcgtcggcgaggcgagcacggcgtgtgcgcggcagcgaggcgacgagtaggtccgacatcgcctcgacggcggcctgatcgaccacgagtggcgggaggtccggctcggggaagtagcgatagtcctcggcggcctccttggtccgcaagccgacggtcgcaccgcgagcctcgtcccagtggcgcgtttgctgcaccacgggctcaccgcgctcatagctctcgatctggcgcatcgcctcggcggcgatggcacgctgcaacgagcgcaacgaattgaggttcttcagctcgacacgggtccgcagctcctccgaaccgatcggtcggacggaaacgttcgcgtcgacacgcagggacccctcctccatgcgcccgtcgctcgcaccgacggcgaccacgatcgcacggagctcgctgacgtaggcgcgtacctcgtcagggtcgcgcagatcaggggccgacacgatctcgagcagcggcacgcccgctcggttgtagtcgatcagggtccgctcggccgactcgatgcggccccctccacccacgtgtgtgagcttgccggtgtcctcctccagatgagcccgctcgatgcgaatccgtcgacccccatcgagctcgaccgcaccgcccgcacagatcggcacgtcgtactgcgagatctggtagttctttggcatgtccgggtagaagtagttcttgcggtggaactggctgctctggacgcgcgatcccagggcggctccgaccgccatggcgatctcgacgcagcgcgcgttcacgaccgggaggctccccgggaggccgagacagaccggacacacgttcgtgttgggtgcctgcccgaatgcgttggcacacccacagaacagcttcgtcgcggtccgcagctccacatggacctcgaggccgatcacgagctcgaatccgcgctcgagccacggccacctcatcgctcggctcccgcctcgagcgctcgcgccgccaccaacatgcgcgcatcctcccacgcaggtgccatcacctggatcccgatcggcaagcgatcagcgtcgtagccgaagggcactgacaccgcaggcccaccgaccaggttcgacggcaccgtacagacatcggaccggtacatggccaccggatcggcgacccgctctcccaggcggaacgccgtcgtcggcgacgtcggggtgatcagcacgtcgacatcggcaaaggcacgagccaagccggcagccagccacgtgcgcacgcgctgagcctggacatagagggcgtcgcgatagcccgccgacagcgcgtaggtgccgagcatgatgcgtcgcttcacctcgtcgccgaagcctgcggaacgtgtcgccaccatcatctcgtcagtggtgagcgcctcgacgcggagtccgtagcggacgccatcgaagcgcgcgaggttcgacgacgcctcagccggggcgaccacgtagtacgcagcgagtgcggctgccacctcggggatcgacacggagacgacgctcgcacccaggcgctcgaggtggcgggcggccgcctcgagcgcggccgccaccgccggatccgcggtctcggcgagctccgtcaccacgccgacggtccagccagcaacgtcgcgatcggatggatcgctcacgatcgggccgcggggtgcactcgtggcgtcacgcgggtcgtgcccgctcagtaccgccagcaacgccgcggcgtcgtccaccgtcgccgcgaaggggccgatctgatcgagggatgaggcgaaggcgatcaaaccgtagcgtgagatcgcgccgtaggtcggcttcacgccgaccacgccacagagggaggcgggctggcgaatggatcctccggtgtcagaaccgagcgcaagcgcgctgaagcgggccgccaccgcggccgcagacccgccagaggagcctcccggaacacggtcgagatcgtgcgggttgcgagtcggcccaaaggcagagttttcggtcgacgatcccatggcgaactcgtcgagattggtcttgccgacgatgacgccgccagcggcgagcacccggtcgacgaccgtcgcactgtagggcgacacccacccttccaggatccgcgagcccgccgtggtcgggactccctcttggacgatgttgtccttgatcgcgatcggtacaccggcgagcggacccggatcatgaccggcccgcacggcggcgtcgacagccgccgcccggcggcgcgccgcgtcgaagtcgagatggaggaaggcatggacctcgggctcttcgaccgcgacctgcgcctcgtaggcctcgagcacctcctcggcccgcacagcaccctcgcggaccgcacgagcgatgtcgaccgcccccagatcgagaatcgcctccgagttcacgcgtcgagctccacgatcggcggcaccaccagcagctgctcctggttgaggcgatccccgctggccaacccggcggggccgagacttgcctggacgacatcagggcgtagcgacgacgactccgatgggacgtgctccatcggggccacgcccgcaagatcgagccgagcgatctcgtcgatcagcgccaacaccccagagagctggtcgcggtagtgcgcgagttcaccgtcatcgagacgcagccgcgcgagccgggccacgtggagtacttgctcagtggagatgccgtcctgcacgcgcgccatcctagcgacgcggccacgaccgactaagacgtgatcgcacgcaggatcgccgtcacgcgctcgtcccgggtcgcgaagacctgcgccagcccgagcagcttcgtgatgtcaccgttcacggtgacgcggccggcgaggaacgcctcgacggctcgctgggggtccatgtcgacgaacatggccttggcggtctcgtaatcgatcgtgatggtgagatccgcctcgtccacgaggcccaagccgatctccaagatgcccgaggtggtatcgatgtgagccgtgatcggttcggggccgaacggcgtcccactgatcagctggttcatccgcagcggcaccgacacgctgatgggctcgataccgagccgactcgtcaggttgtcgaactcctcgagccatgcctgcgacaagaactcgtgtttcgcaagcccctcgaggatttcgggatcgaacgactccatgccccacttcctgaccggcgttactgcgtgcagcctacgagttcggggcgagcaccaagttcaccgcgctcccgaccgggacctcggtgccagccggctcaccctgggcgacgacgaccgccgaggtgccgaggtaggacgcaacgccgttcaacgacaggccgcccggcgtcgtgagctggccataggtcaggtgatccgcctggagcgcagcgaccgcttgcgcaaaggtgtcgtcgaagaggttcgggaccgcgacgtcggggggaccttgcgagatcacgagcgccacagtgctgccgaacggagccaccgtgcccgcacccggcgattcgctgacgacatcgcccgatgggaccgaggtcgagtacgcctgcgacgtcgtgacggcgaatccagccgcgcggagggcggctgctgcagtcgcctctggctctcccgcgaccgccggcacggcgcgcggcggcggtccagcggacacgatcagcacgacgacgccgtgccaccggacgcgttggccagccaggggctctcggatcacggtgccggccgagacggtggccgagtaggcccgatcgagccgcacaccaagaccgacacgcgagagcgcgcgtcgagcatcggaggcgatgaagccgacgacgtcaggggcgaccaccggcgcatggccgcgtgacacgaggatctcgacgaccgcgagcggatggagggcaacccctgcaccaggcacggtccccacgacgcgtccgggcgcgaccgtggcgctgtaggtctcgcccgtccgaatgcggaagaagccgagctcggagaggcgtgctcgtgctgcggcaggttcgaggtctgccagccgcggcacgctcaggcgtcgaacggcaaggtaccaggttgcacccagggcggccacgaccacgatgacgagcagcatgagccacacacgccgccgacgtcgcgctggagggcgtgcctcgatgctcgtcagcgacgccgtgcggccctgatccggggggacgaacgcgaccgacaacgaacttgggtcgaggacggcctcaggatcgtgcgcaggattttcgagcggtagcggtgacggcgccgggagcgcgcgcaccagttcgtcgatgagacgatgcagcgtctcatcgtccggtcgctcggcgggatcccgacgcgtcatgcgaaccaccacgtcgagcagctgtcgtccgggctcagggttgaccacgtccttcgtgaggcgttggcgcgcgacctcctcgatcgacccgccctcgaacgggaacgagccagtggcgagctcatagagcacgagcccgagcgcgtaggtgtcggccggggcctcactgcgagacgccagctcgtcgtgtgcacccagggccgagcgcagctgttcgggcgctgcgtatctcggtgtgccggcgtggcgcccaccggaggtctccgatgcgtgacgcaccagcccgaagtcagccaggcgcacgtggcccgtctcgtcgagcaagatgttcccgggcttgacgtcccgatgggtcagaccgtgcgcatgggcggcagccagcgcgctcgcgacctcttgggcgatccgggcgacttgcgcatcgtcgagacggcgaccacggcggacgagatccttcagcgatccgttcggcatgtactccatcacgagcacgagcccgatcggcgggccaacgtcgaggaggtcgagcacacgaacgacgtggggatgctgcatctgcgagatgacctgcgcttcgcgccgcagctctcgaacaaaggtgccatcggtgcgcagctccggccgcagcaccttgagcgcgacgggcgcaccgagtcgaaggtcgagcgcgacgtagacgacaccggcaccaccggtgccgaggcgccgctggacgacgtagcgaccaaccagggtccgacctgtgatgtcatccatcggcgacgtcacgctgaccaacgggctcccacctcgatcccgcgatcgacggtatcacgcatccgacccgcctcgacggtcgatgagctctcggagcccatcgaggtcgatgacggggatcccccgagcgcgggcctcgtcgagcttcgaccccggtgatgcccccgccaccacgtagctcgtccgctggctcaccgacgtacgcacctggccgccgtgctcctcgatgagcgcagcgagctccgcacggccaatgcccggcacggtgcccgtcagcacgaagctgaggccctccaggggtccaccggccgcgcgcgggcgatcggctgaggctccgaccccagcacgttcgagcttgtcgaggatctcgcgcccgaggtcgctgtctcgaaacgcgacgacgctcgccgcaacgaccgggccgatcccctcgacgcgacagagctcgtcctctgtcacggttcgaaggccactgagtgagccgacgacgtcagccacgagcatgccgacgtgctgaccgacgttgtcgatggcgagggcgaagatgacacgcccgagcgggcgcgaccgcgacgcctcgatgccagctcggaggcgctcgatgctccggtggcgcaccccagggagccgtgccaggtcgtcgtccgtgagtcggtacagatccggcgggacgaccacgagccctgcctcgacgagctggcgcgcgcgttgttctcccaatccatcgatatccatggcgtcgcgactggcgaagtggatgaggcgctgcacgagctgctcgggacagcgacggttgggacagcgccagtcgacctcgccgcgatcgcgcacgaggggcgtatgacacaccgggcaggtcgtggggaagacccatggcaccgcgtcgtcgggacgcagctcgagtaccggacgaaccacctcgggaatcacctcaccggctcggcgaacgatcacggtgtcgccgacacgaacgtcgagccgtgcgatctggtctgcgttgtgcagcgtcgcgcgactgacggtcgagccgccgacccggaccggatcgagcaccgcgaacggcgtcaccttgcccgacttgcccaccgacacctcgatccccacgagccgggtcggacgctcctcggcggggaacttgtaggcgatcatccaccgtggcgcgtgcgtcgtcgtgccgagacgcacgcgatcctcgaggcggtcgaccttgatgaccgcaccgtcgatgtcgtagtcgagcccgtcacgagcctcggcgagccacgcgagcttgtcggcgagctcgtcgaggccgaccggggtggcgtgtgcttcgacctgaaaaccaacctcgccgagccactggagcgcttcgtggtggtagtcgaagctcggcccctcttcgagctggtaggcgaagaaggagagcccgcggtcgcgggtgagcgccggatccttctggcgaaggctcccggcagcggcgttgcgaggattggcgaacggtcgctccacgcgctcgttcagggcccgaaaggccgagcggggcaggaagagttcgccgcgcacctcgacgagcccaggtcccgtgacgcccttgagacgacgtgggatcgcgtcgacgacgagggcgttcgccgtcacgtcctcgcccacctcgccgtcgccgcgagtggcagcttgggccagacggccatctacataggtcagcgagagcgcaaggccgtcgatcttgagctcgaagaagagcgcagggtcgtggccaagaccgcgccgcgtccgctcgacccaggcgtcgagctcgtcggcgtcgaagacgttgtccagcgagagcatcggcgttcgatggcgcactggagcgaagctcgatccgggaggcgcgcctaccctctcggtgggcgagtccggagaacggagttcggggtgggccgcttccaacgcccgcagctcgaggaccagcccgtcaaactcatcgtcgctcatgatcggatcatcagcgacgtagtacgcctcgctcgctcgctggatgagcgagcgcagcgcggcaacgcgggcagcggccgactcagtcatcgtcgacgacccgtgccgaggcgagtacccgatccttggcgtcgtagaggacgactcgctgcccgggagcgacgcgacgagcaggctcgtcgaaggcgaccgccgcctcggacagcgacccaggaagcgcgacgccatgcgctgcagtttggacgaggccccgaagcggctcgctccggggcacgtaggacaccagatcctcgatcggctgggctgcgaccaagagatcgctcgcactgccgacgcgaacagccgtccgagacttcgcgatcacgtagcgcggggtggaccccgagcgaccgggttcgcgaagccgctggcccacggtcgccagctcgaacggcagcgtgaccccgaccggctcacccgcgacgtcgcggacgggtacatcggtcaagccgacggccgcggacacgaacgccgctcgcccgtggggcacgaaacacacgtcctgcgaatcgcgcttgtcccacaccggcaatccggccgcgtgggcacgggtgcgcacctcgtccttggagagctcgccgagcggcagccagagacgcgcgagcacctccgggggcacgtccgccaacacgtacgactgatccttacgccgatcccgcccccgaacgagcatcggccgcgacccatcgaggaccgtcgcatagtgaccggtcaccaagcgggaggcgccgagtcgctgtgcccaagccgcgagggcggtgaccttgacgtagcggttgcacgacatgcatggattcggtgtccagcctcgccgatgggcgtcgagatagggttcgaccacggcgcggtggaactccgctcgcatgtcggccacgatgtggttgatgccgagcagggctgccacggtgcgcgcgtcctcgacgtccccaaccgagcagcagccgcggtcacctgcggcttccgtcaggcgcaaggtgacgccgatcacgtcgtgaccagcctcacgcgccatgagcgccgcaaccgaggagtcgacgcccccggacatcgcgaccacgacacgcgccaccgaccctcccctcgacgtgccccacgctagtggcgtgcctgccgcgacgatcgaccgagcgcgcgcgagaggagccccgggacgtcggtgatgatggcgtcgacaccaaggctgtcaaggaacgtcgcctcggcgacatcgttgatcgtccacacccacacctcgcaaccgagcgcgtgcgcgtcccgaacgcgccgctcggtgagcagtggaacgccacgatacgaacgcggtaccgacaacacgcgccaggggggtcgacgctggcgcgaaccagcgatccaggctgccacctcactgggggcagcggtggtccgcacgccgggccagcgcgacctcacccgctccagaaccccccgatgaaagctggcgaccacgcagcgctcgagggcccccgcatccgtgagcgtcgcgatgacgcgtgcctcgaggtcgcccgagggcccatcgtcgtccttgatgtcgatggaacacgcgaggccctcggtcaccgccagcacctcctcgagtcgagcgagcgatgcctcgtgggtgccgcacgggagccgaatcgtcgcgagttgctcccaggtcgccgatgcgatggagagcgccacaccagcggtccgatccagcgtcgggtcgtgatggaccaccagcaccccatcggcactcttgcgcacgtcgagctcgaccccagtagcaccgcgcgccgctgcactcgcaaaggattcgcgggtcgactcgcacgcctctcccatgcccccgcgatgcgccacgatgagcggcgtgctgcgcccgtccacgcccgcggatcctaacgactaggctcgacgccaaggcatgctccaccacgttctcttcgacctcatcggatccctgcgcgcaagcctcaaagacgccatgcttgagggcggcggactcgacgagcagcttcacgtcgacatcctgctgggggacacaacctacgaaacgtcggcaagcctcccgggtgaggaagcgccgccacgtgtgcgcgcggacatctcgctggagtggtcgacctgggctcagagtgcctatcgatcctggacgctcggtgagggactcgacgaacccatcgacgttgtcctcgaggtcgcgcttcgcgtgtcgggccttcggggccccgccatgagcgccgcggcgttccggtcatcgctgccatcgcagtcgcctccgctcgtcaatcacgaggtgctcgagctgcgaaccgtctcggccgaaaccaccatcgaccccgacgaggatctcgaggaactcagcctcgaggcggtctacgacgtgaccttgtccctcgacgagaacgagctcgagcaccccgactcgctccacgaggccctgcggcgactctcgggctggatcgcgagcgcactcgtcgcagcgagtgacctcacggcacgacaccgcgcaccctgagatcgcgttgcgcgagtcgacgtgccatcccgtaggctgaccacagagacgagggggtgccgtgaagccaatcccggttgagttccacctggggccgcttgtgctccacacgtacggattcggcctcggcgtcaccttctggttcgcctactggtacctcggcaagcgcttccgccggttcggtctctcgagcacctggctcgagcgtggtttcatccctatcatcgtgatggccatcgtcggtgcccgcgtcgtgcacgttgtcgcgaacatcgaggcctatctccacaacccaatcggggtgttcgaggtgtggcaaggcggtctgtcgtcgtacgggggcctcgcaggcggcattccgaccgcgttgtggtatctccaccgcgacatgccgaacctccgtttccgccgggccttcgacatcgcagcaccggtcctgctcgcctcgtggtccatgggacgccttctcggtcctcagctgatgtacgccggcggtggcctgccgacgaaggcgtggtacggcatgtactacaccggcgagatcggcaagcgcattccggtgccgatctttcagtcgatcgaggacttcacctgcttcctcctcacgctctggatcgcacgccactttgcccgctggcgcatgccggcaggctccgtcgcggtcgccgccctcggattgtggtcgatcgagcggttcttcgacgagttcctgtggctcgcccgtccgcgggtctgggatgccgtcgaggtcttcgcgctcatctgtctcgccttctgcgccgccacgctcgccgtgctgacgtcacggcgaggccgtacgaccgaggtggtcgacctcccgaagctcgtggccacaggaccaaccgcgtgagctcgaccgcgctgctcaccgaccgttacgagctcaccatgctcgagactgcgatcgcgagcggccttgcagaggttccggccaccttcgaggtcttcgcacgctcgctcggcggtcgtggcttcggtgtggtcggtggcaccggccggctcgccgaggcgcttcgagcctttcgcttcgacgacgagatcgtgcgttggctcgtcgacgagcgcgtcatcgggtcaccgaccgctcgctacctcgagcactttcgcttcagcggctccatcgccgcctaccccgacggagagctctacttccctggttcgccgatcctacgggtcgacgcgccgttcggcgaaggcctgctcatcgagacgctcatcctgtcgattctcaacttcgacacggcggtcgcgacagctgcagctcggttacggctcgcggcgggcacggccacactcatcgagatgggctctcgacgcgtccacgagcgcgctgcggttgccgcagcacgtgcagcatggatcgcaggcttcgactccacctccaacctcgccgcgggtcaacgctacggcgttcccaccggtggcacgatggggcatgcgttggtgcttgcccatccgagcgagcgggccgcgttcgaggctcaggccgccgtgatcggatcctcgaccaccgccctcgtcgatacctacgacatcgggcacggtattcgccaggcgatcgaggcgttcggcaccgatctcgcggcgatccgcatcgactccggcaacccattcgtcgaggtacggcgtgctcgtacgctgctcgacgagctcggagccacgaagacgcgcatcctgatctccggggacctcgacgaggggctcgtcaggcgcctggtcgctgagccggtcgatggattcggcgtcgggaccaaggtcgtcaccgggggtggggtgcccacggcacaactcgtctacaagctcgtcgccgtcgaacgcaacggcgttgcggagcccgtcgccaagctctcggcgaacaaggagacgtctggaggccgcaaggctgggtaccgacgcctccgcaaccatcgcatcgtcgaggagttctcgatcgacccagccgtgaccgtcgagccgaccgacgactcgaccctgatggccctcgaggtccccgtcatggtcgagggagacatcctcgatccggagtctgcggcccagagtcgtcagaggctcgccgaccgtctcccgaccctcggcgaggacctcgacgcgatcctcgatgcaacggagcccctgttcgtctgccaccacctcggtccgtcgctgccacgttccgggcacggccagcacgaccagtagcgtgtcgagatggacaccacgtcgctcacgcgagcccatccgagcagcctcggcttcgacgcgcacgtgctcgagcgccttcggcgaaccctcgacacctggatcgaaacccaacgcctcgctggcctcgcggtcgccatcactcgcgacggtgaggtcgccttcgagcactacaccggatgggccgatcgagcgcgcaacgtcccggtcacgccgcagacgctctttcggatctactcgatgaccaaacccatcacctcgatcgcggcgctccagctggtcgaggagggacggatccgcctcgacgatccgatcgcaacggtcttgcccgccttcgccgaaccacgcgtactcgtctctggcggtgcgccagggggctacgcgccagcggtgacgcgcggggcgatcgaacccattcggctctggcatctgctcacccacaccgccggtctcacctacgacttccatcgccagagcgcggtggacgcgatgtaccgcaagctccagcgcaccctcgacggcgccgaccttggagcctgggtcgacgcacacgccgagctcccgctcctgttcgacccgggcacgcactggaactactccatcgccaccgacgtcgtcggccacctggtcgcgacgctgcgaggcgcaccgctcgccgacgtcctcacaaccttcgtcctctcgcctctcggcatgcacgacacgacgttcgaggttccggcctcagaggccgatcgcatcgccgcgatcgtcacccctggtggcgacgggacgctccatcgcctcgggcccgtgcagccggagacccgcgtggcgccgatcgactccggtggcggcgggttgttctcgaccctcgaggactacacacgcttcagcatcgcactcgccctcggtggccgcctcggggacgcacgcctggtcggaccgctcacactcgatgcgatgcgatccaaccaccttcccggaggttcggacatccccaccatggcgatcgccaggccacaacccggcgaccgcccagggaccggcttcggccttggcttctcggtcgtcgatgatccgattgcctcacaccgactcggtccgcgaggttcctacggttggggcggcatggcctcgacgaccttcttcgtgtggccggctcaacgcgtgagtgtcgtgttcatgacacagcttgtgccgtcgaacacgtacccgctcgccgaggaactcgagacgttcgtcgcagcagcgctcacgcggccctgagtcgcacgcccgagccgggctcgcgtgtggcgacccgacgagcctcgcggactcaggcctgtcgggcctcagccgcctgcgcctccgcgatctgacgacgcacgtcgtccatgtcgagggcaaggacctgcgagatcaggtcgtcgagcgcctccttcgggagcgctccaggctgggagtacagcaagatctgctcgcggaagatcatcagcgtcgggatcgacatgatcccgaacgccgctgcgagctgctgctcggcttcggtgtcgactttgccgaagacgatctccggatggacctcggacgcctgctcgtagatgggcgcaaacatcctgcagggaccacaccacgccgcccagaaatcgacgaagacgatgtcgttctcctgaatcgtcgcctcgaagtcgctgagcgtcagattgcgggtcgccatgatacctcttcctctcgatgagttcgctctggcctaacgccaatacccataagggtattccgtgtgcccggagcgggagtcgaacccgcacggccagcggcccggagggtttaagccccctgcgtctaccgtttcgccatccgggccttgtctcgacaccacgaccaggctagccctcggcgccgctcacgcctccacgtcggtgagcagctcggcgagcgacgggtcgagcgcgaccacggcagcagccgtccacaccccaaccggcgagaacccccctgccagccacagtgcaaggtgagcatgcaggcacttcacgccagcgcgcgcaccagcgatccgtggatgcgggacgtggcgtcgggcagaggcatgggcgtgttgggccaactcgagtgcgcgagggtcgacgagctcctcggccctacgaacccctcgtcgagcctcgactcgagcaaccgcctgcacgagtcggcgatcgacaagccaaaaccagttcgattgaggacggccctgccggtcgtattcggccagttcgatgacgatgggccaaccctcgcgagagcgtgcggcaacggtgtagggaatgctgggcaggcgaccaagctggtcggacacccacgcctcgtcctcctcacgcaccacggccacggcgtcctcgccggcgcagcagaatcgcgacgaccaccgccacagcgatcacgggagcgagcgcccggcgagcgagcggacgccagcccacaccgagcacgtcgagcggcgggttgtcggcaggcgttcgaacggcaggcgccgtcgtcgcatcggacacgggctctgcctcggtcgatgcggagtcggtggcctcacccgcctcgtcgctcgccgacgacgcttcgctcccgacctcgccgggaggcgtctgcaagaggtcggcgagccgatcggcgaactcacgcatgagctcggcagacacatccgcaaggactccacgaccgaactgtgcgacgcggccagcgatctgcagatcgaccacgacgtccacgtgcgttccctcgccgtgcggtgtcagcgtcgccgtcaccgtcgccgatgcccgtccttgtccccgctgctctcgaccctcggcgcgaaggacggcaacgccgtgctcctcgtcgagcgagacgaacgacgcctcacccttgtacgaagcggtgatcggtccgaccttgaccttcaccgtgccaaggaagcgatctgcgtcgcgcccggtcaacgccgcacccggcaggcacggagcgatgcgttcgagatcggtcaagacgctccaagcgaccgccggactcgccggcacgtcgaacgcgtttcggatctccaccgctatcctccctctccctcatcagctcgttcctcggcgcgcgagagatcgtgcctcgtatcgacgtccatcgggtcaccttgacacgagaccgacaccaccgtcaggtcccttcgggcgaagagtgctctcgctccgacgtctcctgagactgggagtgcaccgaagaggcgcctcgcgatgcgcacgggattcgctcgcgacccagcatacgtcgccaccgcgagatcgacctcctcgggagccgcggccacggcgtcccacgcctgcgccgtgatgaacggctgatctgcgagcccgacgaccatgccactcgccccgtctgcctcggcccacgccgccgcgagcgcaagcgaactcgcaaggccgcgctcgggatggggattcacgatcacctcgaaaccggtcggcacgagatcgtcgaagcgatcccgaccgaccacgaccgcgcgcgcggccagcagacgtgcgtcggcacacgcgctgagcgcccatgtcaacaaggcgcgaccaccgagaggagtccgcagcttcgcacccggtggatcgaatctggtcgctcgacctgccgcgaggaccgctccgacccacctcaccatgtgaacgcaccagcggcgtgaatgtcgccgtccgtcgccgagagaggcgtaccgctcctgccctctcgacgagcgatgatctcggcaacgatcgcgatcgccgtctcctccggcgtcctcgcgccgaggtcgagcccgatcggcgccgccactctcgcatcgacctcgtcgagatcgacgcccgcctcccgcagacgctcacgacgatcgcgctgggtccgacgcgagcccatcacaccgatatagccagcccgcgtggcaagggcagcctggatggcgggcacgtcgaacttcgggtcatgcgtcagcacgcagatcgcatcgcgcgcctggatctcgtcgcgatgcgcctccaaccacgcgtgaggccatgcgaccacgacctcatcggccatggggaagcgctctctcgtcgcaaagagcgcacgcgcatcgacgacgagcacgcgatagccgagcaatctggcggttcgggcaagcgcatcggcaaagtccaccgcgccgagtaccaccatggtggggggcggcgcctcaacggccaagaccaccgagacctcgcgcgagcgcgtctcgccgagtcgaccgagctcgcggcgcgtacccctcgctgcgtcgatggcccctgccgcctctctcgcgacgacccgatccaacgactcgttgccgaggctaccgaagcgtcgaccatcgccgaggaccgccaacgtcgcgccgaccttgggcatcgcgacgcccacgtggtcggcggcgaagtagtcatcgactgacgagtccacctgccacacgaacgcgaggctcgccgcgacaccgtggccgatggcgtcgacgacctcgtccaagaagtctggcggatcaggatcgacgagaatgtggaacgtaccgccacaggtcagaccgacggcgatggcctcgtcgtccgagtagccaaaggcgagcgtggccgccccccgctccacggagcccgtgatgccgatcgacgcaaggaccgcttcgggggcatcgagccgcgcgagcgcctcggcaacgacggccccctcgacgcacccacccgacaccgacccgacgacctcagctcgctcggagaccgccatcatggtgcccggttcccgcggtcctgatccttcgaccgcgacgacggtggcgagcgccgcgcgcacgccagcccttcgccacgcgacgaccgcctcgagtgcctcacgcacggcccgcctcctccacgatcctcaccgctgcccgctcgagcgacgcaacgctctcacccgcgaccaaggcatccacgtactcgagtgctgccgccatcccgcgcgcgaggggcgcgtagccatccaggccagccagcggattcacccacacgatcgcggcgctgcgccgacggagcgaggccatcgctcggcgcatctgctcgggatcgccccggtcccaaccatcagagcacaccaccacgaccgctgagcgcaagctgcgccgcacgccatggacgaaggcttcgatccctgcaccgaggcgtgtcccgccaccccagtcagcgaccagcgcgaccgcttcctccacggcgacgtcaggatcccgcccaccgagcgctcgactgatgcgggtggcacgggtcccgagcgcccacgcctcgaccttggcgacagcggcgaacacccacgcgagacggagcatggccacggcgtagggctgcatcgagccggaaacgtccagtagaaagaccacgggacgcggaaccgtcgtggctgctcgataccgacgctcgatgggttcgaggtcagtcgcgaaggcagcgcgcatggtcgcccgcgcatcgagctgtccgcgaggtgcggaacggcggcgcgcgctccgtcgcatcggaggggcaagacgaagcgccgcgagcgcctccatcgcctcggcgcgctcggtggcgtcgagcgtgccgaggtcggccgagtgcaggcgctcgaccgccgagtagcgaacgacacgctccgcgcgacgctcggtctcgttctcgccggcaccgtcgtcgccgtcgtcgagggccaccatggtcggcagcacgaccttcgacgcgttcggtgcgacgatcccgagataggaggccgctagctcgaggtaacgagggacgtcgtcagcacgcttgacgaacgtggcgagtccggtctcgagtaccactcgccgacttccaacgcccacgacgtccaaggcttgctcgaaatcgatcgtactcgaggtcgaaacgcgcaatccgccgctgcggaggtgatcgacgaacccgacgacgaagcgttcagctcgacccaccatcgccgtccaccacgccagcacgctcgcgaatcgtccgcacgccgatcgcctcgatgcgctcgagatcttctcgtcccttgacgacgagtccgagcgtggcatcgacgagctcatcgtcgaggtcgtcgatgccgaggcgcacgagcgcctccgcccaatcgatcgtctcggagattccgggaggcttgaacaggccctctcgccgaagtgccgcgacgacacgggcgatctccgtggcaagccgagcgctcacatccgggacgtgtcgacgcacgatctcggcctccaacgacggaccgggggcgtcaacccagaggtagaggcagcgcctcgccagggcctcgtggagttcacgcgtccgattcgacgtgagcacgacgatcgggatcacctgggccccacgagcgccgagctccggaatggtcacggtccaggtggagagcacttcgagcaggtaggcctcgaacgcctcgtctgcacggtcgacctcatcgagcagcagcaccggtggacgggcaggatcctcgccgccgagtgcccggagtaccgctcgctcgacgaggaaccgaggtgagaacagctccgcctcgatgtcatcgacctcgcgaccgcgcagagcatctcgcgcgagcgcctcgagcgtgcgcacgtgcaagaactggcgtccccagtcccagtcgtagacggcctgatggacgtcgattccctcgtagcactgcagccgctccagcgacccgccgaagacgcgcgcgagcgcataggcaagctcggtcttgccgacaccgggctccccctccaagagcagcggtcgctgcagcgagaccgcgaggaacccagacagcgccacccgtggcgaggccaggtagccaacggcgtcgagtgcacgacgcagatcctctggtcgttcgatgccgtgcgctcgaagcggctccggagacctaggcaagctcacgcagtgctcgtgccaccaggacctcggcaaggtgacggcggtagtcggcagacgcgttgacgtcgctcggcggttcgagcccctcggcggcacgtcgggctgcctcgtcgacgccagcaccgctcgcgagcgcctcctcgacgcccatcgcacgtactggcgtcggtgccatgttgacgaacgcaacccgcgtgctcccgttgcgcaccgcgacgactcccacgatcgcccagtcctgcgcccgacggttgagcttctggaacgagtagtcccgcaccgccggcacgcggatctcggtgaggacctcgtcaggcgcgagtgccgtctcgaggaagccccgaaagaaagtgctcgccgggatgcgccgctcgcccccgccgccgcgtgccaccatcgtcgcctcgagcgcgagcagcgcagcaggcagatcggcagcaccgtcaccgtgagcgacggagccaccgatcgtcccgcgatggcgtacggacggatcgccaatctggcccgccaccgcagcgagaaccggcacccgacgccgaagcacctcagaggtcgcgaggtcatgatgacgagtcagggccccgatcgcgacctcgtctccatcgtcgcgcacgtacgagaggtccgggaggtggccgatgtccacgagcaacgacggtgaggccagacgcagcttcatgagtggcagcagcgagtgaccgccagcgaggaacttggcgtcgtcgtgctcgccgaccaaggcgatcgccgcgtcgatcgactgcgctcggtggtagtcaaagggcgctggaaacatgcatcctccctgtcaggcccgatgggccgttgcatcggcgatcaggcgccagactcgttcgggggtggccggcatgggcacatcgcgcacgccgagcggagccaaggcatcgaccacggcattgatcaccgcaggtgcggacccgatcgttccggcttcgcccacacccttgacgccgagcggattggtcggcgacggcgtcacggtcgatcccatggtgaagctcggtacctcggcggctgacggcaccaggtagtcggccagcgacgcggtcacgagcgtgccagcctcgtcgtacaccgcctcctcccagagtgcctgcgcgacaccttgcacgatgcccccgtgcagctggccctcgacgatcattgggttcacctggttcccgcagtcgtcgaccgcgatgtaggagacgagatcgacccgacctgtctcttcgtcgacctcgaccacggcgatgtgggtgccgaacggaaacgtaaagttcggcggatcccacgtgacctgggcctcgaggttcggctccgtgccgtccggcaggttgtgggcggtgaaggcctcgaacgcgatggcgccgagaggaagctccttggtgggcgaacccttgacacggaaggtcccctgggcaaattcgagatcttcctcggctgcctcgagctggtgagccgcaatgcgcttggccttctcgagcacgcgttccgtggcgaggtagaccgcggtaccgccgaccgagagcgaccggctcccgtaggtgtccatgccgagtggcgcgatcgccgtgtcggagtgcaagacatcgacgtcggcgacgtcgatgccgagtcgatccgcgacgatctgggaccaactggtttcgtgaccctgtccgtgcggcgccgtgccggtgaccacctgcaccttgccggtcgggagaatgcgcacagtggcagcctcccagccgcccgcgccgtagctcaacgacgccaacacccgcgacggcgcaaggccgcacatctccacgtagcacgacacgccgatcccgaggagccgtcgctcgccagcggcacgccgtcgcgtctgctcgagacgcagctcgtcgtagcgagccagtgccagcgccttggcgaggttgtcgtggtagttacccgagtcgaacacgaggccaggtgccgagctgtaggggaactgctcggccttgatgaagttccgtcgacgcagctcggccgggtcgaggtcgagttcgcgcgcgagcgcgtccatggcacgctcgatggcataggtcgcctccggccggcccgccccacggtaggcatccgtcggcgtcttgttcgtgaacagtccggtgcactcgaatgagtaggcaggaacgtcgtagaccccgtgatagaggaaggcaccgagcaggggaacccccggggtgacgagctggaggtaggcccccatgtcggcgaggagacgcacccgtatcgccgtcacccgtccctcggccgtcgctgccagctcgatgtactgaacctgtccacgaccctgaatcgtcgctaccgtgttctcgccgcgctcctcggtccacctcaccggcacgccgagacgtcgagcgaggacgaaacacaccagctcttcggagtagacgtcgagcttcgagccgaaacccccaccgacggcgggggcaaccactcggacgtggtgctccggcacgcccatcgtgagcgccaacatcagcttgaggatgtgggggatctgcgtcgcggagtacaccgtgaacgagccgtcgaccggcgacggcacgacgaccacgcctcgcggctccatggctgacggaatgagccgctgctgcacgtagcgctcgctcacggtgaccgccgcctcgcgaaacgcgcgctcgaccgcctcctcgtccggcttcaacgaccagacgaagctcacgttcgacgcgaggtcctcgtgcgctcgtggtccgcccgctgcggccgcctcaagatcgaggaccggatcgagctcggcgaagtcgagctcgacggccgctgccgcatcgacggcctgttggcgtgtctcggcgacgaccaccgcgaccggttcgccctggtagtgcacggcgtcgatcgccaggggatagtgggcaggattgaccatgtccggcgtgaccggccatgcacacggcatgggcgcggcccactcggatgccaggtctgccccggtcaggaccgcacgcacgccaggcatcgcggccgcttccgtggtcgacaccgacgtgatccgaccatgggcaatcggcgagcgcacgagcaccgcccagagcgcacccggaacgacgaggtcatcggtgaaccgcgcctggccggtcaggaggcggggatcctccttgcgaagaacccgctgcccgatcaccccgcccgttgcctgcggctccatcgtcgtggtcatgcctggacccccatgcgctcgtgcgcggcgagaaccgcgcgaacgatgttgtggtaacccgtgcaccgacacaggttgccctcgagcccgagtcgcaccgttgcctcgtcgagcaccgggttctcacggatcagcgacagcgacgccatcaccatcccgggcgtgcagtagccgcactgaagtgcgtgatgctccatgaaggctgcctgaaccggatgaagcgctccgtcgggcccggcaagaccctcaatcgtggtcacctcctcaccggcaacctgcgcggcaaggacggtacaactcttcaccgactcgccgttcaccaagaccgtgcacgcaccgcacgacgaggtgtcgcagccgatattggtcccagtcaggcccagcgcatcgcgcaggaacgaaacgagcagggttcgaggctcgacgtcagcgtgtcgcctttggccgttcacggtcatctcgatcagcatgcggggcctcccttggccttcgatcagatcgtcggagtcgggccccgacgggggcaccgagcggaccttaccacacgccacccagctcgtcacggatctctcctccgcgagccccggctcatgaccgtcagaacgccgacttcggtccccgaggtctcgcttcgccgtggcggaccgcgagtgaccccttgctcttgccgccgagttgtcaatgtgccgtagggctacactggaagccgaggaggcaccatgctcttcgtcatgatcgcgttcgtcgcagcggccgccctcatcgccgtggcgatccactttggtccgcatggctccgtcgtctccggtgtgatcgggctcgtcctcggtctcgtcatcgcctggtccgcgcaggcagcgatcagcacggtcggcgcctgggccctcggtgctggtgtcgtcgtcgtcggccttgcgctcgccggcattggcctacgaggggttcgaggcctcaacactcgcgctgcgatcgccgcaccgtcaccgcttgcacgcctacttggtgaggaagccgtcgtcgaacgcgatctgagtcccatcggcgccattcacgtccatggcgagtcctggaccgcgaccaccgagacgggcgagtccgtcccggcgggtacacacgtcttcatcacgcgagtcgacgggctgcgcgtctgggttgttccggctgccaggccggaagatcgccaacggcactccgcctagaaggagggatcccatggccccgctcatcgttctcggcatcatcgtccttgcggcgctcatcctcatcgcacgaggtgtgcgcatcgtcagggagtatcagcgcgtcgtcgtgttcaggcttggtcgcgcaatcggcgccaagggtccaggactcaccctgatcaaccccgtgatcgaccgtctgagcctcgtcgacctgcgcgagcaatacctggagatcccgcatcagacggcgatcacaaaggacaacgcccccatctcgatcgacttcatcatgttctacaaggtgatcgacccggtcacgagcgtcgtcgccgtgcgcgatttctcgggcgctgcgctgaacgtcgccgcgacgacgcttcgcagcatcgtcggtgacatgtcgctcgatgacgtgctctcgcgtcgcgaggacatgaacgccacgctgcgagtcaagctcgacgaggtcaccgagcgctggggcgtcaaggtctcgaacgtcgaggtacgagagatcaacccaccgccagccgtccaagaggcgatgacgcgccagatgtcggcagaacgaagccgtcgagcgctcgtgaccgagtccgagggtcagcgccaagccgccgtgacggtcgcagagggcgagaagcaggcggcgatcttggcggcagaaggtcagaagcaggcggcgatcttggcggccgaggcagaacgccaagcggccaaactccgtgcccaaggcctcgccgatgcgctcagtgccatcatgcctgaagcacgcaacgccgactcgcgcaccatcatgctccagtacctggacgcactacgcgagcttgcgcgctcgggagccaccacgtacgtcattccagctgagttgaccgggttcctcggacagctcgcgggtgccctcagcgccagtccaaccgaaccctccacgaacggcgtcacaggtcattgacggcggagcgccactcgtagacacagacgggccctccgtcggtgcatcccttcgaacgacggctgaacgcgctcgctgccgaggtcgtcacgctccctgacctcagctggcggctcgttggcgcctcgatgctggccaggacaccccggtgctgagcctggccggtaccacgatgtgcgcttgtgatcgtggcgccatgacgcactgggcgctcgtgcccggcagcgatcggtaccgcgaccacttgcgaccatgtggcgccgctcagctcccgtgtgaagacgggaagctgaacggcgctctcacgcatttgtcgactaaggcccaaggtaggaccagcccaccgcgtcccgccaaccggccgaaggcacgaccccgccggcaatcctggcgcgagcgaggccgtacccactatgacggtggacttcgtcacgcgccgtccaaggcactacctcatgtcccggcgtcgcagacgccactcggtgcggagggcgcgccatcgaagcacacgacccgagacacgtcgttccgcgatcgtcgacaccggctcggcggtcctcacccgccccaaccgagctctctcgtatcgacaccaaacgcccctgccaggccaaccctggcaggggcgcgcgcatgtgaggccgcgccaggcaacgtcagcgccgtgcttcggctccctgccgacgtcgtgtcagcgaatcgacggtcacggccgcaagcaagaccagcgccgtcacgatgtactcggctgccgcactgacgcccaacaatccgaggccgttgtagatggccgcgatgatgatgccaccaagcacggcgtgcaccatcttgccgcgcccgccgaacaggctcgtgccgccgatcactgctgccgcgaccccatagagcacgagcgtgccgccgtcgatgttctccgagatcgatccgaggcgcgaggcgtagacgacccccgcgatacccgcagtcaagcccgagagcgcgaaggccgcgatccgaacccgcgagagattgatgccggcgcgacgagcggcctcggcgttgccaccgatggcgtagatgtaacggccgaaccgggtccgattcaggacgaatgtgtagagaccaagcacccccacgagaatggggacgacgaacggtacgccctcgagcgtgacggtcaccccgcggttggtgttcgccacgatcagcaacacgaccgcagccacggcaccgagcgcaatacgcagcgcaatgacaccccgcggaggcgccgagagcccagcccgccgcatccgctcggcaccgaagaacatccacgcaccccagagcgcgaccaccaccgctgcgatgacccaccctgcgaccaccgagagattgccgttgacaatatcgttgaggatgttcgacgagatcgagatcacaccgccggccgcgggcgccgcgtggtcgatcatgtagagcatgaccccttcccaccccagcagaccagccagggtgacgacgaaggacggcaagttgagcttcgtgatgaggattccctgcaccacgccgatgagggtggagaccgcaaggccagcgagtagcgcgacccaccacggctccttggcgatgatcggcgaagccaggatcgccatgacggaggccccaacaccggccacgtacccaaccgacagatcgatctcgccgagcagcaagacgaacacttcagccatgccgagcaggacgaacgtcgcgccttgcaccagcaagttgacgagattgccggcggagagaaacaaggagttctccgcctggaagatgatcacgatgacgacgaggccggccaacaccggcaacatgccgctctcacccgaacgcacgcgccgccaccagctggagatccagcttcgggtgtccgtgagcacgatctcggcaccctgggcaggtgcgctcgccggtgccgccgccggcgcatgtccattcgacgaaggggcctcctcgacatcaacggggagttgctctcgttccaccatcagactgaggcctccttcgcaccacgcggggcacccgactccagcgattgacccgtcatcagttcgacgacgcgaccaggctcgaactcggctcgatctccctgggcgaccatccgcccgagatgcaaaatggcaatccgatcggccgttgagaagacgtcttgcaggttgtgggagatcaggatgaccgacatgccgctcgcggcgaggtcacgaatgatgcccagcacgacccgcgtctggctcacgccgagagccgcggtcggctcgtcgaagagcaccacgcgcgagttccacagcacggcgcgcgccaccgcgaccgcttggcgctgacctcccgacagcgagcccaccggctggcgaatcgaacgaaccgtcacgaccgacagacccgcgagggtcgagcgcaccttctgctccatcgtcgcctcgtccaagatcccacgacgacgcggctcgcgcccgaggaacatgttctgaacgatgtccagattgtcgcagagggcgagatcctggtacacggtggtgatgcccaaacgctccgcgtcccgtggatcatgaatgtcgacccgctggccatcgatcaggatctctccaccgtcgatccgatggataccagagatcaccttgatgagggtgctcttgcctgccccgttgtcgccgacgagcgcggtgaccttgccggggacgacggtcaagtcgacgtgttcgagcgccttcaccgcaccgaagttcttctcgacgccccgcagctcgaggagagcgccggacactgcctgggtcattggacctcccatcaggctcgtgacgaaggcggggtgcgcagacgactgtccgcgcaccccgctcgtgagagacgctaggccttgatgcccgcggccgcgcacgccgaggcataggtgcccgagcacagctgcgacgccggcacgaagttgtcagcgatcacggtcgacgccatgttcttggtggtgacccactcgggcgtcagcaacaccgacgggatgttgttgcccgagaccggatcatgggtggtgccgttcaagagagctgccggaggcgtcttaccagcgcgcaggtagagcgcgagggagacggccgcctgggcctcctgatagatgggcttgtacacggtcccgcactggtaaccagccaggatgttctgcaatccttggagcgtcgcgtcctgtccggtgaatgggatcgtcttcggcgcgatgtggagcgactgcaggtacgagatgatcggcgcagcattctcatcgttcggcgtcaccacggcgttgatgttgggatgcgccgtgtacatctgctggaactccgtcaacgctaccgacggcgtccacgtccctggaggcgtcccgaccaaggtccacttgcccgacttgaagtacggatcgatcaccgaatcgtacccctcggcaaagagggtggcgttgttgtcggtcggtgcgccacgcatgaccagcacgttcggatgcgtcacgtgccacgcggcgacgcaggcgacgaatccctggccaatcagctgtccgacgcggacgttgttgaagctgacgtaataatcgctcggcgaggagcccagcgtgagacggtcatagttgatgacgcgaacaccgtgctgagcggcgtacttctcgatctcgacaccgacgcccgagtcgagcggatcgaagatgatgacgctcgccccacggctgatcgcgctctgggccatcgacagctcggtcgcgtcggagccctgggcgttctcgacgatgtactggttggacttcaggccagccaactggaaggccttcgtgaggaacggcgcatcgaactcggtgtagcgagccgaggacaccgtatcgggcaagatggcagccacgagacccttgcccttggccgccagcgagctcaggctgctcatggcggtgaagttccggttgaacgaggccgctgtcaccaccggcgtggacgcactcgtggaacccgaggatccaccgctcgagctcgaactggtcgagccacaggccgcgatcgccatcgcggccccagcgaccacgagcgacgctcgcgagaacgacgacattcgcacagacaacccccttgtcgtggcggggacggttccccgcgcctctgcgatggtacgcaggcgtgtgtaaacgaggggtaaacacttgggtcgggacgtgaaaaatctgtaaacggccttacgccgcgtcccgcaccagccgatagccagcacgcggttgcgtgaggatcaacggtgcgtccccgggcgcctcgagcttggccctgaggcgccggatgtagacgcgaaggtactcagtctcggtctcgtaaccgcgaccccacaccgcacgcaacaacgccgcgtgcgacagcagccgaccgtcgccacggatgagttcggcgagcaacgcaaactcggttggcgtcaggtgcactggcacaccatctcgctcgacgagctgacgttcgagatcgaccacgagacccgggcgtaagacgatcgtgcccttgtcggactggctcgccgcgggtcgcgttcgccggagcgtcgccgtgatcctcgccatcagctcttcgatgccgaagggtttggtgaggtaatcgtcagcgcccgcgttcagtgccgtcaccttgtcctgctcgccacgccgtgctgacaccacgatgagtcccgcggaggtgcgctcgcgaatctcgtagcacagctcgaagctctcgacgccggggatcatgaggtcgagcaggatgatctccggccgccgtgcttcgagcgcagccaacgcttccgaccggtcggaagcggccgcgacctgatagccgcgcacgagaagattcgcacggatcaggtccacgatgttcggatcgtcctcgaccaccaggaccgacgtcatgagcgctccatcccgaggacggcgtcagccgctgcctcatcggcctctgggagctggacctcgaatcgcttgccgacgtctcgcggcacgagccgcaggacgccgccgtgggcggcaacgatgctcgatgagatcgcgaggccgaggccattgccagtgccttcgcgatgacgctgcgcgagctcctcgacgctcaccccggccgggagcggcgccccgtcatcctcgaccgcgatgaccaccccgccatcgtcgtcgcgtcgtgccgtcacacgcacgtgcgttccaggcggattgtgagacgcggcgttgtgaagcaggttcacgagcacctgctcgatacggtcgtggtcgacgaagacgggcgggacgtcgtcgaggtcgacgtccaccaccacctccggtacgcaggcaacggccgcctcgacgatgtaggcaacctccgcccagtctcgccgcaccctgagggtgcccgactcgatcgcggagaggtcgaggagatcaccgacgagacgggccagacgctgtgactcggcgacgatgcgttgcaagaatcggcgctcggactccgtgtcccaacgcacgtcttcggcaagcaggctggaagcgtaccccgtgatcgccgtcaggggcgtgcgcaactcgtgactgagccgctgcacgaaggcaacttgcagtgcctgcgatcgccgcaaggccgccgcctcgcgttcggcctgctccacgcgccggcgctccagggcgagccggacggaactcgcagccgcagataggagctctgcagcctcatcgggcggggcgtcgtccccaagcgtggcgaggagcgcagtcgactcggcgccgtcgagttcgatcacgcgcgcaagggtccccggcactcggtccagccgcgcctcgatcaacgccgcgccctcgacgagttcgagttcgaccgccccgagaccatccttcagcacggacagcgccgcgtccagcgccggttcgacacgcgcaccccccgccagcacctcgaggaagcgttgaagcacctcgagcacgtggttgcgctgctcaagggcgtggagcacgcgttcgcgctccaccgtcgtggcgatggtcgcggcatagagcgaggcgagctgtgcccgagtgcgatcgtgctcgagcggacgcccgacgatgacggccagtaccccgatcgctccgcgcggtccgagcatcggaacggcccagagcgagcgacgttctccgtcgagctcgagctctccgtcgcgagctgctccgacggtcagcgcctcggcgatcgggccatcagcgtcgacgatcgcctgctcgagtcgcgtctgcgcgagcggatcgaggccgtgagcgctcacgacacggagggcccccatcgactcgccgaggagcgccgcgaccggtacagcgccgagggcgacggaacacgctgccgtgatcgccgtgacgccggtaccctcgtcgatggcggccacctgctcgacgaggctcgcaaagcgagccagctgacgtcgtgaactctcctgggaggacccggcgacgatgagctccccgagttcttccggccccaccgtgccgccgtcgaccgtcgcgacgaccttgccatggtgcagcacgacgacacgatccgacgcactcgcgacgaggccgagatcatgcgacaccagcaagactccgacaccacgctcccgaatgcgcgcaacgagcgccatcacggccgcggcctcgagcgcaccgagcgaggccgtcggctcgtcgagaaggagatagtccggctccctcgcgacctggcgcgcaatggcgacgagccgccgctgtccaccggagagcgttcgcaggggtcgcgagagatcgtcgatggcgaggccgactctcgcaaggacctcgtgggcggctgcgtgcgtccgacgaggcgacaccaggcgacgaccttcgcgaccgagaacgaggttttcggcgatgctcaggctctcgacgagctcgacgtcttgccagaccacggcgacgtcacgatcacgaggctgaatcgaccctgcctggatcgccagctccccagcgatggccttgacgagcgtggtcttgcctgccccgttgtcgccgacgaggccgacgagctccccagggtggatcacgagcgagacgtcgtcgagcaccacgacggagccgtaacccacgcgcagaccacgcaggtccaatgctcgagcatcaccgtccaacgcggccgccaccaccggctcgagtttaggtgtcatcagcgcgtccgagagacttcgtaggctggtgccgtgccgcccacgatcgatcacctcgtcgccgaagcactgagcccgcacgccaaccggatcgcccccgtacccgtggcgctcgccctcgccacgggcgcagcccgcgcccacggcgtcgccgtgagcgctacggggatccttgcgaccgcagcgcgcctcgatggggcgctcatcggtcgcccagccctccgggaactcggcgcgcgcggccgagggatcgcgacgctgctggacgccgtcgacgatgcccttggcgaccgaggccttgcccgcagggagcgagtcatgcacgacctcgtcgccaggtcggcgccggcctcgatcgagaccacggtgccagacgacacgagccttggcgtcgggctcacgctgccgacactgctcacactggcactcgtcgtcgagttcgcgccaaaggctcgcctcgcggtcgacgtcgttgcatcgcccatcggcgatcgagtcgtcgcagagctggagcgtcgttcgcgccacgctggggcgtcgatcgacctccgacctgcgccactgccgctcgagatcgatgcccaccggctgccgacgcagctggacgaggcccgctggctcgcaacggccatcgagaacacctccatggccggtcgtcgcaccgaggtggtcgccgcaccaggtgatccacttgccgacctggtcatcgctgccctcggccggcgaggtcaggcggtcgtcgacgaacgaccggtcctccttcgcgacacagcactgtggcgactcgctcgcgatggcctcatcctcggcaccctggggagcctgcccggtgagcctcggagggagcgccgcctacgtcggatcgggcccccgccggcgaacctcggcgacctcgagacctggctcgacgaggcccgctggacgctcaatgcggaggatctgccaccggagggcgcagaagaggccgcggcggcgctgctcttcggagcagcgcgggcaacgcgcgccacggatccgacgagttccgcactggcggtgatggccgacctcggtcggataggcctggagcgcgaccgtcagcccgatgccgccgttcgcgtcaccgcgacgccgcaggacggcttcgagggccaccgattcatcgtgggcgccgacgccgaacgcttcccggtgcccatcagcgatgatccggtgctgccactggatcgggcggtgcgcctcgagctctcgctcggccctgaggccgctgccgtggccgcatggtaccgcggagccatgacgctcgtgggcgcgcgatgggtgacggtcacgatggcacacacggtcgaggctcagctcacccgaccgtcaccactgctcgatgacctcggcatcgagatcgccgaccgtcaccgacagacacgcccgccgggaccatgggcacgccgagctggcgtcatctcggcgctccgccgtcgcgcgactccgagcccctggacctgggacatcggtgcgcaccatctccctcgctcgctcagcgtcacgcagctcgaagaagctgcttcgtgcggcgcacgcttcgcgctctcgaccctgctccgcgtgagcgaaccagagcccgaagggcgacaggcctcgtcggcgaccatggggacccttgcccacgccctgctcgagcaggacgacctcgtcctcgatgcggaggcgttgttcgccgcactcaccgacctcgtccgttcgcacccgtcaccgcgggtgcgcacggaactcactcgagaccccctcggcgtgcatcgactccgagacctcgccagtcaccttgcgcgagtcctcgcaagcgaggacctccgccccatcggggaggtccaccgcgaaatcccgttcgaactcgagctctgcggaactcgactccgggcgcgcttcgaccgactggaacggcagggctccacgtggcgtgtcctcgactacaagctccgtgcctcgaggcccgagtcctggccgatcgcctcctccgatcgaccggtacagctgtgtgcctacgcgctgctcgcagccaaggggtcgagccctcgcctccctgaccggcagcccccgacgagcgtgacggcggcatgggtgctccttcgcgcgcgcgacgcgcacgtcatcgccccctccctgcctgatctcgccgtcatcgacgacgagatctgcacgctcatcgagcgactcgatcgcggccagctcgacctcgaccctggcggccgcggcgcaccgtgccgtctgtgcagacgccgcgcaacctgcggtgtcgcgtggcaaggcgagggccgctagtggaactcacccaagcgcaggatcgcgccgctcgccatcagggaccgcttgccgtcatcgccggtgccgggaccggcaagacactgaccatggtggagcgctatctgcgcctcgtcgccgatggggtcgagccctcggccatcgtcgcggtcacctttacccgtgcggccgcagccgagcttcgcgctcgcgtgcgcgcagcactgctcggcaacgatgcctcgctcggtgcctcggtcgacgccgcactcatcaccaccttcgacggcctcaaccatcacctcgtccgcgcctacccgtgggcgcacgacctcggcaccgacgtcgaggtcgccgaccccgagatcggcgcagcgacggcttccatcgaggccggcgcgctcctcgctgctgcactcggcaccacgacgctcccaagctcgctgacactggttcaggcactcgccgacgaggcccagcgacaaccagagcgcaccctcgccgccctgtccgtccccatggagccggcacgcgatgatcacgtccggcgagcgcgcgcattctggcgtgacgttgcgctgcgtctcggcactgcacttgctgcgtcgaacgccgcaaccgacgcccagcgtcgcttcctcacccaggcccagctcctcgcgaacgccatcgatgcatggctcgactcgccccacaccgacgcctcgggcctggtcgcagacgcgcggtcgatcgggctccgatctcgcggcgccggcatcgaccaggtgcgatccgtcatccaggagctgcgtgaagcactcgacgatccggctcgccgctggcaggcgctcggctggaccagagccgatgaactggtcaccgtacgtcaacctcagctcgccacgatcgccgcatcggtgatccgcgcgggcgacgagcgtcgccggcgggtcggtgaggccagcttcagtgccatcgagcgcgcggccctcgccgtcctcgaagattcgaccgctcgcgccgaactctcggatcgctggcacgctctgatcgtcgacgagttccaggacgtctccgagaaccagctccgactggtggagctcctcaccagcgtggtccaaggacgcgccgccgtggtcggtgatccgaagcaagccatctacgccttccgaggcgcgcggcccgaactcgcgacaagcttcgccgagcggtcggccgtgatcgagctcgaacagtcctttcgctctctgccacgcatcatcgacctcgccaatgattatgcccagcgagccctcggggcctccgagcgcctcaggccgacgcgaagcgcgccgtcgagcgatgggtccatcgccgtggtccaagtcgtcgggggcagggccgtcgaacgacgccgaggagcagctcgcgccgtcgcggctcgcatcaagcgcgacatcaccgatggcacgctccgtgctcgcgacatcgccgtcgtcgcacgtcgctgggccgacctcgacgactaccggcgtgagctcggctcggtcggcgtcgccgccatcgcgagcggtggcggcagccttctcgacacgaacgtcgggctcctcgtgtcatccatcctgcgctggctcgccgacccgagcgacgacgccgccgcgatcgccgtcgctcgagcagacgtcatagggtttcgagacgacgagctggttgcgtacgcccacgaacgcgacctgacccggccgtggtcgacgttcctcgaagcactcgacgatccacgctcacgacgtcttcggaccctgcgggacaacacgcgcggcgcgagtgcctcctgcgcgatcgtcgcagcgtgcgagctgctcgagatcgacgacgcgctcgccgagggcccggaccctgagcgaaccctcgccgatctgcacgccatggtcggcctcatcgcgcgcctggcgacgggtcgctcgctcggggaggtggtcgcgctgctcgaacgcttgcggactacgggagtctcactcccccgaccacccgtcgctggtgcggacgccatcacgctcaccacggtgcacggtgccaagggtctcgagtggcccatggtcgtcgccgtcggtctcgaagccgacccacacccggcgctgcccgaggggttggtgctccacccgaccctcggcgtcgcctggcgcgaccgggacgaacagaacccgtcctcacgcgcgctcgagatcggcgctcacctcgcccacgagcgcgagcaggaacaacgtcgcctcacctacgtcgcgctgacacgggcccgggacacggtcctcgtcgttctcgacggcgacgcggactccgcgctgcgcgagagcctgcacgcggtcgggacgaacgagtggacgaccatcgatgtgctcgccgacgaaccagatcgcgacggcgcagccgacggcgccgatgcagtgcccatgccgtcgtcgccgccccccgatagcggggccagcgaggccgacgagcccgcacccgtgccaccgccgaccgccccgccacggtcgatcgctggtctggccgctaccctcacctgcccatggctcgcacactggtgtggccccgagggggccgacgccctacgccatccgaccgacgggctggtgcgggtgcccgcagagagcgcggcactgtgcggggtggacccgacggtcccactggcccccgtcgttcgcgacgtgcacctcgggacgtggacggtgaccgcggtcgcgctcgccgtgaccgacgccgccgtgatcgtgcccgtacggagtgtgcgcgcagccgaaccagaagctcgtctggcggcggcactcagcgcacacgcccttgagcgacggagcgccgtgctgctcgcgctggacgaaggcgtcgcgacggcgatcgaagcggtcgccccagaggacgtcccggtcgcggcggcccctccctgtcggcgctgtcgctttcgacaccgttgcccgggatcgcgagtcacgttcgactcggttgtccacaccgcggtcgtcgacgaagcctaggctggtgacgtggcagcgatcgatgtggccggtttcgtcaccgacctgaaggaccacgcgctcgaccatggattccacgtccacgatgagcgccacttcgtcgagacctactccctcaggcagtggtgggaggtcgatctccatccagaggaggggtgcggacagcccgtcgacctccatctcgcgctcgacgtcgacccgcgcgtgttgctcgcgttcgaggacaccatggccaccttgcccgatgacgccgaaccgcccgacgacttccatttcccgctgaccttcacctggtcgctgccgccgcttccggtcgacaccgacatcttgcggctggccgtcgagctcgcaggcgtgaccggtccggcgctcccgctcgagatcgcggcaaccgacgtcgtctcctccccgaccgacgctccagaacgacggatcgtcatcacggcacgctgggccatctcactgtcgcgagtcgtcagcggcaaggagtcgctctgcgagctcttcgaccgatcgcgagaggtcagcctctacttgctcgagcactacacgcgctggcaagccgacgaccgctagccatccgccgaggtcgactgcagcgaaggacaggcatggagggttggacggacgcgagcgacgcatcgctcgccgttggcatcggtcgatggcacgaagcagcgctgcaggaggcgtaccgacgctacgcgtcgacggtctggggcatcgctcgacgcgtcacgcgcgacgcgatgatcgccgaggagatcactcaagaggtcttcctgaccctgtggcgcgaaccggaacgcttcgatccggcacgaggatccctgcgcacctggctcgcaacccttgcacaccgacgggccgtcgacgccgtccgccacgacgcagccctcaggcgacgcgaggaccgcgaccatcaactcacgaggccgccgacgaccgccgagatcgaggtggtgatggatcgcgtcatcgttgccgacgcactggcctctctctccgagcaagaacgtcgcgccatcgaactcgcctacttcgacggcctcacctaccgcgaggtcgcagcgcgcctcgaagaacccgaaggaacggtgaagtccagaattcgaggagcgctgacgaagctgcatcggcagatggtctcgacgagaactccggaggcatgatggagcacgaggaagccgcatcactgcttggcgcctgggcgctcgacgctctcgaccccgacgaggccaaggccctggaggcgcacctcgcggtctgcacgcagtgtgcgctcgaagccgacgaactcagggctgcagctggcctgctcgcgaccaccacgaccgagcccgccccggatctgtgggactccatcgccggacatctcggccaatcgccagccgaacctcgccaaccaaccgtccacgcacctcgacgcccgagggcggggcaccgacgcggtcgcatcgccaccgtcgtcgcgggcctcgcactcgccgttgccggcgcgggcatcgggggcgtcgtggccctggcacacgaggtccacacattgaaccagcacgcagccagcctcggcacggcggcctccaccatcgccgcgacccccggcaccaccgtgatcgatctcacagactcgcacgacatcccgaccgccacgctcgcgctcactccgtcggggaccgcggtcctcaccgccgtacggctaccggcactcagtcgttcgaagacctaccaggtgtgggccatcacgacccaaggcgtgatctccatcgggctcctcggcgcaaatccgacggtcacggtcctgcacgcgccgacgcgtggcctgcacgcggtcgcgatcaccgcagaaccggcgagcggcagccctacgccgacgagcgctcctctcgcggaggcgcgccttacctaactctcgtgcacggcgcgcaccgagcgcgacggcactcccaggcggccaagtcagggcctgcgcgctcaacagcgcgcccgtcccaccatggtacgtcccagggagctaggcgagcgtactccgcgaccgttcgcccgggaaccgcatcgccacgacggaaccgtctcgctccaccacgagcactcgaacaccgcgggcagcttgcgccgccgactcgctgagtcctcggaatcgaacgttcgacccgagagcagccgtgaacgtgactccgtccggttcgacgacggtcacggacgaggtcgtgagcgactgcagggtcccgcgcacccacgaccaggtcacgacgcccgagggccgatcgacctcgaaggatccggagaaaccacggaaccagcgatggtgtccatgatggcccaggtgggacgtcgcggcggtggtctgcgtcacgaccggcgtgagcgccgagctcacagcggcgccgcccccacgcagctcgaccatcccggctgcaagggctcccacggagatcgcggcggcagccccgagcacgagatattgcttcttcataccagggagcctacggcacccgaagccacccgagcccgccaggtctgtcagggaactgtgagggttgctgccccgccgtggtccctcgacaccgacgactcgacgccgacagctgccgcgtggctctgcgtcatgggctgcggcgtgggctcgaggtcccgctcgggtgccccacagcgccgagccacccgcgcgccgcgatgggcacgtcggtgatgattgccgtcgggtggaccgacagggcacgcgagaacgcctcctcgtcgttcaccgtccagacgccgacgtcccagctcgccacggcgggcggccgccaaccctcacgcagcaggtcgaccccgacgaggagccaccggagaccgagctcctcgagatcgcgcagcgtcgactccgccggtgcctcctcgacgatgagtcccgcccgcgccccagaggcgagacacgctcgcaccgcgcgctcgtcgaacgacgagatcagggcgtcgcgttcgcgaaccaactccaccagccgcaccgaggcctcgacggccgcacgcacgcccgtctctggcagcagcttcaactcgatgtcgagcatcgacgaccccacgacctcgagcacgtcctcgagggtcgggagtcgacgaagcgacgtgctgggggcgcgctggatcgtgacgccgtcgacgtcaggatcgtgatggaggacgaaggcaccgtccgtcgtcggccagacgtcgatctcgatgccgtccgcacctcccctgagcgctgcctcgacagcgcccaccgtgttctccgtgagcgccgagccgtcgagacggccacggtgcgaccacagcgcgaccgcggctgcgtgctgcgctacgcccatgggacccgcacacctcggaacctgcgaacgaggcgtcgcagatgacgacgaccacgccgcaggctccagcacccttgcgcccctgcgacccggagcgtccggacgaggtgccggtgggggaaggccgtcacctcgcccggacgctccgcccgcagcccccaaggggtcgtcgcgtcacgccgaaccctcgctgagcgcggaccccgtcgagaccgaccatcctggtcgcgaacgtccatgaccagcaccctacggatgcgacgtgaacagccggcgaaggcgcagcatcaatcaggcgtctggttggtgaacgctgcgccgacgactcctgtccgagccgcacgcagcgcggccaccacacgctccggtgtcgtcggcatggcgatgtcgcgcacgccgagcggtcggagcgcgtcgaggaccgcgttccacaccgccggcgtcgctccgatcgttcccgactcaccgattccctttgctcccagcggattgaccggggtcggcgtctcctcgtgcacgacccggaaactcggcagctccggagccgagatcatctcgtagctcgccagcgtgccggtgagcggcgcaccatcgggcgcgtagacgaactcctcgagcaccgcttgggcgatcccctgcgcgagcccaccgtggacctgaccctcggcgagcaacggattgaggatacgtcccgcgtcgtcgaccgcgacgtagtcgacgacctcgacggcaccggtgtcgaggtccacctcgaccacgcacgcatgcgccccgaacgggaaggtcggccccggcggctcgaagtccaccgtcgctgcaagctggataccgcgcgcccgtgcctcggtcgcgagcgtggcccacgacaccaccgaactcgggaccccgacaacaccgataccggactcgccgaccacgagatcctcgggtgcggcttcgagcatcgtgctcgcgagctcacgcgcagcggccgcaacctcgaccgacgcgaggtgcacggcgacaccacccgtctggaccgaacgagaaccaaaggtccccacgccccgtggcacggcgtcggtgtcaccggtcaccacccggatccgatcgaggggcataccgagctgctcggcggcgatcatcgcccacgtcgtgtggtgaccttgcccgtgcggcgaggtacctgaccacaccgtgagcgtgccatcgtcggccacctccacgcgtgcgtactcggacgatgtgtagccgttcgtgatctcgacgtaactcgacaacccgatgccgagcagacggcgagcgccccgctcgaggcgccgagcctgctcggctcgcaacgtgtcgtagccaaccgcctcgagcgcacgctccagcgcgagccgatagcgaccggagtcgtacctggcaccggtacgcgtctcgtacgggaaggcatcgtcggcgatcagattgcgccgccgaagctccgccgggtcgatgtcgagctcgtgggcgagcaggtcgaccgcgtgctcgatggctgccgccgcctccggtcggcccgcgccccggtacgcggagatcggcacggtattggtgaggacggatcggtaggccacgcgcacccgcgggatctcgtaggtaccctgggccatgagggtggtgagccgcgggagcatcggaccgaggaggggccaggcccccacgtcctggaggacgtcgacggagagcgcgacgatggcgccgtcacgacgagcaccgatggccacctgctggacttgtccccggccgtgcgcgagcccgagcatcgaggcactgcgcgtctcgatccaccgaatcggacgcccgagtcgaagcgccgcagcgcacaccgcgagatcctccgggtagaccgcagccttggccccgaagccgccgccgacgtcgcccgcacgcaccaccaccgcgccatcggcgagcccgagcacgcgcacgatctccgctttgagtcggtgggccgattgggtcgatgcgaagatctcgaggcgcccgtcggccgtcggcacggcagccagggctcgggcctccatcggcgctggggccaagcgctggttcaccaaccgtgcgcgcacgacgacgtcggcgtcggcgaagaagtcctccggttctggctccccaccctcggacaccaggttcgacccctcgtgcacgagctggaggtcctcgagtgctcgctctggatcgatcacgggatcggtctccaccaggtcgagatcgaccagttcggcggcgtcctctgcgacctggggcgaggttgcgagcacgagagcgatcggctccccgacgtaacggacgcgaccacgcgcgaggagaggtcgcgcgaggtcgccacggccgcgcagcggacttggcatctcgagctccccgaggtcatcggccgtgacgatcgcgacgacaccatcgagcgccatggcctccgacacgtcgatccctgcgatggtcgcactggcgaccggcgatgtcacgaaccacgccgcgagcgagccatccaagggcacgttggcgacgtaggagccctgacctcgcaggaggtgttcgtcctcaacccgacgcacgtcgtttccgagaatgctcacccgacctcctctcctgacgacgcacgtgagcaaggacctgccaaaagccatccgttgcgccttcgggcgtgcgacgtcgtgctccagcgcccaccgggccgcgatcgcacgtgcgctccgcttgggacagctgcgaccttagccgaactcgggcgcgctgagctctcgggcccgtgcgccgggacggggagcgagctggtgacgccgactaggtcgacgacgaggaatcatcgtcggagccgtaggtgccctcgggcatcgggccagccgccgcgggatctgacgccgacgacgcctcgggagccgaactcccggcctgcgcagacggtgtgcccgggctccccccgaccccgcctgggatccaactgccgctactgcccggcggcggtgttgccggcgtcacgacgacgctgacacccttggcctcgaggtcgccgagctcgtccatgatggccgcgacgcgtgccgagtccgcagcagtcgcccgatgctggtggtcggcccagacgagccctccgagctcgagcaagagcgcatcggcttgcttcttcgcctgatattggtcgagtcgcgccgtcgccgaaccgtaaccctgctgcgcttgatcggcaagcaccgctgcctgctgcttcagtcgctcgaccgtttcaccaagtccactcaaacgatccttgaaccccatcgggccctctcccttccccgagtgccttcgccacccctagcgcccgagcatgtcgccgaggatccccccgagggaaccgcctgcaacgccaccggcgacgccaccagcgaccgcatccgaggcgccaaggtagggcccgagcgcctgggcgagcaccgccagcggcatcgactggagccagacctggccgggcccgacgagctgcaccagccaatgaccatcaccacccgcccagcgattgacgatccccggtacccgtgtcacctggaactgaaccgtctcagcgaacgcgccaacgtggccagggtgaaccagcagctgttggccctcggcgagctgatagttgaccatctcgcccccgagttcgatccatgccgtaccatgtccttcgagccgctggaggatgaacccctccttcccgaagagcgccccaccgagcgactgctggaaggccatggaagcgacgacatcgcccgtcccacagacccagccatcgcgatgcacgaggtaggcctgcccctgcgcgatctcgagcggaacgatgtgaccggggagcttggcaccgaaggcgacgaatcccggtccgcccgtggcctcgaagtgcgtgagcagcagactccccccgccagcgacgcgcttcaacgcgcccatcaagccgccccctgcagctccggtcgtctgggtcatgcgcacgttggccgacatccacgacagctcgccgcgatcgctcacgagatggtccccgggatcgaggacgatctcgagcaccggcatcgtcgaacccttgatggatgcctgcacgcctgcctccttccgccacgccgtcgccaagcgtaccacaggccgcctcgcagatcccgggaccggcccacgaggtcacacgtggcgacggctcgtcgaggttgcggacgtcgacctgtgcggcggcgcgggatcgaccggtcgatacagcggcgagctcggcagcacctggaccgcgaccgtgccccgcgggaccatcccgtcctcttgctcagcgaggtgctcctgataggcgaccgtgccgacgacagcgatctcgtgggtgaggcgcgcgttgtcggctcgaaccgtggcgagctgggctctgagtgcctgttcgctcgcgtggagatcgaggatggtcccggtgggcaggacccaggctccgtaggccagggcgagacctgcagtcagcgtgccgacgagtatgcgccgacggcccttcggcgtcatcgttgggcccgagtccagtcgacgtagcgcgcacccggaccgagctcgcgctcgatcgcgagcagacggttgtacttggcggcgcgttctgagcgagcgggcgcaccggtcttgatctggcccgtaccgaggccaaccgcgaggtcggcgatggtcgtgtcctcggtctcgccggagcggtgcgagatcacgctccgatacccacttcgcgtcgccaggtccaccacatcgagggtctcggtgagcgtgccgatctggttgagcttgatgaggatcgcgttggcgacaccacgctcgatccccttgccgagcagcccagggttcgtgacgaagatgtcatcaccgaccagttggacccgcgaagcgagccgctcggtcaagatcgaccaaccgtcccagtcctcttccgccatggcgtcctcgagcgagacgatcgggaactggtccaccaggcgcgccatgtactcgacgaggccgtcggcctcgagctcgaggccctggccgaccatcacgtaacgaccctcgcgccagaactcgctcgcggcagcgtcgaggccgagcgagcagtcacgtccgggtacgagacccgacgcctcgatcgcagcgaccatgagctcgagcgcctcctcgtggctcccgaggtctggggcgaacccaccctcgtcaccgaccgcgaccgagtggcccttcgccagcagctcgctgcgcagtcgatggtagatctccacgccccatcgcagcgcctcgccaaaggtcgccgcaccgtgtgggatgatgagaaactcctggatatcgaggttgttggaggcgtggacgcctccgttgatcacgttgagcatgggcaccggcaaccggtgcgcacccaccccaccgaggtagcgatacagcggcacgtcgagcgctcctgcggccgcccttgccgtcgcgagcgacaccgcgagcatcgcgttcgctccgattcggtgcttgtcgtcagtaccgtccgcgacgatcatggcttcgtcgatgagccgctgctccgtcgcgtccatacccacgaccattgtcgcgagctcaccaccgacggccgcgatcgcaccactgacacccttgccgttccactcggttccaccgtcgcgccgttccaccgcctcgtgcgttcccgtcgacgcaccagacggcacgattgcttctccgacggccccgccttcgagcacgacccgggcgccgacggttggattggccctcgaatccaacgcgagaaacccctcgacgctcctgatctgcgtccgtgtcccagccgccatggtgccgcctcctctctgcgggccgatgctagctcgttccgtcgccattccctgggcgccccgcatcgacgtcgacctcgccgagcgcgcgctcgaggcgacgagccgcatctcggagcgcctcatcgacgtcgacacccgagagagcggcctcgacgagcacgcccgcgaggtcatcgccccgtcccaacgaggccgcgcgcacgtcacgcgcccgggcgcgccgagccagcttggcgaggcggagcgacgccgggagccccacgggaaccggccgagacccaggctgctccgcggccttgatcgcctcccatcgctgctccacctcgccggcactgcgggcgaccgcgtcaccgaagacgtgagggtggcgtcggatgagcttgtcggtgagggcgcgagcgatcgcgatcagatcgaaactgccgtcctcgtcggcgatggtggcgtgcatgagcacctgcagcaagacatcgccgagttcctcgacgacgtggtcgcgatcgtgtccatcggcctcgtaggcatcgagcgcgtcgaccgcctcgtaggcctcctcgatgagatgacgtgccaacgaccggtgcgtctgggacgcatcccatggacatgccgaacgcaacgtgctcaccacctcgccaaggcgtcccaacgcgaccgacggtggctcgaagtcggtgagcacgacgctgctcaggtgatcgaccgcggcgagcctctcatccccggagtcgacctcggcgacgacctcatcatcgagaccgaggtggtgcgcgaggaccgcccgcgccccgctgcgctccgcgaggacgaccaggtcgcgtgccagcggctcatgccagacctgcagtgcgacgaccgtaccgctcgcgatccaggggttggcgtggagcgcttcggcgtcgaccacgctcaatccctcgaggggatcgacaccgaaacgttcgatgatcagctcgagcactccgcgtccagccagaatctcgacgtcgatgtcgtcggcccgacgcagcaacaccaccgtgcgttcggccacctgtggcgaacccgggaccacgtagcccacagggccacccgtctcgaacgcgaggtcccgcagacgctccacgatgcgctcgtagcactcctcgaaagtcgtggacgccgcgtagagatcgtcgcacgtcaggatcggagcgtccagtgtcccgagcgcctcggcgagtcccgggtgctccagggacctcgcaaccaccgccacgcacccctcgagggcatctccgagcgccgctgcctccgcgcggccagcaccacacccaacgacccgaacgatcggtttcacaccctctcaccctacctacccagaggagctgcaagaggccctcaagaaccagcactctccgtgccgattccacatttagtgacctatcgccccatctcgcttcccggattgaccaccagtcaccactggatgtggcgcatcatcgccgcgtccgtcgcaggaacctccggcgtcggcgcgacctctctcgcgctgcacgcccttaccggctcgacgacctcgtcacgtgccgcggccatcgttcgccacgatgcgcgagtcggccgtgccccggagccgatgccgacgccgcagcgccctcggagctcatcgccatcgcatccagcaccaccgaccccggctccacaggctccgtcgacgccctcacccaccagcgcgacgagcccaccagcgtcggccgcaccaccagcgacgccgccggcgaacccacccgtcgtcgcctcgtcgacgccaccgccggcttcggcgctcgcggacccaccggccaacatcgccccgaccccgaactttgcctcgatctgcgcctcgagcatcagcgctggccctgacggcccaacctgcgagagcgccgccgtcgaggcgatcgacgccgcccgcgcccaggaagggctcggtccactcaccctccctcccaacttcaccgatctcagcccgacgacgcagctgctgtggctgatcaacgaggagcgcaccgcgcgcggcctggccccggcggctggtgtcgtcgacaccctctcggcactcgccgaggacggtgccgcctcgaacagcgatccgcccctcgggtcgctcacgactgggggaccctgggcggtctccgcagaggccaattgggccgcggactactccacggcagcatccatgtacgactggatgtacgacgacggctggggtgggtcctcggccgcgacgacgaacgagacctgcacgtcgccgaccgcagcaggctgctgggagcaccgagccaacatcctcgcgaccgcccccgcgggctacgtgccggtgctcgggctcgccagccaacccgagccatcagggacgtcgctgtcggggctcgagtcggacgcgatggtcctcaccttcgtgcccacgagcgcgctcagctcactctcgttcgtcacgacctggccatagcaccgtgccgtggcggaagagcagcgtggcgagcccgacgccgcgagacccgtcagccaacccgttcgggcgtcacgatctggcgtgcgagcgccgcacccttcggcacggtgggcaccacgctgagcactcccttctggaccacgatccgaccaagggcccgattcacgtggatgttggccgtgtgaacggtgcgcgccaggtagtcgttgaggagcgtctgaccgtgactcaccatggtgtcggccgcgaggagctcggcctgcgagaacggtatctcgctgcgagaggtgatctcgaacacagcaaacccgttgggcacctgtacgacccctgatggcgtacccacaggaaggctcgtcaccgaggtcgcaacccctgatccgaagctggatgcgtactggccctcggtcccgcagccgagcgcgccaccgccagcggcgttctgggtcgacgacgacttcgccacggcagcgaacgactgacccttgtgcagcttcgcaaccaccgcttcggcttccgtaggcgtaccgaccaggatctccgatccgcagtagctctcgaaatcagccgggtgcgcgcggtagtacgcctggacgccactcgtggtcaagctcacgtggccgagcgccgcctcgagctcgacgatgtcgacgctgtcgcggatgaggcgttgctgataggagcgcggaaagccactgaagacggtttgaccgccagcggactgctccgccagggccgtgccaaggctcgttgcgacagcgctcggctggacgtgcatccgcccgagcgctgcctggacccgcatgatcgtgatccgtcgagagaggatgttgtccacgaagagcgcggtgtagctctggtcatggggaccccacaccggctcgtggctcgcgacgagttcgctcacgaacgccttgttcgcagcgacgtccgcgagctccgcttcgagctgcgacgtcgtcagcgtacggttcccgaccgtcgccgcgacgctcgcggaaccacagctcgcgagcaccacggccccggcgagtgggatgagtccgaaccagcgacgatgcacacctacctccaggagcccacggccatgctactggggagaacctactccaggcgatggcgcgccttcgaggatctccagcagtgcctcgagacgtccaagcgcgtcctcccggcgcgcaaggggaaccgcaaggtcgtcgccacgactcacgacgccatggagccgacgctctagacgcagccgggtcgccaccgacggctggagcggaccgacgacgagctcgagtcgtgcgctgcgtgggttgcgccgaacgagcgcatgatcggcaccgagggtcgcaagccgacgccgtgccttcgcgagggacaccaaggcgagcgcttcggccggcggcggcccgaagcgatcgcgcagctcttcaaggaactgatcgaactccgcctggctccgcgccctcgcgagacgccggtagaggtccatccgagtctcggcttcggcaacgtagtcctcggcgagcagcgccgataccggcacgtcgagcgccacctcccgatcgggcgtcggctcctcgacgccgtccatgcgcgccacctcttccgcgacgagccgcacgtacagctcgtagccgacctcgctgacgtgtcccgactgtcgcatgccgagcaccgtgcccgccccgcgaagttcgagatctcgcatcgcgatccggtaacccgccccgaggtcggtgttctctgccaccgtccgcagtcgctcgagggcgatgtcggagatcccgccggtggtcgaggtgagcaggtaggcatacgcctgccgcccggagcgcccgacgcgcccgcgaagctggtggagctgggcgaggccgagctgctcggcacggtcgacgatcagggtgttcgcacgcgcgaggtcgatcccgttctcgacgatcgtggtggcgacgagcacgtcggcctctccgtgccagaactgggccatcgtccgctcgagcgcagcgggcggtagttgcccgtgcgccacgagcaccctggcctcggggacgaggtcggcgaccagacgggccgaggcctcgatgtcgcgcacgcggttgtgcacgaagaacacttgaccttcgcgtaggagttcccgacggatggcctcggtcacgaccgcgggatcgaagggcccgacgtgcgtgaggatcggatggcgatcgacgggcgcggtccgcagcacggacagatccctgatgcccacgagcgacagttcgaggctgcgcgggatcggggtggccgagagcacgagcacgtcgacgccggggaacgcctccttgagctgctccttgtgtcggaccccgaagcgctgctcctcgtcgatcacgaggagcccgagcctggcgaaccgagtcgacgcgccgagcgcagcgtgcgtcgcgatgcacacgtcgagctcgccacttgcgagctcggcgcggatgctcgcagcctcacgagccgtgctgaggcgcgagagcatgcccacgcgaatcggcgtgccctcgaagcgctcccggaacacctccgcatgctgggcagcgagcagggtcgtcggcgcgaggacgagcacctgacggccctcggatgccacggcgaacgcggcgcgcagcgcgatctcggtcttcccgaagcccacgtcgccacagacgaggcgatccatcggcaccggcttggcgagatcagcgagcacctcggcaatggtgcgctcctgatcacgcgtgagctcataggggaaccgttcggcgaactccgagagcagcaccgggtccggcgtgatgctcgaaccggtcgcggccaagcgacgctgatagagcaccaccagctcctgggcgacctcctgcgccgcgcgacgagcacgatggacctgacgctgccagtctccgcctcgcagacgggtgaggcgaggctcctcggagccgacgtagggggcaacgagcgcgagatgctcgaacggaaggaagatccgatccgcgctcgcgaactcgagctcgaggtactcccgcgagacgccatcgaccacctggcgcacgaggccccgatagcgcgcgacgccgtaggcctcgtggacgacgaagctgccctcgacgaggtcgtcgaagctcagacccccggtcgtacgggtgggcaccgaagcgcgaggagccgtcggccgtacgagactcgcatccgcgatcaccaccaacgatgccggctcgagctcgacgctctcgacgaggtcgagccccgcggccactcgaacgccgtgaccctcgaggcaggtggcgaccgaggccagctgcacgtcgatgccctcctcgccaaggcgttgggcgacatgacgtgcacgttccgagccatgcgtggcgacgacgacgtgaactccgtcgcgccgcgcactccgaatgcgaccgaacacccctgcgaggtcgcgatggctcacaccgaggcgagcaccaaagccggctggatctgccgatacgaggcgggcgcgcactgcgcgcagccgttccggctcggccatgagactgaccgacccgagcgcgtcagcctcgagtccccaggtcggagcgagcgcctcccgaatggagcgctcctcagcgacgaggcgatcggcgatgaccgcgtccatacccttcgccgggacgagaacgaggtcggcctcgtcgacgatgtcgaggaccgtcggtgcgacatcgccgagcacgagtggcacgagcggctcagggggctctcgacccgcgagcacggcctccacccgatcggccaccgctggaacgcgtgcagccagggcctcgagttgcttggcgaggtcggtgtcgatccgaacttcgcgagccgggaagagctcgacgcgctcgaggtcgccgaccgagcgctgcgtcgtcggatcgaagaaagcgagccgatccacctcgtctccgaacaggtcgatccgcaccggcgacgccaagcccgggtcggcgacgtcgacgatcgatccgcgcaccgcgtactcacccgcggccgagacctgaggctcacgcacgtagccagcgtcctcgagccaagtgatgagctcgtcacggacgagctcatcacctcgcgccacgatcagacgctccaggcgcgccgcggaggcgacgagcttcgtcaaggcggctcgcacggtcgtgaccacgacgatgccctcgtcaggcggatcgacgatggacgcgagcgctcgcagacgcgctgcggtcgtgcccatgctcggaaccacgcgctcgaacggcaaggtatcccacggtggcaacagcgcgacagggatccgaggcagccaccaccgcagatcgttggcgatggcctcggcttctcgatcaccctcggccacgacgaccatccgtcgcggagcgagtcggtgccaggcgagggcgacgccagccgcgctcagggccggcggatcttccaccgtcgccgcgagctcttcgacgagcgcggcgagcggcgcctcatgcggatcgatcgacgccacgggcgttgtaggtggtcatggcgcgctccggaccaagcgacacgagatcgacgacggcatcggcaccccgctcgacaccgacgtcgaaggaggtccgctccgggccgcgtacctcggtgaggacccaatcgacgacggcctgacggccggccgggcgtccgatgccaatacgcacgcgccagaagtctcgcgtgccgatgtgggcgacgatggagcgcaggccgttgtggccagcgagcccgcccccgtacttgagctgtacgcgaccgagcacgagatcgagctcgtcgtgaaccacgaccagctgcgtcacagggtcagcgtggaagtagcgcagcaccgccccaacggcggcacctgagtcattcatgtaggtctggggcactgcgagcaccgctcggtgatcgccaagtcgcccactgccgacgatcgagcggtgacccggcgtcaacctcacgtcgaggcgtcgagcgagcagatcgacggtcagcgcgcctgcgttgtggcgagtgaagcggtaacgagcgccagggttcccgagaccaacgacgatgatcggctcagcgggtgctggaggcgtgagctcaggcctcctcgaccgtcgccaccaccgtctccggcgcctccacgaggctcaccccagccggaagtgggagtgcccccgccgtcacggagccatcggcgagcaggtcggcgccgacgtgaatcgacgacggcaccgatgtcggggtgccggacaccgccacgagacccacgaccagccgtactccctcgcccgcctcgagcgggacctgcacctcgaccgtctccgacgcaccgaccgcaagaaaatcgaggtgagagagttcccgtcggacggggtgtcgaacgacagcctggagcttgaccgttcggacctcaccgtcgatctcgatgtcgagcagttggccgacgaccgcgtgctgaccgagcgccgtgaggaagccatgccggtccagcgtgaccgcaactggctcagtgagcccggccccgtagacgatcccgggtaccttgcccgctcgacgcagacgacgtgccgcggccgagccacgagcatcgcgtcgctcggcgaccaccttcaccatcgagacctctcctctgtgccgggcgcacggcgcctccgcgcgcgagggagcagcctaccgccccagtcgggacctcgatgcggctaggagaggttctccccctggaacagctccgacaccgacccatcctcgaagacggcggcgatcgcgtcggcgatgaccttcgcgatcgagaccacctcgagcttggcgatggctcgttcgggtggaaccggcagggtgttcgtgaccacgacgcgcgagatgggcgcgtccatgagccgcttgggcgcggggcccgagagcacggcgtgggtcgccataacccagatctcatcagctccgcgcgagcgaagcagttccgccgcggccgtgaccgtgcccgctgtgtcgatcagatcgtccacgatcacgcagtgacgacccgccacgtcgcccacgacctcgagggccgtcacgacgttggccgttcccttggggcggctcttgtggaccaacgccagtccagcgccgaggcgctgtgcaaaccgctcggcaaccttcacacgaccggcatcgggagcgacgatgaccgcgtcacgaggagcgaacgcacggaggtactccaccagcacctgactggccgtgagatgatcgaccggcccatcgaagaagccctgaatctgacccgaatgcaggtcgacggcgatgatgcgatcggctcccgctgcgtgcagcatgtcggcgaccaacttggcggtgatcggctcgcgacccgatgccttgcggtcctggcgcgagtatccgtagtacgggcagaccgcagtgatgcgcttcgccgaggcacgcttcgcagcgtccaccatgatgagctgctcgaagattgcgtcgttgacaggcccagcgtggctttggatgacgaagatgtccttgcctcggacggactggtcgaatcgggagtagatctcgccatcggaaaactcccgcagcgtgatcgcgcccaactcgacgtcgaggtgctcggcgacctcccgggcaagctgcggatgcgaacgtcccgagaacagggcgagtcgcttgcgggggacgagctccatgcctcacctttcgtggcgcgtcgacgccgcaccatcctaggctccgcgtcacggcgacgtaccgccccctgtggctgtcgcagagacgcccgaacgctcgacggctacgaacggtgggagagcgcgcgtcgatgacccgggctgcgtgggcccgatggctcgacggtgcagtcgatcgctcagaacatgccgaaccgaacgctcctcgcgctggtgttcgtcgggccctctcgctcacctcggtcgatgcgttgctgacacgggcgagttcttgagggtccgctcgttcgggccgaggtcgcggacaacgtcagcaagggcgcggtggttggtctcgttcatccccttcctcctgcacctggagcaggtgtcaaccgggaagggcacggccatccctctgcagctgtcgacgccgttcgaaaactgaacgatttcgccggtgaaaagtgaacacccgagcatggaggggtgatcactgtggaagactgggcactcatcaggcggctggtggccgagggcgtccccaaggctcgcatcgccaagcggctcgaggtctccgatcgacagcgtgcccggtcgcgagccagccaagcgccacgcatcctcatcaccacagccagagtcagaaggtctccgcgccccaggtcatcgacgcctccggggcccaggcgggaggcgtgagcacatcgagtctcgcatcgatggtggcctcggttgcggagcgacagccaccgacaccagcgcatctggccacagcccctcagggaagcccctccatgatcgtcgggacgcatgcgatcgtggtcgcacggtgcgcgagacgagacgctccgttgggggtagcaatggtttgttcccgaggcagtcgatcgccgacttcccacccacggtgcgcagctcgaggaatggggactctgcggcgcggcaccagtggcaaccccgatgctcaacgccgccatgggagccgcggcagctcacggggtccggccgcgatgagtgcgacgaggtcagactcggcgacagggtaaccaccccatgcatcgacgccgacgttgatcatcctcccgtgctgtcgccacttctcatggacatgaccgtgcaggagccaggcccctcgatccttcggacgcaacgctgggaagcgttccacctcttgactatcgccttcgtatgggaagtgggatacgaccacctccacatgcccaagctgcagcgcaagctcgccatcgaggaccgtcaagcctgcagcctcgtagctacgacgccaccgatcgacctggttcttctgcttccttcgcaagccctcccagcacttgtcatggttccctggaacgagaaacttcgtgccattgaagagctcgaccaactcaagcatctccgctactggacccatggcgaggtcgccgaggatgtagacctcgtccgcaggatcaacgcgctcgttccagcgctcgatgaggtcgacattcatcgtctcggtatcgccataggggcgctgtgtatgagcgaggattcccgcatgaccgaggtgcagatctgaggtccaccaccgccgactcatcgatctgagtgtacttcgaggggtgggcacgacgatgatctgccacaggcggcgtcaggaccctggcacttcacgaccacggcacttcacgaccacggcacttcacgaccacggcagagaggccgttcggcattctccctctccagtcttgcgtccttgacgacctctgaccattgcgatccaggtcgccgcctgctcgcggaccaagcgtcacgtcagactccggagcggtcccggacgagcaacctgcagctcgccgtcgaaacccttctaccagctcctcgaggatgcgcgttcgtcgcaggacagcagcgacaagcgatgaccgacggtcccagcgcctgcgggttcaacgacgagaccatccgtacgggtcgacgggcgcgtcgaacgctcccgcctcggcggtcgactgacgtcgggcaccgagcacccgctcaccgccggggccagtcgaccacagctcacgatggaatcttggacgtgcgaacggtcacctagggcaggcgcgcgaacggcggaaccgtacccttcggttcgacgaccgctccagtctcgagcacgctgaaggggcccacggtggcccactctccaatcgtcgcacagcacgcatccaccgcccggagctgggcgccctggcccaccacggtgtcgacgagacgagaatgagcgccgatgagggcattggcctcgatccgtgtcgctccgagcaaggcgacctgcggttcgatgaccacgccctcggccacgcgcacgcgggcgtcgacggtcacggtggaggggtgctgaatctggacaccctcgtgcaggagacgacgtacgatgcgcgcccgcatgcgctcggcgacgtcggcgagctgcagccgatcgttgacgccgagcgcttcggtcgggtcatccaacacgagcgtcccgacccgatagcccgactcggcgagcagggcgatcgagtcggtcaggtagtactcccgctggcgattggtcggcgcgaggagccgcaacgccgaggggagcacagcgagatcgaagacgtagacgcccgtgttgacttcgcgggtggcctcgccccgatcatcgtcgaggtcggcctgctcgacgatggcgcgcaccttcccgtctcgggcccgcaggattcggccatagcccgatggatcgtcgagctccatcgtcaacaccgtcgccgcgttgccttgggctgcgtgggttgcgagcaaggccctcagcgacgtcgccgtcagcagcggcgcgtcggacggcacgaccaccacctcggcaccgctggagccgacaccaggcaggagatccggcaaacgggtgagcgcgacccgaaccgcgtcaccggtcccgcgttggtcgaactgataggccgtcacgacctcgacgccgctcggagcatgtcgctgcacctctgcctcgacggcctcggcctcgtgaccgacgaccacgacgatgcgcgacagatcatcaaggtcgcccagcgcagcgagcacgtggccgaccatgctgagaccgcacacctcgacgagcggcttcgggcggtccgaccgcatgcgagtccccttgccggcggcgagcacaacgccgtagcgcatagcgcaacctcctcgtcgcaaggctagcttcgggcagtccgcaccacgtaggtcgtcaccgaatcgggcgtgagcagcgccaccacgctgtgcgcgtcgacgtccggcagcgccgtcggctggagcgacttggtcggattcgtcaccaccgcgcccatggcctggaccccgtcaagtcccgggggaagctgcacctcgagaggcaagggggctgagccaggggcggtcaagttgatggcgatcagtacgagacgcccaggtgcacgccccgcgagcatctccacccgcgcatccgacgtcgtcaccggcacgagacccatgcccggacggaggtagcgagagaactgtcccagcacgtcgtagcgcttggtcaggtagagcgtgtggtcgccgtcgcgtgcaccgttcaggtcgaagtagatgagtccgtcgttgcgcccgagtgggttgatgtctcgaaagcacccagggtcggccgcaggactgcagccgagatccggtgagagtgccagccaccagtcgaacaccgaggcgttctcgaccatgaggtcgttgtagatcgtctgggcgagccagaggcccgacgtcatggttgggtcgtactggtagccgaacccctccccgtcatagcagcagatctccgtgtcccagatcggcacgccccatcgacgtccgagcaacgcgacctggtggagcaccgcccgcgaggggtagtcgtagccatggaccgcgagggcggcgagcgaggcacgcacgcccggatacgtcagccaccgtggcgcctgccggagcagttgcgtggcgtaggaggactcgtcggcgatcacgcgcgcccacggcgcaacacgcgccagatcgcgcgcgaggtccacgacgagcggaccacgctctgccaccggaacagccattccctcttggcgacaggccgcttgcgaacccaccggctcgttcatgggcgacacgtagcgcagcttgacgtggtcgacgcgccacagacccgccacggtcagcgcgagctcgtccgcgtacgcagcgacatcgccagcgaggagcgtaccgccgcagctgcggtggttcgatgtgaactgcgggggtgctgcgttgacgaaccccacaagatcgcgcaccccccacgaggccgcttgacgggcaaagagcaccccctggggatcggcgtggaagtcgaacgtaccgttggcttggtagaagctcggcggcgccttccaccacgtcgtcacacccacgccgccgccgccgatgttgaagcggaactgcgacagctccaacccgcgcgacgagtagagcagccggcccacctgcgcgatcgtggcggagccgagcgctgcgaccggtcgcgaccaccaggcgccactcgccccgatcccgaccagcgtgtggcttggacgtggccccacgtctgcgacgacgagcggctggcgcggcggcgacgacggcgaggcgggcggcggagcgagcacgttcgcgccagcgacgatggcaaccccggccgcgacggccgtggtgacggacacgacggctcggaccaggctccctacgaccgcccgccgacccacgtcacgcatcgccgcgccacgctacccggcacggggtgagggcagcctgatgcccctgcgacctggcccctcgagcgccaaccttgcactaacctcgacgcgtgaacggagccgaactcgccgcgttgaccctgagcgatctcggcgtcggggtagtcttcgccaatcccggtacgagcgaactggttctcgtcgatgccctggagcgacgtgggccgcgcccgattctcgttacccacgaactcgtcgcgatgggagcggccgatgcacacggtcggctcggcaggctcggggcggcgctcgtccacctgggtccgggtctctcgaacggcctcgccttcgtccacgacgcgcgccgagcccacaccccgatgctcgtgctggtcggcgaacatccgcgctcccatcgggcgctcgatacgccgctcaccatgcggatcgcgtcccttgccgaggccatcgacgtcccgatgatcgcgatcgacgaccctgcgctgatcgccccccaactccgcgcagccgcgaccatcgccaccacgcagcgcacgccggtcgtcgtcacgctcgatgccgtggcgatggaacgcgaagcgacaccctccgaccccagcgccccacccacgaccgcgcacgaggcgccttccatcccccgagcgcgcctcgaagccgcgatcgacctggtgcgcgctggagagtgcaccttgctcctcggcgctcgcgttctcgagcccgacgcacgcgcgctcgcacgtgccatcgccgatgacacgggcctgcggctcttggcggagaccttcccggcgtcgcatcgctacggagaaggggcggggcgcatcgagcgccttgcctacctgcccctcatggcgcgcccgcagctcgccacggcgcgtagcgtgctcgttctcggaaccgatgccccgtcggcgtggttcgcccacctcgagcaggatccgcggctctggccgctcgctgcgcccctcgtacgcctcgacggccaggacgaggacccacgcgtcgtgctcgagcacctcgccaaggcgctcggggtcacaccggctcctccaccgacatcgcaacccattccggcgccggacccccacgcagcgctcgacgggtcgacgctcgcagccgtcatcgcacgagccgtgcaggccgacgacgtcgtcatcgacgaagcgcgcacggctgcccccgcgctctacgaacaactcgccgacgcgcgacgccaccactacatcggtcaccctggcggtgccatcggggaaggggcgtcgctcgcgctgggggcagccacgctcggcgcttccgtcctcgctgtggtggccgacggagggttcctctatgcgccgcaggccatctggaccatggttcgcgagcacctcgacgtcaccgtggtactcgcggtgaacggcggctaccgcatcctcgagatcgagcagaccatcgctgggctcgacctccacccggagctcacccgcctcgacgacccaggctgggacttcgctggcctggctgctgcgatgggcgcacgaacgacgaccgccacaacggtcgcagagctcgaggcggcgctacgagatcgacatggcgtccacgtcatcgtcgcgaccgtctcccaatgaccggtgggcgcccaccccacctcggaacgagccccgtcacgaggcggcgagtccaaggtgttggctgaggaactcgacgcgagccctcgctaccgcctcgagatcgtcgggtcgccgtggcccgtgacgactctcgaggagcgggaggaatcgtaggtcgatcccgaggtgcgcggcacgctcgagcagtcggagcgagtgaccgacgtgcacgttctcgtcgaccatgccgtggatgacgagcaccttgggagcatctggacctgcgagtccttcgatcccgtgcaggacgctcgcctgctcgtagcgtggatcgtcgaccaagccgaggtagcgctccgtgtagcccgtgtcgtaccagcgaaagtccacgaccggtgcacctgcgaccccgacccggaagcgtgacggatgtcgcgaggtcgcgagcagggtcaggtacccgccgtagctccacccgaagatccccacgcgagtggtgtcgatgccgaggtgggccgctgcccaatcgatggcggcgagctggtcgtcgagctccacggtgccgaatcccctggcgatcggctcctcgaaggcccggccacggttcgccgaccctctcccgtcgagcttgacgacgacggcgccgcttcgtgcgagccactggcaggtgagatctgcggtgagcgaccatgcatcttgtaccagctgcacgtgcggccctccatagaccgcgagcaccagcggacgaccctcggtcgacccttccccttggtagaccgcggcgtagcgccggacgccatcaccgaagtccgcttccacgaggcgaggggtcggcacgacgacctcgggctccgatcgcacgagcacctccaggtcggctccgatccgaaggagctcgggagcacgctccacggacgacctgaccgcgacgattgcccgatcgccagcggcagcgaccccgaacacgccgcccgcgagcacctcgtcgggcgacgacccatccagcggtacgcgccacagggagcgccgtgtcggatcgtcgacgtagccgatcgcgaccaccgacccaccgaccacgccgacgatggccgtcgccacgagtgccggggccagcgcacgtgcaccctcatccgtgatcgccgtcacgcgccagaagccgtcgaaacgctgactcctcgtgacgaggacgccgtcggcaccgatgagcacgcccggcacgtcgacccagggttcgtggtgctcgcgatcgatgcgcgtcgcttcaccatcgcccatcgacacgcgccagcgggtgagctcgtgctgcgcccgatcgaggatccctgccacgaacgtctcgtcgtcgagccagagggcctcgacgaggtaaccgtcaccgatcggcaggtcgacgatcgtcgcgccacctccgtcgagcgtggcgatcgcgatctcgaccaccgcgttcgccgcgccgacgaaggggtagcgatgccgctcgacacgctcgggaaagggtccgtgatgcacgatgaggtgctcagggaccttggactcgtccaccacggtccaggccactgaacggccattcggcgagagccagagcccgtcgtgacgatcgaattcctcctgagcgatgtagtcggcgagcccgatggtgcgatccgtggcgatcgcgagacgttggcgctcgcccggccccgcaagccacacctctgagccactcgccgcgaccacacgatccgagccagcgcacgtcgccacggcgaccgcgccatcgaggtcatagcccacgactggccgaccagtccgatcgaccacgctccaacgaccgccggtcgacaccgcaagtcccgcggtacccaccagccgaaacgagctgaccccatcccaggaacgtcggaggcgctgggcttcgagctcgtcggcctcggtcggtcgcgcctcgtcgtccggtccaaccagcaccacgggcgaggagtctcccgccgcccaccgaacgagcgaggcgcggtcgtcgtcgccggtacggagcgcgaggaccgatgcgccatcgatcggatcgatggccacgagtccgacctcgaccacgcccggcaaccgtcggcgccacaggtcatcgaaacgaagttcgcgcatcatgcgagcaccttacgtgccgaggcgccctggtgcgtcagcgtacgagacagcgaaccagactgcgggccgcctctcgtgcccaccgactcggctcgtacaatgacgccaaacctcgtggtcgaagacccgggccggttgagcgctgagcggttctcgtggtgacacgcatggccggagacgatcctccgaaccctcaccaatggcccacgccaggactgcactcccctggggccgggacgaggcggcgtccgatctgagggggaggtctgcgaaacggtcaccacgctcgctcccggccaccctcaccatcgactcgatccggcggagcttgagcgctaggtcgccgacgcctcgtcacgcggctccggccgcggacgctcgggcagcgcgtcgcgacgccacaccaagaccttgcgccgaaaggagacgacctcctgaccatcttggttgtagccgcgggtctcgacctccaccacaccgcggtccggcttcgatcgcgacggcacgaccgcaaggacggtgctctcagcgtagatcgtgtcaccatggaacgttgggtacaggtgacggaggttgttgacctcgagattggcgatggccgagcccgacacatccggcacgctcatgccgagaacgagcgagtacaccaggttccccacgaccacgttgcgcccgtgcaccgtggcgagctctgcgaaccgctcatcgatgtggagcggatgatggttcattgtgagcaggcagaagagatggtcgtcggcctcggtgatggtcttgcccggccagtgccgaagcacgtcaccgacgacgaagtcctcgagacagcgcccgaacgggcgctcgtgggtggccaccgaactagtcgagtggtcgtggccccgagggcatcggtgctggacctgtcggaccgttcgcgggtcctccttgctggggcatctgtggtggcgcgagcgtcgagaacgacgcgtaccagtcctcgcccgactcaccgtcgaccacgagctgccaacggtaccgcgagttggcgggaagcgggaggggcccgatcgtcaccgccagattgagcgggatatccgaaccgagcggcacgccctgcggggtacccaactggaagtcaccacggatctcgaccggctgagggccctccggagtctcgatcgtgacctgttccccggcttcgtcctggaggaacagctcccagtgatgcggattcggcgcttcgccccaggcgagctccagtcgcatcgcgatcgccatcggcgcaagaccagcgacggtcatcgaccaaccgcctccgaggatgtagagcttgccgtcgcagacttgcgcggcgtcacagagcatgagggaagccttcacggcgccaacgctagccgccggcacacctcgggtcagcgcacgagagcgcccgtgccgagcagggcgaccacggccgtgaggttgaacgccgcgtgcgccacgatggatggtccgagtcgtccggtacgcgagacgatgatggcgaggatcacgccgaagacgaacaggccgagaaattggagcggctcgaagtgtgcaatcgcaaacagcagggcgctggcgacgacgggaaccccgatgcgaagcagcgagggccacccggccgcacggagctcgtagagccgcagggtcacgccgcggaagaagatctcctcacacaggggcgccccgatgacgatgatcgcaacgacggcgaggaaatcgtggccgacgccgacgccgagcagctggacggctggcttggagatcgaccgacgcgcagccgggtcaacggcctcgacagggagatagagcagcggaaccacgacgagctggccgaggacgccgacgccgatcccgaccggaaggtcgacgaggcgcatccgaaagcgcacgaagcggaggaacgaccccgcgccccaccagcgcgcaccgagcacagcagcgccgacgaacacgacccacaggcccgcttcgtcggcggcgagcaacgacgggctgaggccagcgaccgtggtcggcaccgctcgatgctgcagcgctgcggtgccgtcgagcgccaggatgctgcacacgaaggcgaccgcgagagcgacgacggggaacgcgagcgcaccccagctgacggtgccgagggagtcgcggtcttccgtcacggcttccctccttgcgcagcctcgatgggtaccacgccgttcgctgacgaccgtacacgagcccaaccccacggagtaggcaggcctgcctcgcaccgcatcacgacatctcgaacgtgagcagcaaccctgaggcatcgctcaatgccgcctccagggtaaccaggactcctcgaccgaagctcccgtacgtgcaggaactcgcctagcataggcagggtatgatgccatcgtcccaacgcccctcgccacgaggctcgcgtcagtcgccgtcgcccgaccagcgcgggcgcattgccttcgcgatcctcgcaacgctcgtcgtcgccgtgctgctactgactctcttcagccacgccccgagcggacagccccttggctacagcaccttcatccacgacgtacaggccaagcaggttcgcacggccgtcctcaacaacaccacgggtcagatcaccggctcgctgacgaacggtactgcctacagcgtcaccggtccgctgccctacacctcgagcgaactcagcacgctctcgaaggcccacgtccaggtgagctacatcacccccgggcctggcatcgcgtccaccatcatcgagtacgtcatcttcttcgggatcttcatcgggatctgggtctacctcacgcggcgcacgcaggggtcggtcaacggcatcatgagcgtgggtcgctcgcgcgcgaagacctacaccacggaacgcccgaagacgacgttcgacgacgtggccggctaccagggcgtcaagggtgaggtgaaggaggtcgtcgacttcctccgcgatcccagccgcttctcgcagctcggtgctcggatcccgaagggcatcttgctcgtcggtcctccgggaaccggcaagacgctgctcgcccgtgccgtcgcgggcgaggctggcgtgccgttcatgtccgtgtccggttccgacttcatggagatgttcgtgggagtcggcgccgcacgcgtccgcgacctgttccagacggctcggcgccagtccccgtcgatcatcttcatcgacgagatcgactccatcggtcgtaagcgcgggacaggtctcggcggcggacacgacgagcgcgagcagaccctgaaccagatgctctcggagatggacgggttcgatccggctgagggcatcgtcgtgatggccgccaccaaccgtcccgacatcctcgacccggcgctgctgcgcccgggacgcttcgaccgtcagatcgtcgttccgctccccgatctccccgaacggctcgccatcttgcaggtccacacgagaggcaagcgcctcgcgcccgacgtcgatctcgaggtcatggcgaagggcacgccggggatgagcggtgccgatctcgccaacttggtcaacgaggctgcgctcaacgccgtccgcaggggcgcgaccgacatcgccatggcagacttcgactctgcacgagatcgcatcatcatgggccagcgccgcgaggccaccatcctctccgacgaggagaaggagcgtgtcgcgttccacgaaggcggacacgccgtgctggcctatgtgctcgattactcagatcccgtccacaaggtcaccatcctcccgaccggcatggccctcggcgtcacccagcagctcccagagcgcgatcgacacctctatccgcgcgagtacatcgaggacacgctcgtggttcggatgggaggtcgcgtcgccgagctgctggtctacggggatctctcgacgggagccgccaacgacctccagggcaacaccgagctcgctcgcaggatggttcgcgagtggggcatgagcgagcgactcgggccgatggcgtggggttcgcagaacgtcgtcttcctcggcgaggacctcctccactcggccgagtactccgaccgcacggctcgcctcgtcgacgaagaggtcgaacgcatcctgcgcgaacaggaggaacgcgcgaccgagctgctccgccagcacctcccgggcctcatcgcggtggcgcacgcactcctcgaacgcgagaccatctcgggcgaagaggtcgggcgtctggtggacgaggcggcaggccacccgatccaccccgacggcaagcgggtcctgccgatcgccaagctcccggagtacgccgagctcgagcagttcaccgtcacgaacggcaacaatcacgctgcatcgcacgacgacaccgaccccgtcagctgagacacccgtgcgcgagttggtcgtcgtcgccgagttcctcgggttgacggaggcgcacacctccgggggtttcctcgccctcgaccgtggcctcgcgaccagtgctcgactcgtggtggcgggcccgtgggcccccgaggtcgtccgtcgctaccgaggccaggaccttggtgtcacgctgacgctgacctcggcccatccgatcctgcgactctccccgctcaccgcggcaccaacgctggcgagcggggatggcggactcccggtcgcggccgccgacctcgtcgaacacgccgacgccgaggaggcagcgctcgagttgcgcacccagctcgaacgggccatctggtggggcatcagcccgagccacgtggcactcttggacgaggggatcctgcgccgcgccgacctgttcgacgtggtcgcctcgctcgccgaggagtacggtctcgtccttcgcctcacgccgagcgccgacgaggcacacctcggctacgacgcctgggggatcgctcgcgaccgcggcatccgcaccatcgacgccgcgatccccgtcgacccggcgacgctgaccgacgcgggcgccctgctggatctcgtccgctcgagtgcccacgccctcccagagggcatcagcgagctcggcctcccactcgcgatcgacagtcccgagctcgcggcctgggtcgcgagcggcggtgccgccccggcccccgtccggctcctcgagcacatcgaacgcctctggggggcactcgagcagcgctccatccaccggacgagctaccgcgacctcagtcgccgagtcgatcgaagtccgtccgacgggcgagctcctgctcaagggttcggtacgccggcgacgccgtaatgggcagcagagccacgagcagatcgaggttgccctcgacctccaggcgcccttcgagaaacgccgtcgtcggatcgagctctccccgctgcatcgcacgcgcgatctcgacgtccaccgtgatcgagacgtccgggttcgggtgctcgccaagcccggcgtcggcgagctgcccgtcctcgatcacccagtagtacggacgctcgacgtcggcaagcacgtagtactgcaccacgccgttcgcaccctcctggcgaggcatcgccgcaccgagttccttcgtatcggcgacccacgcgctcgagagccatgcccccatcacatcctcctcaccatcgggtctcgaggctcgccggctccagcagcagatcggcgaagagatcgtccaccacgacgccggctggctgaccgacgatgtggtagtcgtccgtcggccacagctcctccagctccgaagcccccagcgcgaaccaccacggcgatgccgggtccacctgcgatgcgtgggcacggagcgcctcgtgggcacgctcgatgaagccggtgacgtcgacacgcgccccgacgagctcgtcctggcccgggcgatccgtgcgagcccaaggaacctcgatcccccgtgcccgaagcgcctcggcaatgcggacggagcgctcccggacccacagtgaccacgcccaccgcggcactcgccacggtgggccgagctccggcaacaccgtgggctctggcgccaaggcgagcgcgaggcgcgtcgcttcgaagacacggagatggtccgggtgcggatagcccgcctggtcctcgggataggagatgacgacgtgaggtcgcacgcgcctgaacgtggcgatcaagccacgcgccgcctcaagcagtggcaccgaaccgaaggcgcgtggatgacgcgccgtgggagagcccggcatcccggagtcgcgaaacccaaggcgcacgatctcggcatagcccgcgatggccgccgccttgtcgagctcctcacgccgcatccgtgccatgcgctccggccgctccgtcgcgagctgagggttcaggtacgaaccctcctcgcccccggtcgccgtcacgagcacacagtggacaccggcatcggcgtagcgcgcgatagtggccgcacccttcgacgcttcgtcatcgggatgagcatgcaccgtcaccaggcggaacgttgcgatttggcgcgccgacgtctgggaactcacgccgccagcctaccgaggaaccactcctccagggcgccgtgctgccctcgaggcttacgccggcaccagcgtcaccgacccgctcacgctcacggtgccgacgccaggtcgaccggcgatcgcagcatcgaggacccgagcgagccccacgcgcgtcggcgttgcgccaagggcgtggatcgccccgaccatgttcagcccgaccacaacgccgagggtcgctgcacgagttccccctgcgcgtgcggacaaggtggcgacgagcggtgcccacgacggtggcagcgtcgtcggcacatcgctcacgaccgagaggcgtcgaggatcaatcccggcgctcaccgccagccatgcgccgtctctggcgggggcgagcatcgcgccgacgacaacgacggccttcggtgtcacgccagcctggacgagatcgtgcagcacggtcgcgtcggcgacaagatcgtcgccgacgacaagcgtggcgcccggattcgcgcgcacggcactcgcgagcgacatcgagctctcgccgatcgcgtcacgcacgcccgccggcagcacggtcatcgtcgtcccaggagggagccacagcaacgggcgcgcgcccagcgagccgtcgtgcatgagcacctggagctgcgcagcgaggggtggcagccagcctccagagacgatcgggaaggacgatgatgccccgatacgtgacgccaccgttgcaaccgtgctcgtcgctggcccgagactcgcgccgacgacggtgaacgcgtccaccgtcgtcagcgcatcgcgggtctcgatggccgctgcactcgacgtagctggcaccgtctccgcgatgaggtcgatgcggcgacctgcgacgccaccgtgctcgttcgcccacgtgagcgcctcgtcgatgccacggcgataggaggcagcgccaatgctccacggagactgagtggccgtcaccgtcgccactgcgacagagctcgcggtcacgccaggtgcgctcgccgccgggagcggcgtcgacacctgcgtactcgtgcacgccgcagcaacgaggccgagggcacaggggacgacgagatgacgacggcgcatcgcgcctcatgctatcgagcgccctactggaagtccctggagccaagggcgatggcctcaggaaggctcacgatccgatcagcgaccacggtcacgacggtcccggcccgctcgatcacgccgtcgaccagcaccgcgctgtggagtgcctgcgatcgatcgcgacgccagagccacggcttgaccaacacgttgacgaggcccgtctcatcttcgaggttcatgaagacgatgccacgcgccgtaccagggcgctggcgatgcgtcaccgtaccggccacgcgaacccgccgaccatggcgctggctcgccagctgatcggcgcgcacgacgccaagtgtcgacaaccgctcccgaacgaacgccatcgggtggtccccgaccagcaggccgagcgcgtcgacttccagcgctgcccgctcacgagggtcgagggcagggaagacgggctcgctcgagggaaacccgaggccatcgagcatccgatgccgacgtgccagctcgtcggcgaaccagatggcgcgctgccccgacggctcgagtgcacgcagggcaccagcgccagcgagacggcgaatctgctcgggcgtgagttcgacccgctggacgagatcgaggagcgagtcgaacggacgcatcgcgacgatgctcgacgccgtcgccgctgcgatccctcgaacggcgtcgagaccgagcgcaaggagctgctcgccatcgcgtacgacgacgtcggcgcgtgcgctcgaccgcgtcacatccggaccgaggaccccaacaccatgacgccgcgcatcgcgtacgagtgtctgcggcgaccagaaccccatgggctgagctcggagcagcccggcgtagaacgccgccgggtagtggaccttgaaccatgcactcacgtagaccagccacgcgaacgacgccgcgtggctctcgggaaacccgaagttcgcgaacgcctcgagctgcgtgacgacctgctcgcgcgcggccggatccacgcctcgagcggccatgcccgccatgagccggtcgtggagccgtgccatgcgcgcgctggagcgcttcgcccccatcgcctggcgcagctcgtcagcctcggcagcactgaaacccgcgacgtccatcgcgagctgcatcagctgctcctggaacagcggcacaccgagggtctttgcgagtgctcgctcagcgagcgggtgcggatagaccactggctcctcaccggctcggcgacgcaggtagggatggaccgacccaccttgaatcggaccggggcgaatgagcgcgacctccacgacgaggtcgtagaaccggctgggacgcagccgtgggagtgtcgccatctgcgcacgcgactcgacctggaacacacccaccgagtcagcacgagcaagcatctcgtagaccgccggatcctgttccagcgtggcgatgtcgacctcgacgccgacgcgctcgcgcacgagatcgaccatctcgtggatcgcctcgagcatgcccaacccgaggagatcgaacttcacgagacccatgcgcgcgcagtcatccttgtcccactggagcacgctgcgaccctcggcccgtgcccattccgtcggacacacgtccacgatggggcgatcacacaggaccatcccgcccacgtggaccccgaggtgccgaggagcgccctcgaggacgctcgccacctcagcaatcaccgcagggacctcgagcaacgggcgacccgcgccgtcacgttccgcgagtgagcgcgcgaccgaacctcggtgctcgacccccttcgaccacgccgcgagcgtggcctggtcgacaccgaagacccgcgcgctgtcgcgcagtgccgaccgagcacggtacgtgatcacgctggcgacctgcgccgcacgcgctcgtccatagcgggtatagacgtactggatgacctcttcacgacgacggctctcgatgtcgacgtcgatgtcgggaggaccgtctcgctcgggcgagaggaaccgctcgaagagcagaccgagcgccaccggatcgacgttcgtgatcccgagtgcgtagcacaccgccgagttcgccgccgagccgcgcccttggcagtagatgccctctcgcacgcaaaagtccacgatgtcagtgacgacgaggaagtagccggcaaaaccgagcgagcggatcacgtcgagctcgtggtcgatctgctcccacgcaccggggatccgcggcgcagctctcggaccgtagcgcctcggtgcccgctcggccacgagcgcgacgagggcctcgtcatcgtcgacgcccatcgcgacgacgtcacgaggcaggccaggggccaccagatcgacgttgaaggcgcaccgagcggccagctcgacggcggcgtcgaccacgccgggatagcggccgaaccgcgctcgcaacgcgcgcgctggccgcagcaccggcggccctgcgcctgggaggtagccatcgagctctccgagggtgcgccgtgcacggatcgcagcggcaactacggcggctcgctgggttcgcacgtcgatcgcgtgcacagcctgggtcgccaccaccggcaggccgtggtgcgcaccgatcgccgcgaggacgtcgttgcggaccgtgtcggcagggtcgagggtgtcgacgagttccaacaccaacgcatcgccgaagcgctcccacagcgagcgcacactgcgctccgcggcgctcggcccagcgtgcgcgagcgcacgccccggagggctcttgcgccaccccgcgagcacgaaccacccacctgatggggccgcctcagcgaggtcgtcgatcgtgagatcgaagcgtcccttctcgccggtacgcatgtgaccggtcgcgatgacacgcgacagcgctcgatagccctctggcgaggctgcgaggaccacgaggtgctccccttccgggtcggtcgcgccagctcgaggcgtcgtcgtcgccaacgtaagttcggcaccgacgagtgggacgacccccacacggcgagccgcctcgaggaagcggggtactccgtagagaccgttgtgatcggtcagcgcgagcgcacggtaacccgcgaccgccgcggcctcgacgagatcctctggatcgacgacgccgtcgaggaagctgaacgacgaatgggcatggagttcgacgaccgcctcgctcactcgtagctcccctcgagccaccatcgcccgtgctcccgtcgaacccagcaccaccgccgctcggtcgcgagcacgagtcgggcgtagcgagcacgacggcgctcccaccaccgctcgcgcaccacccacggcccatgagccgcctcgatgcgctcaggaccctctccgtcgtcgagcaccgccggtggagcgctcaagacgccatcacgatcgacctcgacggccataccatgcgcatcgagcagcacgacggcctggaggcgctccggaacccgcgtcggcgtgagtcccggaacatggccaggccacggggcgccagttccgaccctgtcgtcgacgaccggccaaaccccggtccaggacacccaaggacgtcgatcggcgaacccgcgacccaccggtcccggacctgcgacccgaaccgcctccggtccatagcgctgctggagcacgtgaaatgcctgacgtacggcctgacgtcgcgcgccaggcacgccatcgagggagagctgcgggggttgtggcacactccacgcaaggatctccacgccgacgcgtaccggtcgcccccgagcaccctcggcgcgatcgctcagcgcacgcaccgattcgaggatctccgccgccgtccctccgaccgggcgctcgacgacccgctcgagcgccacggctccctcgaggtcgacgaaggagcgccatcgggcaggcgcgacgtctgcgtgctcggcgagcacgagatcgagcgccccacggaggcgaaaccgcacgctctgggcatcctcgccttcctcgacgtcgatcgccaccgcgtccggctcgagtggaggggtgcgcacgagcggaagatcggcttccagtcgcacgagtcggtgccagcgcaggccacggtctccgaagcgagcggccaccgcagccgtgtcgatgcgctggaagccaccgacgcgacgcacgccgacgtcacgaagcggaccagcgagccaccggggcagcagctcgaccggctgggcagcgaaccacgcccgcgagcccacctcggccccgcctccatccgtcgtggcgccagcgacggtggcgatgagtgcgcccgcgatcgaagcacccagcgccactcgagtcggcacggtgccgtcgagggctgcccgcacgcgctcgacgagtgcgtactcggtcccgtagaagcggcgggcggcacgcgcttcgatcgcaaaggccccacgcacgcctgccacctgacccacgcccggcgagacgctccagagtgcccggtgcacgcgggccaaccaacgtgcctctgcgatcggatcgaccgcgaccacccggccatcaccgaggcgggcacgcaccatgggggcacgtgccccgagggggatcccagcagctcgagcacgggacccgacggcgacgacccgatcgcgacgatcgacgacgacgtcgaccgcatcagcaccaccatgtgcgatgagctcgagatcctcgatccacgcaacgacccctggccgcgcagcgaccagctcgatgccgtcgaggtcgatctcgtcgaggtcgatcaacccgccacctcgacggccgtgggcgtcgtcgtcaccagcgacgaacgacgcaagctgacgcgcacctcgcgcggcaggccagactcctcggcgaccgtcatcgaggcgacctcgagcgcacggatcgatcccgctgcggccagcacgcggtggcgctcgcgactgcacgcgcgttccagcaccacaacgatccctcgtcggcggcgcacacgcccgagaatgcgcggccaccggacgtcgacaacccgatcggagacgacgagcacgtcgaccacctctgcaaggttggacgccacgaccgccagctgcgctgtcggcaccgacacctgtgccacgtgtgtgagcgaccacccagccgcttcgagcgcggcggctggcaggtcctcgagaccgagcagcgccaccgccctgccctgatgagtactcggcgcgatcgcctcgagtgcaccccaacgcgcacccgggccgccgtgcatcaccagcgcggttccaggcgggacgccgtccccgaggcactggcccgccgagccgcccagctcgagtcgctggtctaccagctgcccagcagacaggaaggaggtcacatcgtgattttagaacatttgttcgttcatcacgacggctccccctccatgcgcccccactgcgcgatgaagtggatccgctcgggaagcagcagcgaccgccgatactcgaccggtcgcgccccggcgaacgtgcgccgctcgaccagcaagagcgcttgaccgacctcgacaccgaggagacgagccacctcgccgtcagcgttgacggccgagacctcgtccatccccgccgacacgtgcacgccggcgtgctgctccaagatctcgtagatcgatccctgctggagcttggcctcgagcaacacctcgccctcggggagcacgacgctcgcctcctcgagtgcgacgacgtcctcttcgacgccccggaggcgccggaccacgacgaacgactgcgcagggatctccaggcgctccgcagcccgagcatcgtcgcgcacctcgacactcagcagcgtcgcgacctccttgcccacgtcggcaaggcgcgccgccagcgagaatcgctgctgctggtacccctcgaactgcctcctgggcactacgaaggtacctcgtccctggcgagcgtcgaggtagccctccatgcgcagctgacggatcgcctcgcgaacggtcgcgcgcgacaccccgaaggcatcgcgcaattcgggctcggaggggagacgatggcgcacccgaccatcgtcgatcgccgagcgcagctcatcggcgagctgcacccacagcggcaccggcgaccccggatcgagacgagccggctgtagtcggtcagtcacgagatcccccatccgttcgaagcagccctgcaggtgtgctcacacccggcgcgctgatccgcccaacccatcggtccagcatacggtcggcgctcaacctgcaccgtcgagcgctccacgcgccagacatcccagctcgttgccccaccgcctggcggcgacacgagtcactgagaccaatgcatcgagacctcgtcacggagggcgatcgacacacgacgcctacgcgatcgcgaccgaccgctccggcgtacccgtcgcagagacgaccacgacgacaccggcgctccagcctcagcgatcgatctgacgcagccgtccttgatgcacctcgatgcggcgctctcccgcgaggatggcctggatcccacgtcccacgacgtcgtagcgccacccttcgagcaggctcccctcgccccgagacacgaagagctccacctcttcacgcgaaccgagcaacgagggctcgagttcgagctccagcgccactgcatggacgagcgcttgtgccgtgagcacgagcggcacctcgtggggatcgagcgcgcgatccatacgcacggcgccccgagccacgatggcatcgtcgtcacgcgcagctcgtacgacctcgagtagctcacgagcacgttccttcgccatgcggccgtcgaagccccgcacgctgcgcagctcggtgagcgagctcggacgcgccttggcgacactcgccacggcgagatccgagagcaccgtgcgcaccggaacgtcgtcgcgttgggcggtgcgctcgcgccaggccgccacgctcgctgcgatccgtctccccgtaggatcgaggccacgacactcccggatccgtgtccatgcgagctccggttcgatgtcccgacgccgccgctccacgagacgagccatctctgagcgagcccagtcctctcgtccacgagcgtgcagttcctcgagaagccggtcggcgagcgcagcgaggtagcggacgtcgttcgcggcgtaggcgagttgcccgggctcgagaggacgacgcagccaatccgaggtgcgctcagccttggagatgctcacgccgaggtagcgatcgagcaacgcgccgagactcgcgtgaccggccccgaggaatccacctgcgacctgggtgtcgaagatacgccgtgggcgtgcgccgaccgcgcgctcgatgatctcgaggtcctgatcggcagcgtgaaatacgagctccacctcgtcgaaccacgctgcgatcggcgagagatcgacccgcagcggatcgatcaaccacaccctccgatcgatcgcgacctgcaccaacgcgaggcgtggatagtacgtccgctcccgatggaactcagtgtcgatcgcgatgcgtggcaccccgagcccgacgccgacgagttcgtcgaggtccgactgtcgatcgagccagacgggctcgtcatcgctcacgaccgacgcactcagcgccatcagcacgacccgcccgtcgcccacacggcgctcgccgtcactctggccacgcctccagcctaggagcccttcgaaccagccctcccgtggggatggggctggtcagaggtgacctcagctcgcgagcaggccgagagcatcgtcgtgacctcgcctacagtccttggcaactcgggcaccatcgcaagatttccggtgttcgcggcggccaacacgggttgcctgctgcaccacaccacggcgaagacgttccgagtcgagagcgatcacctgagcgaccgacccaatgagccaccgccgcaggctgggcttccccccacttgcttgacagcctgattgaggccacggccgcctcccgacgggtccaggagagctcgtactcgacgggtggcacgtacccgaggctcgggtgcggtcagaccgcgctgtcgcacttgatccagacaacgagagcatgaccgagctcagggaggttcgccaaccgacgccgagtgaccagctcccgaatcgcgttcgcgaacgcgatttcggcctcaacgcaccaagcgcccgggacgaagcacagccccttcacgcgtgcgcagaccgccgtgccacgagagctcgtgcctgcgtccgtccgagcatgactcggccacggcggtcccccgccctacgctgtggccgtggaaggttgcgtgttttgtcatctccttgccacgagtgacccctatctcgtcacggcggaccacgacgtcgccgtcatcttggatcgcgcgccggtggctcccggtcacgcgctcgtcatcccgaccggccacgtccccaccttcgatgacgcgagccctgctcagttggcttccgtcacggtgaccgctcaacgactctcgcggggcttgcgctcgcacggcatcgcggacggcgcgctgatcctgaccaacgtggtcgtctcgcaatcggtgccgcactggcactgtcacgtggtgcctcgacatcgcggcgatgggcttcgaggcttgctctggcctcgacgtcgctacggcagcgacgatgaggtcacgctctggcgcacgaccctgcacgcgctcgtagcaccacagagctaggaaccctggctggcgcccctcaaacaagaccacccgcttcgtgagcgaccagaatggacgagtgggagggagaccacatgaagggcccgaagcgccataggccggagcagatcctccggaggctggccgagggggacagctgctgaaggcgggcgccacggtcgtcgaggtcgctcgggccttcgcacatcaccgagaccacctgggagcggctggctggccttcccccctccaggttgacacctgctctaggaggaagggatgagccagacaccgaacccaccaccgggcgacagccccgctcggcgacgacgcggccgctacccgagccagttcctcaaaggagccgcagcattggtcctcgaccagcgtcgcaccatcgctgaggtcgcccgcgagcttggcgtgaacgagcagacccttggcaactcgcgtgcaccaggaacgcatcgaccgcggtgagcgcgaaggtctcacgagcgccgagcgcgaggagctcactcgtctgcgccgccagctcaagcaggtgacgatggaacgtgagctgccgaagcgttgcccggcctttgcggatcctgcgagggcaaccagtgacccgctaccgctccggttgctcgtcaggaggccgatgggttctccgtagcggcagcggcacgagtcatcggagtctcgcgccaggcctacgacgcctggcgacgctggcgcgagcgcggccctgaccccgagcacctggtgctcgcgagcgagcttcgcgccatctggcgcgagagcgacggcacccacgccaagtcccagagtgacccacgagctgcgacacgcggtgagtgcgtcaaccacaagcgagtggaacgcatgatgcgcgagctcgagatagccgcctgcccaccccggcgcttcgtgcgtaccacgacgcctgcagaggacgcacccctcccggacctggtccagcgggacttcgcccctggcgagccagggcgttgctctgcgagcgacatcacctgcgtccgaaccgatgaggggttctgctacctcgccacggtggcagaccttggctcgaggcgcatcgtgggctgctcactccagcatcgcatgcctgatgacctggtggtcgaggcgatctgcggagctcttcggacccggggcagcgtggctggggcgatctttcacagcgatcgcgccaaccagtacctctcccggaaggtttgccagctctgcgcgacgctcgggcttcgccagtcggtgggcagggtcgcgacctcgcgacgacaacgctgtcgccgaggccttcttcggcagcctgaagcgcgagctggtgggtcgctaccgcttcgcgaacctcgccgaggcccgccctgccatcgcgagctggattcagcgctacaacacggtccgcctgcactcgagcctcgggtaccgaccgccaatcgagtacgagctcacctgggcccgtgcggaggcggccgtggcctacattcagactgtcaagcaaatggggggaaggccagcgatctggacccactagtgggtggtcgccactttctcggcgacctcggacagtcgggcctggaccttggacagattttcagccctgacaggattctcggtactcacatgcagaccaggtctcatgtcggcactatcaccgcgacgccgtactgggaggccgccgccgccatacggttgtcgtaggtgacgatgccgtcgagctcgtcacccagttccagagctgcggcaagatggagcgcgtccagactccgcaactcttcggggtcaagggtggccgcccgttcgagcgtggcagaggtgaggttgaacaaggtgagagcgtcaagtactgatcgagcgcgctgcatccgatcgggggccgcgcgccgggtcgcccgaaggagctcggtgcgcagcaagtcactggcaatcacctgggtttcgtggctggccgcccacgatgccatggcttctgacgccggttcggcgacaacgagcttggccgccgccgacgtgtcgaggtagaagaccatcagtagcgctccccgccacgcatggccgctacgacctccgacagcctgggctgctccgcacccgcgtcgggaggcgcgccgagagctgcgagcgagcccttcgccggccgagcccgacccgacgcgacgaaggcagcgactcgcccctccgggaccggaacgagctgggcgaccggtcttccccggtcagtgatggtcaccacctcgccggcggcggctctggccaccacctgcgaggcgttctgcttgagggcgcggatgcctaccgtactcatgttctacattgtagcactctgtcgctgaccgctccagggatcgatgtgctcccaggcgtgttgaaccgccccgggtttcgtgcacacttcgttatgtgtgaacggtctcggactcggccgccaggcggccatagtactcctgctcgacctcgacgggtggacggcgccccagccggtgcatgagcctccgcgtgtcgtaccagttcacccaggctgaggtcatctccttgagctccctgcgcagcctgatgagctcggtgcgctcctgcgccgtgaggggcgggctgccagtggcgctcgctgcctcgatccgcctgcgctcctcccgcacccatcgaaagatggctgtactccccgatcgcgagctcccgggccacctccccggcacgctccggccgctatcgataacccggtgggccgcctcgatgcggtactccagggtgaactgaccttctcccctccttctgacatcgtacgtgtgacgaacgacgtgtctacggaatctggggcggctcagacgtcggatctcacagtgagggtggactcggtgtggggggacggtcagagcgaatcagcgcacagcgcaagcgcaagctctctggggcgaggctgcgctaccgaggactcgtgcgcaaccgcctgcacttcgagctgctctgtgcgacctggaacctgagggtgctcccgcgtctcgggctcacccgagtaggtggcggctgggtgcttgccacctgagaggcgctcgggcccctcccctccttgcctccgaaggaggggacgaagagaagagggtgaggagctgggcgagcacgggtcagctggatccgttctctggcagggttggtgccctcagccaccacccgggaggggcttggtggggaggctgctagttcgcatcgttcagccgcaccaccacccaatcgcgcttgccgcgacgcagggtcagatggccatcggtgagatccgcctgcgacacacgctgaccctcgagtgctcgacgtccgtcgacatagaggcccccttgtgcgatgaggcgtcgtgcctcggaccgactcctcgcgagccctgctgcaagggcgagatcgatcacatcgatgccgtcgccaaacgccgcgcgctcgagggtgacgacgggcgcacccgcctccgcacgtccaccctcgaagagcgcacgagcggcctctgcagcctgatcggcagccgcctccccatgcacgaagcgcaccacttcccacgcgaggcgccgatgggcgatgcgccgagagggatcgtcctcgtgggcagttcggagcgcagcgatctcatcgaaagagagaaaggtgtagagggccacgtactccatgactttctggtcctcagcccgaacgaagaactgatagagctcgtacggcgacgtgcggtcttcgtcaagccagacgttaccccccatcgacttgccgaacttggtcccgtcggccttcgtcacgagcggccacgtgaggccgtggacctcgtgcccgtcgagacgtcgcacgagatcgatcccggcggcgatgttgccccactgatcggacccgccgagttgaagcgtgcacccgtagcggcggtggagctctacgaagtccaccgcctggaggatcatgtagctgaactcggtgaacgacaggccctcaccgccgaggcgcgtacggatcgactcgcgcgccagcattgcagagaccggcacgtgcttgccgatgtcacgcaagaacccgatcagggtgagcggctcgagccacgttcgattgtcctcgagcgtcacggcccccggcaccacgtcgccgaggagtcgttggagctgaccggcgatgcgggccgtgttgtgtcgcagtgtcgccggatccagcaagacccgctcgctcgagcgacccgagggatcaccgatcatgccggttgcgccgcccgcaacgaggatcgcccgatgacccgcatcgatcagtcggcgcgccagcacgattccgagcaggttgcccacgtgcagtgagtcggcggttggatcgaagccgatgtagaagacccgtggcccggcatcgaggagctgctcgagtggcgccgacgcatcttgaaccgcgccacgccacctgagctcctcagcgagcgacacttgatccccctgtcacgaccgtccggcagcctggtagagcctatcgagctcggcgttggtcgcctcgcgagtcgtgcccacgcgggccacgacgaacgcgcccgctcgggcgcgcgagagggccgtcttgacagaggccgcatccttgagcgtcatcacctcatggccgaggccttcgaggatgcgtcctggcgagtaccgtggcggcgtcacgaagaaggagcgctgcgtcgtggggtcgagcaagcgcgccggagcgacgcggtcgaagatgacgcctccttggttctcgagcaccacgaccagccctcgctcgggcaacggcagttgccacaaggccgagagtccgtagagcgcggtgaggtccccgacgacgaggacactgagcgctctcgacgcgtgggcgacgccgagccaggtggcgagggtgccgtcgatgccgttcagacctcggttcgcgaggacccggacgccagcaggggcgcgaccgccgaagacctcgaggtggcgaatgggcagcgacgacgcgacgacgagcgactctccgtcgtgcagtccctggaggacgacccgggcgagggcgacttcgccagtgggcccatccgcgaccacctgctcgagcgtcgccgcgatggtgcgatcgcgctcacacaacccacacggctcgcccgcgtggccgcccggcacggtcagcagcgcacgccgcagggcgtcgccgacgtcggcgaccaccgccgtcgtggcgaggcgcgctggatcgcgccagcgcgatcggctctggatccacgccacagggatgccccgtcgtgccgcaacggcgatgcgctcggcgaccacacgcgaggcgtgtggggcgccgaggacgaggacaacctctggggaggcgtcggggagtgagcgcaggacgagctcggggtgctcgaggacccacgggccgcgctcgacgccagcgagcggatcggccagcacgggccagcccaggtgcgcggcgacgctggcgagggcatcgacatcgatcgtgtcgtcctcaccgacgacgagccagcctcgacgctgaggatcgaaccactgcgcgagccatgcatccgccaggctgggacgactcgggatcgtcaccgagcgcggatgccaaggtccgatccgaacctcctcgtcgacgagaagcggttcggcgatcgcaagattcagcacgcacggcccagggccgaacggcgcggcaaccgtgcgcacgaggagctcgtgcgcgacgccagcgagctgctcggcgtccacgacgtcggagagctccagatcgatgacgctggccaccgacgcgagcgtctgggcctgctcgaccgtttgtgcagcgcccacgccatgggcccagcggggccggtccgccacgatcgccacgagcgcgacgcccgcctcgcgagcctcggcgagcgcgggaacgagctccagcgcagcggtcccgctcgtcgtgacgaccgccaccggtcgacggagtgccttcgcccacccgagcgcgaagaaggcagcttcgcgctcgtcgaggccgacgacgaccgacgcatcgctcgcactcagcgctgccgcgatcggcgtcgaccgactccctgggcagagcaccgcgcccgcgagcccaccgagggtaagggcctcgacgagcaccgtacactgagcaacgctgcgtccaaggagagacgatgaccaacgctcgtgcacgcaacctcctcggaccgaccggtgctgtcgtcgaggtcacgagcaccggcggacccgagcgacgcgccgtcgtgctccacggcttcactcagtcgcgctggagcctcatcggcacgctgcttcccgtcgccgagggcattgccagcgagatcgtgttcctcgacgccccaggtcacggcgccaacctagggccctccagtgtacgggcgttcctcgacgccgttgcggagctcgacccagacatcgtcatcggctactcgatgggtggtcgcctcgccctctggctggccgcggtgcaccccgagctcgaggcggaggtcatcgccttctccgcgcatcccggcatcgaagccgccgatgcccgcgccgaacggcgccgccgagacgaggccctcgcagaccgactcgaccagctcgctcgaccacgagccctcggtgccgatgcgagcaacgtcgacgccttcctcgacgagtgggactcccagccgctcttcgcgcgccgccggctgagcgagcggcgacgcaggggccgggccctggccgatccgagcgggtgggcccacgccttgcgtgcctacggcacgggcagccagcccgacctcaccgaggcgctcgctcactcacgagcgcgcctcgcactcgtcgtcggcacgcgcgacacggcctacgtcgcgcacgcagcgcgcctcaggcaccgtgcgcacatcgtgaccgtgcccaacgtgggccacgacgtgctcgccgaggcgcccgagatcgcccaagggatcgtgctcggactcctcgccgcccggcgcgcaccgacgtcggctccctaagccgcgagccacgctgccagcgcaaaggcgaggccgagcacgagggtcagccgcccggttgcagccagcgaagcgacgagcggacggcccttggcaccgccaacgaccggcgcgatcgcgctcggagccgcgacgagcccgaccacggctaccgcggccaccgcaaccagccgatcggtggcgagccaggttgcgagcgccacggcaacgacggaggccgccacgagcgtcacgaagagcgcgcgagtcgtcgactcgccgagccgcacggccagggtgtgcttgcccgcgagacggtccccgtcgacgtcacgcacgttgttgaccatgaggatggcgctgatcgcaagcccgagtccgatcgccaggatccagccatcagccgggagcgcgtggacctggatccacaacgtcccgagcgtggcgagcagcccgaagtacgcgaaggcaaacagctcaccgagacctgcgtagccatagggtcgtggtccgccggtgtagaaccaggctgcagcgatcgcactcgcgccgatcacgagcagccaccagctcgtctcggctgcgacgaccaccccggccgccgcggcgacggcgaacgaccccagggcggccgcacgaacgtgcgcggggctcgcgagcccctggccgaccaggcgaaccggtccgacccgagcctgatcggtaccgcggataccatcggagtagtcgtttgcgtagttgaccccgacctggagcgcgagcgcgaccaccgccgcaaggatcgcgcgcagcacgacggcgtgatggagatgggccgcgaggccggtcgcagccagtaccggagcgaccgatgccggcagtgttctcggccgagctccagcaatccacgcgcctacctgcgccatcgttcctcccttcgcaccatgccagtctacggaaggttcggccctaccatgagagatcatgtcgtcgccgtccaacgtaggtcgacgcctcgtcgcgctccccgcccgtcaggacgcctggctcgtggatgccatcgcgaccgcgtgggaacgtggcgaggccgtgtgtgtcgtcgacgtctcgtcgccgatggttcgccaacgcctcgacgcgctcggcgcccacgtgcttcgcctcgagtcgtcggagatcacgctcgacccgtcggcgccacccctccatgacgacgcctggatcgtgcaggtcacctccgggacgaccggcgcaccgaaggccgtggtcctcaccgagtccaacgttcgggcctcggcccatgccgtaggtgaacggctcggcatctcgagccacgaccactggaccaccgcgctctcgcccgcgttcatcggcggactcgccaccatcgcccgcgccatcgtcgcgggcgtgccgatcacgctactcgcacgtcaccgacccgagcacttcgcccgtgccgtcgccgctggtgcaacgttgaccacaaccgtggcgagcgccctgctcgagatcgatacccgtccgttccgggccgtcatcctcggcgcccagcccgccaccggcaacctggcccccaacatgcacacgagctacggcatgaccgagaccggctccggcgtggtgtacgacggcgtcgcgttaccgggcgtcgaggcgaggctcgtcgacggcttgatcgaactccgcggacccatgattgcgcagacctaccgcactggcgccccgatcctcggccccgatggatggctcgcgaccggtgatgtgggcgtgctccgagcagggcggctcgaggtccttggacgagccggcgacctcatcaactctggcggccaccacgtgccccctgacccggtcgaggccgtccttcgccgcaccctcgcagaccgcgtcgtcgatctcgcggtgtacgcgacggccgacgatcgactcggagagaccgtgaccctggccgtggtcgccgagcgcccaccgagcccagctgatctgcggaggtcgctcgaaggtctcatcgagaccccatggatcccgcggcgagtcgtcgcggtcacgtcgatcccgaggacggaaaccggcaagccactgcgcagactgttgcctggcgcagtggctcgcacaccacaagcgtccacgaccgacggctccgccgcgtcgatcgccgcggtctcctagtcgacgagcggttctggcgcctcgccgacgtcgtcgaggtgcaccacccgctcctccgggctcggcatgcggaagtagggccggcctttggcccagtaaatggcgatagggatgatgccgagcgcgatggccccgataccgaccaccttcgtcgtggtattgagccctgggaggctctgctcgaacatcaccgccatgaagatcgctccagcgagcggccagagtccggcgaagatgaaatacgagagcttcgtgaacaggagcttgcggtacaagatcaccaccgagaaccctgcaaggccgtagtacacggcgatctggagaccgattgcgttgatggcgtccgacaagacggtaccgacggagccgacgtagttcgacgcgatgagcagcccgaccgagacgacggcaacgacgagcgtggcggccacgggcgtgagccgcgtccgatgcgtacgaccgaggatcgagggcatcgtgccgtcacggcccatggcgaacaacgtgcgtgacacctggatgatcgtcgtctcgagcgtcgcgatcgtcgagagcgcgacggcgacgacgatcagcttgcccccgatcccgggccagaccacctgcccgagcgcatccaggacgtcaccggcgttctggctgatctgatggcccgtgagcaccatgttggtgccgatggtgaacacctcgaacaagatgaacaccacgatgacgccgttgatggccccgagacccggggtgacccgcgatcccttggtctcttcgttgaggttggccgtaacgtcccacccccagtagtagaacgccgccaccagggcacccgcgaagaaccctgccgaaccgtggaagatcgacggggagaaccagtgccagctgaagctcaccaccttggggctgtgcaccagcatcaagatcgcaaagagcaccaagatcgcaagttcgatcgtggacatcgcgacctggagcttggccgtgatggtcaccccagcgatgaccgcaccgaccatgatcaagaacacgacgatgccgaggaacgtcacccacccggtcgagttcgcgagccgctgcgagaacaggccgaggatggtcgatcccgccgggaccgaacctgcaaccatgaagatgagcgccgacaccacgaggcaccagccggcgatgtagccgagcacgggatggagcgcacgtcgcacccacgcgtacgtcgcgcctgcgttcgcctccgatcgcccgaggtagttgaacgcccagacgataccgaacatggcgattccgcagtagagcagggccgccggccctccgagcgccacggcgccgatcagggtcgccgtcgatgctgcgatggagtaggcgggggcgacgcctgcgacccccatgaccgacgagtcgaagagcgagagggcacctcgccgcaggcgatggtggtcccgactgttggcgtgctccagtgaatccatacctcccccttctcgagtccgacgccgaggctccccgaggttccggcgttactcgattcgcggggaattctacgctcgaccatcgaaatcggcaaggatttcacgaattacgcacgaattcgcaacaatcacggccccccgagccgaccgatcgtcagcgtcccgccgtcgacgacgaggttggcccccgtgatccagcgcgcctcgtcggagacgaggaacgcgaccgccgccgcgacgtcggcgggctcaccgatccgccgtgccggcaacgagcgagccagctgcgcctcgagcgcatctacgaggaccgccgcaaaggatgtgcgcaccaggcccggcgagaccgcgttgacgcgcaccggtgcaagctccgtggcgagctggcgggtgagatggatcaacgccgccttggagacgttgtagagcccgatgccgggctcgggctcgagccccccgacgctcgcgatgttcacgatcgccttgtcgtcaccaggcgcgctcgcgaaccgagcggcgagcaatgcgggggcacggacgttgaccgcccagacgaggtccatcgcttccggctccatctgggcgatcggaccgaacgtcgggctcgccgcagcattgttgacgaggaccgacaccgacccgaacgcagcgacggctcgctcgaccacgatggtggcgacctcgggatcgcgcaggtttgccgccacggtggtcaccgcgacgccaccggcgcgcaggtccttctcgaggctcgcgagctcctcctcgcggcgcgcgaccccgacgatcggatagcccttcgctccgagcgtctcggccacgctgcgaccgatcccgcgcgttgccccggtgatgatggcggcacctcgatgcatgtccccacgctatcggtcacgccgagcgctagcctggcatcagtcggcaccacgagggaggcgccggtggggaatcgccttgccaccagcgacagcctgtatctgcgcgatcatgccgacgatccggtcgactggtggccctggtcgagcgactcgctggcgacagctgctcggctcggtcggccgctgttcgtgtcgatcggctacgccgcatgccactggtgtcacgtcatggccgagaccacgttccgcgatcccgcggtcgcagcgctcatcaacgagcacttcctccccgtgaaggtcgaccgtgaggagctccccgacatcgatgctcgcttcatggcggccgcgctcgcgatcaacggcagcggtggatggccgctcaccgccgttgccacgtcggatgggagacctgcctgggtcgcgacctacctcccgccacgctcgacgagtaacctgcccggcctgatcgagacgctcaccacgatcctggacgcgatcgcacgcgacccccgcgcgctcgagcgtgctgccgacgaactcacgcgcgcacgcctcgagcctcgcagtcggcgaccaactgcgccaccgaccgacgagatcacgatgcgcctgcggacggacctcgcacgtcagctcgatcggtccgagggtggcttcggaacggcaccgaagttcccacaggctcacgcactcctcgccctctgggagctcgtgcgcaccggggatggcgtcgagacagtccgcgtgcgagagctcgtcctcgcgagcgtgcgccgctacgccgagagcggtctcgtcgaccacctcgacggaggcatctttcgctacgccgtcgatcgcccgatggtggacgtgcactacgagaagatgctcgtcgaccaagcctggttcatcctgctcctcgcggtgatcggtcccgatcgcgaggatctcgacctgtacttcacgctcgagcgcacgatcgccttcgttcgacgagcgctcgtacgcttcgacggcctgctcgcaacctcgctcgacgccgacgcccacggagtggaagggggcgcctacctcctgcgcgccgaggaggtccgtgccgtgctcggcgacgaggccgcctgggtaatcgacgagcttcacctacctcccgatcgcccccaccacggccaccggatcggcgcttcgacgctccgattggaagggaacgcactcacccgcttcgatgcgctcgccgcatggcggcgcgggcgcggcagtgcgcgacgcgacgacaaggccttgtgcgaccacaacgccgccgtcgcgaccgcactcctcgtcgccggtcggcgctcgggacgcgacgagtggatcgtctggggtctcggcctcgcgcgtcgcgtgcatgcgacgttcgtcgatgcgagcggcgcccgtcacgtcgcctacggcggcgaggcccgcggagcaacgagctccgacgagctgtgggtctcgatcatggccctcgccgcatgggaggtcacgggcgcgactgcttggctcgagcgcgcgcgcacgagcgccagtcgcctcgtcgaacggttcctcctcccagggctcggcatggtcgtctcgagcacggagcctggtgaggccgtccccgaccgcctcgacggcgcccacccgtccgtgagctcactcgccctgtggcacctcacgcggctcgtcgcggtgagcgcggacgaccgcctcgcccacgcacgcagccagctcgccgatgcgctcgccgatgtcctggaggccgcgccggccgcagctgccctcggcgccctggcgatgggacacaccgaccgcgtgcgcaccgtcgtcgtcgcgacccccaacctcaccgaactcgcccgtgtcgccctcgccgctgctcgtccgctcgacgtcgtcgtccgcgatccgacccacccactcgcgaccggagcggctggcgaccgggccgaggtgtgtgttgctcacgcctgcctgctcccgacgagcgatccacgcgtcctggctgacgcgctctggtccacgctcccgtgatgcgcaccgaagcccagctcggccgcgagcggtctcgtccacggagcggccaacccgagctgtgacgccggccgagcctcgacgaccaccgttcagcacgccgactcgacgacctccggcggcaccatcacgtcggcatcacgacccagtacggagccccccagagcaccgtcgactcgccgccgccatcgcgcaccagctagcctgaggtccaccacagtgacctgcggaggagggcgcgtgcatcgttggccgccggtggaagcctgagatgtccacaccgtttcgacatgtgctcctcgggacactcgacgtgcctggccacgaacgcgagttcatcatcctcgaccgggccgaactgcgcctcatccgcgtgatcgcacagcgctcgggcgagctgacgaacttcggctacgtcgtcctcgagcacgagcacgcacccgacgaggcagatccggctcgccccgatctgcgtatcgccgccgaggtctccccgaccgagcaggtcgccaagcgtcgccacctcgtctcgtggctggaacgcctgagcgcgagcgagcgcctcgccccacttgggcacccgggccccagcgtgccgtacgcccgcttcgatgggacccgcccctcgctcgcggtcgtggccctgcgcgatcccacgcttgggcgcggacgcaacgacgaggccgtcctcgagttctcctggggatcccttcgtcagctgatgccggtgaccaaggagctcgaggcgcgactcggtggcgggccgaccattacgcatcgcaagggttggcagcatgcgttcggacgcgtgccgcgcttcgcgctcgccgcctacacgccgccggatcacggctactgccgcaagctcatcgtcacgctggtgtgacgagcggtgaacggagaacggagaggcctatgacccgcataccagagtggttcggccgcctggaccccgaccccaacgcgcccgacgatgtccgcgcgcgcaacgacgccgtcgccgaacggaccggctttctcccgacgatctttggcgccctctcgtggcggccggaggagtatcgagccttcttcggctaccacgatgcgctcatggaggtcccgagcggtctcacgaaggctgagcgcgagctcatcgtggtcgcgacgtcggcgggcaaccactgcctctactgcgtcatcgctcacggcgccattcttcgtattcgggcacacgaccccaccatcgccgaccgggtcgtcgtcgatccagagcgcgcagacctcgacgaacgatcactcgccatcgtgcgctttgccttcaaggtgcgcgacgaagccaacgcgatcacgcccgaggacttcgcgccgctctacgaggttgggctcgatgacaccgacatctggctcgttggggcgatcaccgcgttcttcgctctctccaatcgtctcgccggcttcgcgaagatcctcccgaattccgagttctatgccatgggacgtacgccgcgaagctcatagcgcagcgaagtggcgtcccaccacgtcgtgcactttccgggcgccacgaaccccaagagggcgggccaccgggcgatcgctggcgtgtcagccaacagcgagccagaggagccacgcgagtggccccgacccgttccgactgtacccgcgtgctctggcaccatcagggcaggcgatgacatcgacgtcatccgagaggaggtccagctcgtcctccaagccctcatcgagcaggaggcagcagcagtcatcggcgctcgccgcgaaaacgagacgagggacgccagatgcagcgccacggtgagcgcagaccgtctgctcatcaccaaggccggcacgtggagctgcgtatccgcacggctccgccagaagagcgtgtcccgagcatcggcgagcgctggcgcctgtgtcgatcgtgccctcgacgccttggtcatggaggcctgcgtctgagggcgtcagcacccgcacggtcgatgacctggtcgcggccctcggtgggacgggggtcacaaggagcgaggtctctcgcatcgtcgcaacctcagacgaggagctggcggggttccgtcgccgcaggctggaccatcgctgcgttctgctccctcctcgccgatgccaccgacgcgaagggccgccttgcccaccgggtcatctcccgcgccgtggtgaccatcacgggcgtgcatgccacctgagacgcacgaggtcctcggggtcgtgcgtcggggacgggcagaccgagagcttctcgcccgagtactcgagggagctcaggggtcctgaggcctcggtggtgtgtgcctcgtcatctccgatgtgcgagcgcgggctcaccaccgccatcgcgaggtgcttcatcgggacgagctggcacaggtgccggatgcagcgtgcgcgacgtgctcgctcgcatcgaggaaggggagcctgggagacatgaacctcgcctcagatccgcacgatcgtcgctcgagccttcctcggcagcgctccgtacccaggacgaccaggtcatcgactcccttgccctcgaagctccccgcggttgtgaccgtgctcgccgaggccaaggaggaggtcgctcaccttctgagagcttctcggagggttgctggggaacgatctggtcgacgaacccgctcagagcgagtgaaccatgagatcaagcggcgcaccaacgtcgtcggggacttcggcaacgacgctgctctcctgaggctcgtcaccgctgtcgtgctcgagcagcacgaggactgggccgttgccgagcgacacggccgctaacaggagtgaatggcagagctcggggctgcaacgagccgcgacgacgacacggcgggcacctcgccgacgcttggggcccctggcgctccttgcgtgctggcgtcgctcgccgaggcggcacctgctgtgagaggaggaccagggagtgaactgacaccactcggtgggacgtgatctcgttgcccgagaacctcagaaccgctggcgggccagcgcccagtacggcgccgggcgatccggggtaagacttcccccctcggccagcctccgtggatctgctctggcatgtcgagctccccgcgctctgtgtggtctgccttacgtgtccatgctgatcagagtcctcgcacggcgggtgggctcgatggggcggccagcctgagtggttgcgattctggcgatttctacgattctggcgatttctacgattcttgcgattcttgcgattcttgcgattcttgcgatttctgctacagtgttgtcgtggtgtcaaccaaccaagtcggcaacgaagcctcgaccactctcatgcaccccaggccgggcgaagacgtcgtcctgccccccacggacctcggcccgctcgtccacctggctcggttcctggaagctcacaccgaaccagcgatgctccgtggtccagacggcgagaacatcccactaccacctgaggtctacacggtcttgcgccaggtggtcgaggtcatgcgacagggtaaggctgccctcatcgccccccaaggactactcctcaccacacaggaagcagcggatttcctcggcatcagtcggcctaccctcgtccgactcctagaggaaggggccataccgttcgagaagccgaaccgtcaccgccgcatccgcctcgaacacctcgtcgacttccagcatcgtcgctcgacagatcgtcgcgcggtcctcgaccaactcacggagcaagccagcgagctggggctctacgaggagacggaggccacctacgccaaggcgctgagggaggctcgtcggagcctggccaggaagaagatcgcggactgacgtcgtggctcgctacgcggtggtcttggacgcgtgcgtcctcgtgccggttacgctcgccgacactctccttcggctcgcagagctcgggctctatcggccactctggtccaagcggatcctcgcggaggccaccaaggccaccgtcgaggtccaccccaacatccctcgggaggtcctcgagcagcggttccgcgagatcgagcgcgcattcgaggatgcttgcgtccggggctggcatccgctcgagcacggcttgaccctccccgacccggacgaccgccacgtcgtcgcagctgcgcttgccggcggagcagacgccatcgtcacgaggaacctccgcgactacccgaggggcgccctcgccgatctcacgatcgaagtcactcaccccgatgacttcctcctcgaccaactcgacctcgcgccgaaggcagtacttgacgccatcgagcagcaggctgccaacacgcggcagccctcgctcacgccacgcgatgtcatcgcccgactggcccgctgcggtgtgcccaccttcgccgacaagatcggccgaatgatctgaccgaccggcacccgaaaccgagtccaccttcactgtcgaaccgacattctcacacgaccgctcactggtcccgctccgcttccgtgacgcagagcgcgccggacttctgacacctggtcaataccgcgcaagtccgtcgccgtccgcgacgtcatgctgattcagacaaaccagctcgagccacctcggacgtgaggcctcagtcgaatgagtgctcgagccgggctgcgcctcacgcggcacgcgggtcgtactgtgagccattggtcactcacgcaccgtcgagcgctcatgtctggcgcgacgagccctcgtgcgcgcccgcatcgctttgcaacggacctgcctaggagcgtcccgagcgagatccacgtggtcgtcgatcagcgccgacggatcgtcactcgccgctgcaagccgaacgatgggcaatccgagccgttcgaggcgtcttcgccgctcacgacaagccatccgctcacgccccggagacgtgctctctggtgagtcggcccctaggtgcaaccgaagcccaccacgcgcatgacagccgccaactcccggcgggaggcttcgagtccgtcaggccgtctcgagagcattgccgatacactggcgcggaccagtcggcgcaccgttaacccggccacccgcggcgacggacgacacgatcgccagcaggctcgtaccggtcaatcgagcgcacacgccactcgacctctcccagcggcccctctcaacaccgcgacgacagcgacgaaggccagcaatcgctcccctcccagcacgacgggagctaccagcgacgacgaccccacaacgacgagcgcccgagccgcggcaggatgcgaaacgccatccaccccatccaggcgaacgcaacgaccatgaggagcatcggtcgcaccatccatggtgccgttccaatgaacagcacggcggcatacaccaggagcaccgtcctgagaacgtgcgtccgatggcgacgctgcacccgtacgggagcttccgcagccacggggagcgtgcccggagccgtaacggggggaaggaacgggagcgcgtgcggaacgtcggtcacgagtgcgccgagatcacggtaggtccgcgcgacgtggagatgctcgagtcgctcttcgaactccatgggatcgagccggccctcttgaaacgctgagcgcagcacctcttcgaccgcatcgcggtctgcttgcgaacaccgcacctcgtcgaagtcgctcacgcagccatcgtatcacgaccgctcgtcacgcgtacgagagcccgaaccgaggatctcacggcgacctcacgagacgggccacccgtcacaggcgaggccgcggggcgcaggtagcgtggtgccgtgcgctcgttcgtccacctccacactcacaccgagtactccatgctcgacggcgcgtcgcgcatcaacgatctcctgcgtgccgcagccgccgacggccagcccgccctcgcgatcaccgaccacggcaacctctacggtgcgctcgagttctacaaggccgccacacgcaccggcgtgcgccccatcatcggcctcgaggcctacatggcggggggctcccggttcgagcgcccgcaacgtcgcggacgcctcgacgacacgggcggcgagagcgagcgaggtgagaagctctactaccacctcacgctgctcgcggagaacgagaccggttaccacaacctcatccagctctcctcgcgtgcgttcctcgagggctactactacaagccccgcatcgacttcgagctcctcgaggagcaccgcgagggactcatcgcgctcaccgggtgtctcggtgggctcgtcctccagcacctccttcgcggcgacgaggagggagcgcgcacggtcgccggaacgctgcgcgagatcctcggcccggacaacgtcttcgtcgagctccaagatcacgggctggccgaacagcgccgaaccaacccccaactcctcgagctcgccaagcacctcgggctgcggaccgtggccaccaacgactcccactacacgcaccgcgaggaccacgagacccacgatgcgctgctgtgcgtccagaccggcgcgaccatcaacgaccagaatcgcttccgcttcgagggatcggagcactacctcaagagcgccgaggagatgcgtgagcgcttccgcgaggtgcccgaggcctgtgacgcgaccctcgacatcgccgagcgctgctcgttggagctgacctttggccagccggcgcttcccgagatcgacatcccggtccggatcacgggtgcgacctacgacgagcgcgcaggtgagtacctcgccgagctggtctggcagggcgcgcgggcgcgctacggcaacgatctcgacgagaccacgagcgagcggattcgctacgagctctccgtgatcgagtccatgggctttccgggctacttcctcgtggtctgggacctgatccgtcatgcccgcgaggctcacattcgcgtcggcccgggacgaggtagcgcggcgggcagcgtggtcgcttactgcctcgggatcacccagatcgatccgctcgcctacgacctcatcttcgagcgcttcctcaacccaggccgcaagcagatgcccgacatcgacatggacttcgacgagcgctaccgaggcgagatgatccgctacgcggccgagcgctacgggcatgatcacgtcgcccagatcgtgacgttctccaccatcaaggctcgagctgccgtacgcgacgccgcacgggtccttggctacccgtacgccgtcggcgacaagatcgccaaggcgatgccgccgctcgtcatgggacgagacacgccgcttgctgcctgcctcgagctcacgcccggccacgaggacggctacgctcaagcggcggcccttcgcgagatggtcgagagcgatccggacgtggcgcgggtcgtccaggtcgccaagggcctcgaaggcctgcggcgtcaggacggcatccatgcagccgcggtggtgatctcgcgtgacccgctgacggagtacctgcccatccaacgcaagcccgatccaggccaggatccatccgaggcacccatcgtcacgcagttcgagatgcatggcgtggaggaactcggcctcctgaagatggatttcctcgggctgaggaccctctcggtcatcgatcgcgccgtggagctgatccgggcgacgcggggcgtcgacctcgacatcgacgccatcgccctcgacgacgaggccaccttcgcgatgctgcgcgcgggtgacgccatcggtgtcttccagctcgaaggcgggccgatgcgccagctcatgcgccagctcgccccgagccgcttcgaggacgtggccgcgctcgtggccctctaccgtcccggcccgatggcggccaacatgcacgtcgactatgccgaccgcaagaacggccgcaagccggtgagctacctgcacccagacctcgagccggtgctccgcgacacctacggcctcatgatctaccaagagtcgatgatgcgcgtcgctcagcagatcgcgggctactccctcgaggaagccgacaacttgcgcaaggcctgcggcaagaagatccggaccctcatcgccgccgaacgcgagaagttcatcgccggttgcgtcgcgagcggctacggacccgaacttggtaccgcactcttcgacatcatcgagccctttgcggactacgccttcaacaagagccacgccttcggctacgggctcgtcagctatcagacggcctacctgaaggccaacttccccgtccagttcctcgcggccatcttgacgagtgtgcgcgacgacaaggacaagttggccgtctacctcgccgacgccgcagcccaccacatcgcggtcctcgtgcccgacgtcaacgcctccgacgtcgacttcagcgtcacgagcggtcctgagggcgagcagatccgtttcggccttgctgccgtgcgcaacgtcggggagggcctcgtgcgctcgatcatcgacgagcgcacgcgaagcggtccgttcacgagctttgccgacttcttgctgcgggtcgatgcgagcgtcctgaaccgccgcaccttagagtcgctcatcaaggccggggccttcgactcgttcggacacccacggcgggccctctacgaagcgctcgagggcgcgctcgaacgggtcaacgagcggcgccgccagcgcgaccgaggcctcgggtccctcttcgaagagccctccgaggacgagagcgtcgtcccggatctgcgcctcgacatcggttcggtggagtggagcacgccagagctcctcgccttcgagcgcgacatgctcgggctctacgtctccgcgcacccgatgcacggcgtcaacgtcgaccggctcggacgggacgtcacccccatcttggatctcatcgaggccgatacgcctcccggcgaaccggtgacggtcgtcggggcgatcacagcgctcgcgcaacggacgacgcgcaagggcgacctcatggccaccttgcggctcgaagacctgcaagctgggatcgaggtcatggtgttcccgaagaccatggcagatcacgggctgcacctgaagcaggatgccatcgtcgcgatcaccggccgtatcgacggccgcgaagacggccgcacgctggtcgcgctcgccatcgagcccgtcgatacggccgcgctcaccagtgacgacgcggcggacggcgccactgacgcggtggtgctgcgactgcccaagcgcctcgccgtcccagattcgctcgttcgactgcgtaacgtgctcgcggatcacgtcggcacggcgcgtgcggtcctcgacatcgaaggcatgcgcttcgagctcgccagcaccagcgtccgccccggatcgagcctggtggggcacctgcgcaacgtgttcggagatcaggtccgtgtcgactgacggcccacgcatcgccctggtgggatcgggcgagtacctcccggcgatggcgcccctcgaagcgtcgctcatcggtcggggtcgcaactacgtccagattccgctcgcggctggccaagagagcgatgaacgcttcgcctactgggtcgacctcggacgtgagcaggccgcgcgcctcggcgtcacggcgcacacggtcctcgcacgctcccgagccgacgccgacgaccctcgctgggcacgtctcgtcgccggtgccgatctcgtctacctctcggggggcaacccattccacctcgccagcagccttcgcggaagccggttgtggtcggcgatcgtcgacgcgctcggtcgcggtgtggcgctggcgggctgctcagccggggcgatggtgctcggcggcctcatcggatcgctgcgctcacccacgcagcacgccgagcccgggctcggtgtgctgccggggaccagcattctgccccacttcgatcgagctcggcattggatgccgaccgagctgggggccgtcgccggcgccgaacgaacgatcggcatcgacgaactcaccgcgctcgtcggcgagggcacgacgtttcgtccctggggaaccgggcgctgctgggtcgtcgaggggacctcgacgacaccgatctccgacgccatcgacctgcccgtcgtcatccccgccacgtagccgcggacgaatcgctcagtggtggaaggactcccgcacggtcggatgcactggcggcggggtcccgtggcgctcgagcacctcgacacactcggcgaggtcatcgaggaacagcgttgccatgtccgcggagaactcgctgcgcaccacggcgcgcatcaccgtgacgtcgctcatcgcatcaggcatgggataggccggcacctgccacccataagcgcgcagctcgtgtgagaggtgattgaggtcccacggtcgcacctcacctggccgcagacgccacgccacgacagggatgtcacgcccgtcgccgatcacctcgaacggtccgagcgatgccagctcgtcggcgatcatgcgagcgactcgttgggcactcgcgtgcacggcggtgaagccctcgcggcccagtcgcaagaaggtgtagtactgcaggagcacctgcgcccccgggcgagagaagttcagcgccagcgtcggcatgtcaccgccgagataggcgacacgaaagatcagctcttcgggaacgtccgtcgcttggcgccatacgacccagccgagtccgggatagacgagcccgaacttgtggcccgatgcgttgatcgagacgactcgcggtaggcggaagtcccagtcgagctgtggctcgaggaacggcgcgacaaacccgcccgaggcgccgtcgacgtggatcgggatgtcgagacccgtacgctcgtagagctcgtcgagggcacgcgcgatctcggcgaccggctcgtagacccccgtgtacgtcacgccaaggatcggcacgacaccgatcgtgcgctcgtccaccgccgcgagtaccccgtcggcgtccagcgtcgggtgctcgggcgtgaccggaacgtaacgaggctcgacctcgaagtagttagcgaacttctcccacaccacctgcacggcggagctcacgacgatgttcggccgatccgtcggcgcccccgtggcgcgacgggcgatctgccaacgccgcttgagcgcgaggcctgcgagcatgcacgcctctgacgaacccgtggtggagacaccgatcgtggtgtcgggatcgggcgcatgccacagatcggcgagcatccgaacacagcgaccctcgatcgctgccgtctgcgggtactcgtccttgtcgatcatgttcttgtcgaccgcctcggcatagagacgatcggcttgcggctccatccacgtggtcacgaaggtcgcaaggttgaggcgcgcgttgccatccatcgcgatctcgtcgtgaatcacctggtaagcgaggtcgggaccgagaccatcgctccgcagccgtgcacgtggtacaccctcggtgagctcgcggacgaagagcggattgatcgggaggtccttcgagaacgtgtgtcgccgtggtgacgagtgccgtcgagccaacctgatcatctccttcggtcatccagcaggcaccgcccggtgctcccgatcacgtgacgtgagaggcgcgagcaacgctggaacccgctgcgaccctagcaagcccgtccggtgccggtcggtcagtgcgtggtcgatggcaggccggaccttcagcatgcgagcgctgcgccctctgcgcgatcgcggcccgcagccacggacggcaccgtgcgagcggccctgtgagcgcggcgcgagtcacgcaccggcgaacatggccgggagccgtcgtcgcgcggcgtgcgagcagcgtggcgagagttcaccgacgacaagccaccgctcacgcctcgtgatcgccgcggcggccatggacgtccgtgacgtcaccgacgtctcatgctcccctcgccagttcggcctggatccgggcaaggacctcggggtcctcgaggccggtgacatcaccggtcgccttgccatcgacgaccagttcggcgagcaggcggcgcacgatcttgcccgatcgagtccgcggcatcgtcgacaggacgtacaccgcgccagggcgcgcgatcggaccgatctcgcgctcgagcgccgcagcacacgtggcctcgtcgacaccggtggcgccggcggcaaccgtcacgaaggcgacggggacctggcccttcagtgcgtcactgaccccgacgactgccgcctcggccacacccggtacgaggaggagcgcactctccatctccatcgtcgagagtcggtgtcccgcgacgttgatgacaccatcgacgcggccgacgacccagacgtggtcatcgtgatcgaggagggcggcgtcggcggtgtcgtagcgttccgcaccgaagcgcgtgaagtactgcgcccgatagcgcgccggatccccccagatcgaccgcgccagcgtcgggaacggcgccgtgagcagcaggtagccgactcggtctcgacccaccgttgcgccttcatcgtcgacgacgtcgaaccgatgaccagggagcgccatcccgcacgacccgggcttggcgggcgtgatgcccacggcactcgaggtccacgccgaaccggtctcggattgtccgtaggtgttgttgatctccacagtgcccgtgccaacgtgctcacgcacccagtgccaggtcgtcgcgtcgagcggctcgccgacgagcgagatcagacgcagcgacgagagatcgtggcgctctgcccagctcgcgcccgctctcgcgagcatgcgcaagaacgtcggggcggtgaagaccttcgtgacgcggtagcgctcgatgatgtcgtaggcgcgatcgggctccggatagtccagcgcaccttcgtaggccagcatcgtcgccccggcggcgaggccaccgacgagctcgaagatcgggaaggtcagccatccggtgtctgcggtgcaccagtacacgtcctccggcccgaggtcgagcgcccactggacgttgtggtaggtcccgatgagaaagcccacgcctgcgtgcacgagccccttgggtttggccgtcgtgcccgaggtgtaaatgatgaagcccggctcgttcgcctcgaccggcaccggctccgctccgtccggatgcgcggcgatgagttcgtcccatgcgtgatcgcgccccggttgcatcgggacctcaccgtcgccgagccgacgcacgacgatgacgttgcgcaccgacggcaaccgatccaggatgccgtccaaggtctccttcaatgggatacgccgcccccggcggtaggtgccgtctgcggtgatcaccaccttggccccggtatcgacgatgcgatcgaacagcgcttgcgccgagaagccagagaagatgatgttgtagatggcgccgatccggtagcacgcgtggaccgcggcgaacgtctcgagcaggttcggcaggaagatcgcgacgacgtcgcccttcgtcacgccgagatcagtgagcgcggccgccatgcgtgcggtctcggaggcgagctcctggtacgtccagctgcgctcggcgccatcctccccgatccaccgaatcgccacgcgctctggctcgcgcctcgcatggcgatcgatgcagttcacgctcacgttcatacgagccccggcaaagaaccgaaatccatcggcaaggctgccctcgagggcgggggcttcgtcgaacccatcgatccactcgaacgtggctgcaaccgaacgccagtagcccccgagatcctcgatcgagcgttcgtagagcgctcggaactcgtcgacgttcgagaccggcagtcgaccagacggtgacagggacggctccaccagttcggcggttcgcaccatcgggggtagctctggcattggctcgctcatgggcagcacctccctcgctccacgctgggcggatgttaccacggcacggcacgcgcggcgaggacccggggcgcgacgcgccgtgcgaggcaggcggccgcggcgaccgctcgtggctcgctggtcgcgaggaactccacgccgagcgaccggtccccacgtcgtacggggatgctcgtggctgcaagcttcgccaggttcgccacgtgcactcgacccacctcggtggtgtcgtcgtccgtcacgacgacctcaccagctctcgtcctcgccccgctcgacccgacggtgctcggtgcaagcagcgcgtcgaactcgccggccacccgacgcacacgcgcgctcgccgctcggaccgcgttctcggcggctacgaatgccgccacgatgccggtcgcgacctcgcgagcggtgcgctcggtctgcgtcgttgcgatcgcctcgagcgcgcgccgtgcctcgacgagcgaccaccacggtgcgcagaacgcgtcgtcgacgtcgatgcattcgaccccgtccgcttccagcgcggaggcggcctcgtcgaggactgcgtcttcgtccgtgcgagcgcgtccgggcgtcacgcggccccagaccccgatccgcgtcggacgccactggccgagcgtgaacggggtgaggagccgtccccgcccctctgggtctcgaagcacatcgatggcccatgcagtctcggacagcgtcgcggcgacgacgccgtcgctcaggcgctcggcgtcaccgagcacccacggtcgcacgtgcacgctcgcgagtccgacgtcggctgctgccacccgcagcgacccgagggcatcggggaccaacgcgagcgggaccgcaccgagtgcgacccggctcaccgcagcgtcgaggacacgggtcgcgcaagactcgtccacgacaccgggatcctcgagagcaggaagcggccccgagcccgtcgtcgaccacacgcgaccgacaacgacggctcccagactccgggccctcgcgacgactccctcgccatctgacagacgagcatcgacgagcacggggacaccagcgagcgggcgagacggcgacggggcgacaccgtcgagcgcacgagcctcctcgagcgccgcgtcgtcgagcgacacagcgatggggtcggggcgttgctcgagggagcgaagctgcgcgcgagaggcaacgacgacctcgctcgcgcagcgacgtcggtggacgaggtcgtcgaggacctcgaagagcacgtgctcgacctatgcgccctgaatcggcgggaggctgccgtcagcaaggccctcggccatcgcccagccgaaggcgatgagcacgtcggcgtcaccctctttgcagcaggtgaacacctcatcgaaacccgtcggcgtcgcgtccgagagacggtagaccacgaaaccgaccggccgctctccgctcaccgcacccgaggtgcggtcgtcaaggccagaatcgagcccaaagcgcttggcgagccgtcgcgaccaggctcgctcctctcctgtcggacgatgcccgggtcgcggaaccacgtcctcaagaccagcaagcaggtcgtagccggtcggggagccgagcttggccgcgacgagcacatcctcgtcagggaacgcgagcagcgcgcgctcgtaggcctcgtggagcagactggccaaggtgaggggctcgtgctccttcggcgtcgtgaccgccagctcgatgagcacgcagggcgtgccgccgatacgttcgagggtgaagagcatcccgccaacgagctgctcatcatcggcggcgagggcacagagcacccacgcttctcgctcggcctccaagaactcaggggtcaaggtcacgccgtgcgctgctgccagcgcaccgagcgcgtgcagctcctcgtccgtcagtgcggtgcaatccttcgtgatcgtctcgatcgccatggcgctcctgctccctcgagtcgacggcccctccagtttacccgccctggcgtcgcggcgagggcgatgccacccgcgccgtaggctgggatcgtggacgactcgatcacgctgcaggcactgggttcatcgcggcagacgtatgcctacgacgaccctgacccatctgtgctcgagaccttcccgacgccacagccctccggcgggctcgtcatccggctcttcgccctcgagttcacgagcctgtgtccggtgaccggccagcccgactatggccagctcgacatcgtctacgtgccggggcctcgttgcgtcgagtcgaagagcctcaagctctacctcatgcgctttcggaaccacggagccttccatgaggcctgcgtcgcgcaggtcgcgcaggatcttgcctccgtcctcgctcctcgctatcttcgggtaatcggccgcttcaacgcgcgcggaggcatcgcgatctggccgctccgtgaggtcgtcgccgaccacgaggacccggctgccctccgagcgctcgtcgatctggacaacggagcgcgtccatgagaggcatcgatcgatcgcgtctcgcactcgccatcgcgggtgcggcggtctacgtgggatccatcgtcctcgccaactggatgctgctccacgtcggcgctccgggcccgggggcacgtgtgctccccgtgggcttcgggctcgaggccccgagtggggtctacgtcgcagcactcgccttcatcgcgcgcgatctcgtccagcgctacgcgggtccgagggtcgccgtcgcggccatcgtcatcggagcggcgctctcagcgctcgtctccacggcgacgctcgcgttcgcatcgggcgcgacgttcctcttgtccgagtcgaccgacttcctgctcttccaaccgctccaacgtcgcacgctccccggcgcggtgttcaccgctggactcgcagcgatcgtggtggactcggtggtgttcctcacgctcgcaggcattccgctccacgctgcgcttccagggcaactgctcggcaagttctggatcgtcctcgtgggcagcgccgccaccatcgggctgcgacgcgtgacccccgcaccgtcgcttcgtcctcgcgccgcgtcatgaaccacctcgaccaccgtcagcgaacgctcggcatcatcgccctcgctggtgcctcggcgatctggggcggcatgtacgtcgcgaccgccgccctcatgcgccagaccccgccactcgtcgtcctcgagctgcgcgaggcgatcgcaggtttgatcctggttccgatcgcatggcgatcagggcggttgcgcatcgctcgcggcgacctcgcccttgcggcagcgatcggcatcgtgggtttcaccgtctcgatcggcctgcagctcgaaggcacgcacatcgctggggccgcactcggttcgctcatcaccgcatcgtcgccggtgctcattgcgctcctcgggagggtctggctgcgggagcgactcccatggcccaagctcgtggcgatcctcgtcgccgtcgggggtgtggcgctcatcgccggccatccgccagggggaccccaggtcgagcccgggatcatcgacctcgcaggggcggccctcgcttgggcgatctacacggtcggatcggcgcacctgacccgccgctacgacgccctcggagtcttggcgatcgcctgcatcgtcggctccgtgacgagcctccccttcgcactggcgtcggccagccacgcagcgcatccgctcccgacgacgctcgtggcgtggctcgaagtcgcctacatctccatcgcaggaatggcgctcgccttcttcctctggaactgggggttcggtcgagtcgatgccgccgtcgggggatccatgctgctcttccagccgctcgtgggcgtcgtcctcggcatcgtactgctcgcagaaccgatcactctcaccctggtgttcggcggcttcctcgtcgtcgccggcgtctcaggagccgtggcgatcgccacaccgagagtccagcttgcgacgaacgcgtcacctgaggcaccccagtcggggattcgcacgtagccgtcaccccgtcaggccccgaccacatgctcgaccgagttcgcgacgctcgcgagaccacgccggagcgggtacggccctggctcggagcacatcgtccttgtcagcgagatcggagccatctcgcacgagcaggacggaacctacggcagccccaggatgacccacgagatgcgactcgtggcggctgcttcttcaaccaccagtgcccgtgaccggccctgcgaccgagtccaccctgaaggcgagacttgacgccctcccgccacggctcggtcacggcgggcgccgatgaccgagagcgcgtcgagcctccgactcccggacgcgaggatccgtcgctgggtggcggcgtcggggtggcagcgcgtggccgagctgaggcaggcgacagatccgtgggctcgcgtcgtgttggcgcgatgccgttcgtgtgcgacgagcgcccggggctcctgcacggcggcggacggtccccgtcgagcacctcctctcggacctgggcgttcagcggcttgcctcgcagaggccgcgctgccacggcgatgcggcatcggggagccacggagtcaccccgagttccgctgctcagtgagcgagcacgcccgcgacggacaggcgcaaggtggagagcgggtcggagtggccaggtcggacggccatgttatccgtgacgaagcggaccgtgacgcccttgtcattgagctgggggacgagggctcgcaggtcgtcgaggttgcgcgccgaacgatccagcgagtggacgacgacctcgtcgccctcgcggaggtaggcgatgaggtcgcgcagggccgggcggtcgacccgagcgccggagacgtggtccacgaagacacggtcggtgtggacgccgaccagctggcgctcgaccgaccgatcaaccgaactcacatgaacgtagccgacgacccgccctgaggcctcgctcacgagagcgcgcctaccctcagcgtgagccaggagacgagtgccacggtcgggagtggacggtcgcggcgacgaaggctcgcaggtggtgggccaacgtctcacggtcgatggctccctcggcgaccttccagacgaggtcctcgagctcgttgtcggacgccagcagcacgtggccgttgagccggacaaacagctccgtcgtcacgaccgcacagcgcttgttgccgttggggagtgggtggttggcgaccaggcgctcaagcagcaccgcggccttggtaggcacggtcgggtaggcctccacgcccccgaggccggctcgaggcgctgcgagcgctgagtcagcgagttgacctgccgggccagcgaggatcgaccttaccgtggcctcgtcgaggccgagcgtggcctgcacgacgacggcgtagtcggcgaggtcgaggtagcggaccgtcacatcgtggcgaggcgctcgaggagccccttgcgctcctcgatgatgcctcgtagcatcgccaagtacccggggtcggcgcggcgctcgcgcgcacgagcgatgacgtcgtcgatggtctcgacgggcctgggtgcagcctcgacacagcgggtgaggtcctagctggccatgatcgaacacaccccctccctgcgccgacgtccgccaactcatcgagccgatgtcagcacaccgtagcagaacgagctggggggcgtcggcggctgctgtcgcctttggtctacaacatcgccgcgacagctgtcgccacaggaggagtgaatcccacggcgacaggatcccgtggggagcgcgagatcgcggccggtacaccctgaggcgacgtcggtggaagctcattgctgggggcgaccatgtcgtcgacgagtttgcataccttggtcgagcgctcgaggcggtagtcaagttccgaccacgcctcgccaagttcctcggcgcgtcggccctggtagctcttgatgaagcgcccgacgcgggcgtcgaactggatgcgatcgccaggctggagctcgaggcgcgcgagcgacgcgccgtacgtgaaccagaggtggtccgtgactacctctcccgtcgtgacgagacggacatcgaggagcagaatcgagcgctctggccccatccagccaggtttggagtcgaagagccctacgtcgcctcaaagcgtgatcgttgtccgacgtgtcgtgccagtcgttccctcgtgtccgtcccattagggcgggcctggcctatatctccccgggcaagaccgatgcgctcgctgcgcggccgtcctcagggatttccatctgcgtccagggctcgtcacgcacactctcgcgagccacgaggtcaaagagggcgtaggcaagggcgcagagcgcgtagcgggcgatcgtgcaagcgtcacgtgtggagcgtggcggcacgacgatctctgccgcgttgtcatcaagcacgccaacggtgatcgcgtcgtcgtccggtcgctcggcaatcctcgtcgtgacgaggcgctgggtccactcaccgaacacgcgacatgcgatgcccgcctcgtcgcagagggcctcgatcgtccgcgcaccgtcgagatcgatgtgctcgacgtagcgaggcgccggccagaacgaggtggccttcttgcgctccgagttcgacgagtgcggcaagagccgctcagcggtagaccgcgcgctgcgcgccctcgtcgacgaggaggtgctcgtgcgcggcggctggggcatctacgtgcgcgcgaggcgcgtcgggcatcgctgctcgcgccgaccggcacgatcggggcatctacgtgcgcgcgaggcgcgtcgagtacttcggcaggaccggcatcggcacggcggtgatcttcgatcgccggtaccccgaggtgctcgccaagctcggtgtcacttgggaggccgacagcgcacgcaaggcgtacaacgaggggcgcaccacccaggtcccggcctggaccgcggtcaacgtcggccgccagcgcatcaccaggcggatcgcgttcgggaagcgagtgttgcagtatgagcggaccacggggactcgacgacggaacgtggcgagcgctcgaggaggcgcgagcgaacggtcttcttccgctacttcctgagttcttcgagcagaactcgcccgtctgaacaggaccatcgacttccgggtggtgctgccggacgacctgcccggcaccaaccactgccgcagctacacggtgtgctggaatacggcctgctcgagccgacggaggcgctcggcgacgctcagctcgccccctccctcctcggtgcggagccgatcgagtgcccagatgcggagcagcgtggagactggtaggtgctcctgagcggcggcccgttggagccgggcatgctcgtcagcggacaaccgtaccgacaccacggttgggcgagtgaggttgggccgtgcgaccgtgatgtccgtgggcatcgtgtcggcgaggtcgtgctgctccgccgctgccccctcttcagccaggatttcctcgatcttgctgctcatcggtcctcctccgcgtagatccgtcgatctcgtgggcctgcgacccaggcgttggcgccccaccactccccggcaggccgctccgtctcgtcgacgtcggcggcgaccaggatcacaacgaggacatctcgagcgctcggcgagtagccgatcactcgtaccgatcgaccgctccggctcgcagggtccggcgtgagccagaccgcatggtcctcgttgatcgcttcgtcagcccagcctggttcgatgccgtggcgtgagcggatgtaggcggctcgcttctgccagtccactcgcaccacacctacatagtactacactcgactacgcttggtggctcggcgccgaccgtgagaggacggttgtgaggttcgcggcagcagtagcacccgctcccagggagcggctcggaggtcgtcacggcgcagctaccactcgtagagtggcgtcccaccaggtggtgtaatttccgggcggcctgaactccaggagggcgggccaccgggcgatctctggcttgtcggtcaagagctcgccagaggaggtacgcgagtggccctgactctttccgacttcacccacgtgctctggcgccatcagagcaggcggcgacatcgacgtcatccgagagggggttcagctcgttctccaagccctcatcgagcgagaggctcgagcggtcattggagctggccgcgacgaacgaggcgagggacgccagacgcaagcgcaacggtgagcgcgaccgtctgctcgtcaccaatgctggcgacctggagctacgcatccgcaaagctccgtcgggggagcgtgtcccgagcatcggcgagcgccgccgcctgcgtcgatcgcgtcctcgacgtgcgtggtcatggaggccgacgtctgagggagtcagcacccgcacggtcgacgacttggtcgcggccctcggtgggacggggatctcgacaagcgaggtctcccgcatcatcgcatccctcgacgaggagctggcaggatttcgtcgccgcaggctggaccatctctgagttctgctccctcttcgccgatgccacctacgcgaagggtcgcctcgagcaccaggtcatctcccgtgccgtggtagtcatcaccggcgtgcacaccgccggggaccgcgaggtcctcggggtcgtgcgtcggggatgggcagaccgagagcttctggaccgagtgcgagagggagctcagggatctcgggcctcggggtgtgcgcctcgtcagctccgatgccagagcgcaggctcaccaagccatcgccaggtgcttcgtcggggcgagctggcacaggtgccgagtgcagcgggcgcgacgtgctcgctcgcatcgaagaaggggagctcgggagatggacctcgcctcagatcccaacgatcgtcgctcaagccgtccccaggagcggtacgtacccgctacgaccaggtcatcgactcccttgccgcgaagctcccagcggttgtgaccatgctcgccgaggccaaggaggaggtctgcaccttcacgaacttcccggaggcccattggcgaacgatctggtccacgaacccgctctgagcgggtgaaccacgagatcaagcggcgcactaacgtcgtcggggtcttcggcaacgacgccgctctcctgcgccttgtcaccgctgtcgtgctcagccagcacgaggagtgggccgttgccgagcggcaatacctatcacaggagtccatggccgagcttgtgactgccacgagcgacgacgacacggcgggcacctccgagacgcctcggccccctagcgctcctcccgtgctgccgtcgcccgccgaggaagagcctgcagtggtaggctgagagcggccagggaacggatttacaccactcggtgggacgtgatccatcgcaccctgctgtcgcatctggtccgagatttcaccgcgatagctgtcgccacaggaggcgcagatcccacggcgacaggatcccgcggggagcacgggattgccccgccggtacgtcaggagacgaagccggtgggcgcgtcgagatggcagcttcccgggtcgggcgtgatccgggagggggcgtggggaggtcgtcgggcgaggatgcagcagtgctcgtcgctgcgcgaccagtcccgcctcgtcgaccaccacgactcggacgcacgcaggcaatggagtctcgaggagatcgaaaccgatgggcgaccgaacgcgaccgctcgacccggcctcaccgattgagcgcaccagagctgcctaggccttctccggggttgcgttcctactcatcgacgagaaaacgccacgcgagctcgcccccgcggctcagcccgattcggccagtcgccagaacacccgtcctgcgttcgtcggccggctcgaggtcgaccgccccgccgagcacgaggccattgtgctcgcccgtcatgccgagcgctcgtgcgacccgccctggaccgagcactcgacgcccgtcgtcgagctcgatgccgcgcacgaggacggcacctggcactccttcgggtgccacgacgatgttcaccaaccagtgcaccccgtagcacaggtacacgtagaggtggcccggaggaccccacatgatctggttccgcggtgtcgatcctcgccacgcatgacttcctggatcctcagcgccttcgtacgcctcgacctcgatgagtcgacctgcgccgagcggcccgacgagacgtgcaccgaggagccgcggagcgacgtcgtgtgccggaccctcgagcagctcacgcagggcgcgtgtgcctgagtgcatggaggcgctcccgacgctcgccgagccggacgcgcagctcgtcgagctgacgccgcaccgactcaagactcgccatcccgttcgcgccgcgccgctcgatcgcctcgtgagcctcgatgaggcgcaccgcctcctcgccgagctgcggatgcgccgccacgagctcggcgagcgcgacgtggcgctccagcgagtcacgcacgagccctgccgccaccgcatgcgcacgtcgaaagggcatccctcgacgtaccaggtactccgcaacatcgatcgcttgcaggtaggccgatgacgccgcctgtcgcatggcgtcgaagtcgaacgtcatcgtcgcaagcagcccctgcatcgccgacagctcgaggcggaactggtcgaccgcgtcgaagagcggctgcttgtcctcctggagatcccggttgtaggtgagaggcaaccccttcaagacggtcaggatggtcacgaggtcgccgatgtagcgaccggccttcgcgcgcgagagttcggcgatgtccgggttcttcttctgcggcagcatcgacgagcccgtggcgtaggcgtcgtcgaggcggatgaagcgaaactcctcggtggtgaagagcacgatctcctccgcgagcctcgacaggtgcacccccgccatcgtgatcgcaaagatcccctcggcgacgaagtcccgatcgctgaccgcatcgacgctgttcgcaaacgaacgcgagaacccgagccgggccgcaacccacggtgggtcgagcggcaaggtcgaacctgccagggcaccggcaccgagcggcgagacgtccatgcgcacgagtgcgtcgagcactcgggcgatgtcgcgctcgaccgcccaggcgtgagcgagcaaccactgtgcgaccgggatcggctgagcgcgctggagatgcgtgtagcccggcatcactgcgctgcccgcactctcggcgagctcacgaagcacgtccgcaaacccgatgagccctccggcaacctctgccagtgcgtcacgggcccagagccgcagatcggtcgcgacctggtcgttgcgcgagcggccggtgtgcagcttggcgccgacgtcaccggcgagctccgtcacgcgtcgctcgatggccgtatggatgtcttcgtcggaggggaccacgacgaaggtcccctcgccgagttcggcctcgacggcccggagcgccccgagcagcgtctcgagctcatcgtcgtcgagcaagcccgcgtggtggagtccctcgacgtgtgccctcgagccctcgaggtcctcgcgccagagacgctcgtcgatcgagaggctctcggtgaacgagagcagggcatcggcgggcggcgcacccatgcggtgctgccagagcgtcacggccgcagccctccctggcgttcggcccaggtacggatcccgagcccgaagatccgtacgaagccctcggcgtcaccatggcggaaccgatcctcgctggcataggtcgccagttcgtagtcgtagagcgacgaggggctgcgacggccatccacccagaacgcgttcggcgcaaagcgcacccgcacctcaccggtgacgggcttggacgcttcgtcgatgaaggcgtcgatggcgtgcttcaggggcgagaaccacagcccatcgtagacgagggttgcccaccgcagaccgagttcgatcttggcgtgcgccacctcgcgctcgagggtgatgtcctcgagctgccggtgcgcctcgagcaacacgaccgcggctggtgcctcgtagacctcccgcgacttgataccgacccgtcgattctcgaccatgtcgatccgaccgacctgccacgatccggcgatccggttgagacggtccacgagagcggcgagcggcaggcgctcaccgtcgagcgacaccggcacaccctgctcgaaaccgatgacgacctgatcggggagcgacgcaaggccacctgcggtgtaggcccagacgtccgatggtggcgccgcccagggatcctccatctcaccgcactcgaccgcacgaccccagaggttctggtcgatggagtatgggttctccttcgactgggtgagggtgaccccgtgcgcgcgcccgtactcgatcgtgtcctcacggttcatgccccaatcacgcacgggcgcgagcaccgtgagatcgggagcgagtgcggcgagcgcaacctcgaagcggacctggtcgttccccttgccggtacagccgtgcgcgacggcgctcgcaccgtagcgccgggccacttcgacgagccgctccgagatgagcggacgcgacagcgacgagacgagggggtagcgattctcgtagcgcgcgtccgccttgatcgcacgcgcgatgtagtcgtcggcgaaggcgtcacgcgcatcgaccacctcggcggcgatcgcgccggtcgcgagggcgcgggtccgcaccgcctcgaggtcttcctgctggcccacgtccaccgagagcgcaacgacgtcgaaaccacgctcgacttggagccacttgagcgccaccgacgtgtcgagaccccccgaataggccagcactaccacttcagccacgagtcgactccttgctgttccgtcttgtcttcgtcctgtatcgagcgcgctccgtgcgacctggcgccacgaccaggtcgatcccgtcgatcgatccgagcagagccgacgcgcgcagtcacgggagccagatccgcgccgatgcccgcgtcagcctaacctctgggttcgcccgggagtccggcgaggttgtgcagcaacgcggcgacctccggggcggtcgagccctgcgacaccacgatgagcagggtgtcgtcacccgccacggtgccgagcacgccatcgggcttggcgcgatcgagggcagcggcaacgacatgcgcgcaccccggcggggtcttggcgagcacgagatccctcgcaaccgcgacctccacgagccactccgacagcacgcgacgaaggtaatcctccgacgtggtctggtcccgcgggagatccgggatggcatagacgctctgaccctgcggaccacgaaccttgatcgcgccgagctcgtcgagatctctcgatacggtcgcttgcgtggcggagatgccctcgacggcgagtaggtcgacgatctgctgctgagagctgatcgcctgctgactgatgagcttcgcgatccggtactggcgctggttcttcgcgaccatggcgatcaccaccgctcgatcgagccggagccggcacgatcgacgaggaacgccaacagtcgcaccatggccgtcacgcgatggccggcctgacgaaaggcccacgagtgcgggccgtcgaggaccgacgcctcgatctcctcgccacggtgcgccggcaaacagtgcaagatcccaacctcgtcgctcgcctcggcgaccaacgcctccgtcagggcccagccctcgaaggcgctgcgtttggccgggtcctcgcccatcgagacccacacgtccgtggagagcacatcggcaccgcgtgccgcactcgtcggcgagtcgaacagcgcaatcgccccccgcgcccgccctgcacgctcgaggtaggcatcgatctcagccatgtcggcctcggagaactgaaaccccgccggcgccgcgatgcgcacctcggctccgagcgcgccagcggccttggccagcgatcgagcgacgttgttcgcatcgccgatccacgcgatccgcacaccctcgagcgtgccgagcgcctcgtggatcgtgatcacgtcggcaatggcctgagtcggatgcgcgcgatcggtgagcaggttgacgaagggtcgctgatgcccagcgaacctgggagccatccgctcgaacgtggcgtgacgacgaagacgcgccccaaccacccgatggtgacgcgccagcacctcggcgacgtcctcggccgcctcccgcgtatcgatcccgatctcgtcgccggtgaagaacacgggcgtcgccccgagcgcagccgcagcgacgccgagcgccgagcgagtgcgcatgctcggatgctcgaagacccctgcgatggtgccgcctcgaagcggcccgctcgctgcgaccgcctcggtgacgaggcgccgcatgtcctcgggagcaaggtcgtctacgtccccgaccacgagcgacgtcgcgcgctccatgttcagacctcctccaggacacgggccagggcacgaccgaggcgggcaaacccctccgcaagctcgtcggccgtgatgatgagcggcggcagcagccgcaaccgcgtcggaccggtggcgttcaccacgacgccctctgcgagcgccacgtcgacgacgcgcgctgcgaccggagcggcgagttcgaggcccaacatcaggccagagccctcgacgagccgtaccccaggcagcgcccccgccaacgcgacggcctcgtcacctcgcgcgcgagcaagcgcgggcgcgtcaaggcgaaccagctcgttcgccaccgcctcgacgaccgccatcgcgagggcattaccgccgaaagtagagccgtggtctcccgggcgtagcgcctcggcgaccggcgcacgggccacgaccgccccgaccgggtacccgttgccgagtgccttggccagcgtgatcacatcgggctcgagcccgaccacctccgaaccgagccacgcacccgtacggccgaggcccgtctggacctcgtccacgacgacgagcgcgccggagacccgccgtgcccgctcgatcgccgcgatcgccgccgctggcagcggatggacgccggcctctcccgcgatcggctcgacgaccacggctgccgtcgcctcgtcggcgacctgcgcctcgagcgcagccgtgtcgtgcggatccacgtgcacgacgtcgggcaccagcggctcgaacggcgcttgcttgtcgggctgacctgtcagcgagagcgagccgaaggtacgcccgtggaacgcgccggtcatcgcgaccacgcgggtcctcggagcgcgcgcacgccggacgagcttgaacgccccctcgaccgcctcggtccccgagttggcgaagaacaccgacgcgtccccgagcgaggcgagcggcgtctggagcgcggcgagcgcgcgctcgcgcgcgtcagtgtcgaagtagttcgacgcgtgccacagacgcgcagcttgggccccgagggcctcgacgagacgcgggttcgcgtgaccgagcgacaccacggcgatgccggcaagcaggtccacgtagcgctggccgtcggcgtcgatgagccaggagccctcgccacggacgaaccgccgcttgggctgcccgtagacgccgatgagcccgagcctcgtcatgacgcgctccgacggatcatggttccgacccccgcatccgacaacaactcgacgagaagcgcgtggcgttcacgaccgtcgacgaagtgcacctcgtcgaccccggcctcgagcgcggcccgtgcggcagcaagcttggggaccatgccgccccgtacgctgcccgagctgagccaatcctcgagctcgccgagggtgagttcggagacgacgctcgccggatcgtctgggtcggcaagcaggcccgggacgttcgacaagaacacgagcttcgtcgccgagagcgccggcgcgagggcggcagcgaactgatcggcgttgacgttgagttcacggccctcgtcgtcggcggcgagcgacgccacgatcggaatcatgccgtgtgcaaccagcgcctccacgaggtcggcacgcacctcgaccacctcgcccacccgaccgagcgacggatcgacgacacgcgcacgtgcgagcccaccgtcgacgcccgagaggcccacccctctcggcgctccggagacctggttcacggcgcgcacgatggtggggttgacggcaccgagcaggccgagcctcaccacctccagcatcgcgtcgtcggtgaccctgaggccgccgcgacgctcactcgacaccttgagtcggcgcgcgagatcatcgatctgcggacccccgccatgcacgaggaccgggtggatcccaacgtgagcgaggagcacgagatcggtagcgagcgaggcgagcgaccccgcctcgtcgccgagcacgttgccaccgtacttgatcacgaccgtgtgacccgcgaagcgctggatgtagggcagagcctcgacgaggatcggggcgcggagacgaggatcgaggtcgatcacgaggtcctccggttctcttcgaggtaaccgtgaccgatgtcgctggtcaagacggtggcgctcgccgatccacgcccgagtgcgacggcgaggtcgacctccggttgggccatccgccgcgtgagctcctcgtgctcgttcgcactccagccgcctcgggcctcgaggccaccctcggccacgagcatcccctggtaccagatgcgcacaccgctcggatcgacgccgcgtcgcgcggcccccacctcggccaggacacggccccagtagggatccccgccgagcaacgacgccttcacgaggagcgagtttgcgatctgtcgcgcgatcaggagcgcttcgtcctcgtcgcgtgcctcgagcacgcgcaccaccccgacgcgcgacccaccctcggcgtccgcaacgatctggtgcgcgagctgcgcacagacctcgcggacggcctcttcgaactcctcgccaggcgagcgtccccgaccagaggcgagtgcgacgaccgtgtcgttggtcgagctgcatccgtcgatcgtgatccgattgaaggtcgtctcgaccgccgcgcgcagcgcagcgtcgagacgctccgcctcgaccgccgcgtccgtagtgatgacggccagcatcgtcgccatctgaggcgcgatcatcgccgcacccttggccaagcccccgacgcgaaaaccatccccctcgacgagcgcggtcttcggatgggtgtcggtggtcatgatggctcgagccgcggtctcggcgctccgctcgtccactccgaccgacgcagtgagggccccgaagcccgcgagcgccgcgtcgatggggaacgagatcccgatgaggccggtctgagcgatgagatagtcctcggcccggcctccgaaggcgtgggctgcagcctcgaggaggcgccgagcggctgctcgtcccgcttccccggtggcagcgttcgcgttgcccgaggtcagcacgacgccacgaacgcggcggcccgagccagcgaggtgcgctctcgacacctcgatgggtgcggctggcgagtcagtcgtcgcgaacaccgccgccgcgacgaccggctcaccgtcggccgatccgacgaaggccgcgtccaacgcgccgcccgccttgatgccgatccacgctccacctgcacgaaagcctgccggcgcggtcacgctcacggccacacccccaatccctcgagcccgagtacttcatccacaccgaccatcaggttcgcgccctgcactgcgtgctgcgccgcgcccttgccgaggttgtcgatcacgctcgtcgcgacgatcacgccgacctcgtcgtcgaccgtggcggccagcacggctcgattggacccccgcacctcacgcgtcgacggaggcgtctctcgcacctcgacgaagggcgaggttccataggcccgagcgaggacgtcgcgcaccgagtccgcatcgacggttgcgtcggcgaccggcagcgtgatcgtcgcggcgataccgcgtgaatagggcccgagatgcggcgtgaagcgcaccgggaccccgagcagcgagcgcatctcgggcgtgtgtcgatgccccccgagggcataggcgcgcactccctcggcaacgttgacgaaatgcgtcgtctccgtggctgcactgcccgcgccggtgacgcccgagatcgcgtccaccacgacgaggtcacgacgagcgagaccagcgtcgatcagcggcttcgcggcgagcaccgtcgcggtgacgtagcaccccggaaccgcccagacctgtgcgctcgcaagctccgtgcgcacgtgctcggcgaccccgacaacggcagacccgaggagctcgggcgcggggtggtcgtctccgtaccagcgccgccaggtcgcctcgtctgccaggcgcaggtcggcaccaagatcgaccacgcggacaccccgagcacggagttctcggatgatcccaccactgtgaccgtgtgggagtgcacagaaggcgagttcagcggcgacggcacgaggatcgatgggctcgataggccgctcggccaagtcgacactgaggccaggcacgagctcgcccaggcggcggccagcgcgctggtgggcctggaacgcgacgggctcgaagacggggtgccgcgccagcacccgaacgagctcttggccaacgaagccgcttgcgcccaccaccacgacgtccatgtcgagagtctatgtccactactgcataatcatgcgcaccctgcccgaagaatcggcgccgagctaagcttccttcgatcgagggaggcgcccgtgggtccgttcgtcgcctatgaacagttctggctgcgctacgtcgacttccgaggacgctcgagccgggccgagtattggtgggtcttcctcatcaacctcgttctcgagctgctcttcaccttgggtgcacgctccacgtcactcgtcagcgatctcggtctcctgtatgggctcgccgccatcatccccaacctcgcgctcgtcgttcgacgtctccatgactccgaccatcgcggctggtggatcttcatcgcgctcgttccgatcgtcggcgcgatcgtgttgctcgtcttcgaactcctcccgggcaccccagggccgaaccgctacggggatccgtcgacgccggttcgctctccccggttctagatcggctatatcagcatgggaacgcttcgctagaactccagctccccggctgaatggatcgttgctgagaacgaatccactcgcgtcggagctcttccccgaacgaaccgcccgacggcgggtagggtgggcactcgtgcgcggttcgtcgggcctgagcggggccacctcgcgatggctcgaacgcttcgaagtgcttgcagtgcgagccttcggcgccgacacgctcctctacggcgtctccgcagtcatcgccgggctgaacctcgtcgtcgcctccgggggcgactaccgcgcctgggcgatcgtcgcgacaccgctctatgcgatcgcagcactcgccagcctccttctcgaccggatcggcgacgtcgagcaagcgacgcggtggcgtcaccgtctcgtgctcatcctcctcgtcggcgtggtcgtcgtgccgctcggcgatgcggtggcagcgcgcgcccttgcgctacccggcatccacgcccaagccgaggtcgtcgtgatcgagcgctgcggcgaccgcgtgctccacggccacgactgctatctcacccacccgacgaccgctggcagttccgtgtcatcggcgtcgcacgcactcgacgcgaacgcgttcgtcccctacctccctgggatggccctcttcggcctcccgaacggcctccccctgccgaccgtgctccgcgacgcccgagtctggatgagcaccttcaccgtggcggtgctggccttcggcgcgtggctcgctcgactcgcgcctgcacagcggtggcgcctcctgctcctcgtcgtcgtgctccccgcaggagccctccccatggtcaccggcggcgacgatctccccgtcatcgcgctgctcgcgaccggcctgctcctcgtcgagacgaagccgcgcacggcggggatcgcgctcgggctcgccacggccttcaagctcaccgcgtggccgatcgtcgcactcctgctgctcgttcgcgatcccaccgtgaatcgtcgccgcctcatcccgccgatcgtcgccatcggtggcggcctcaacctgctcggtgccgccatcaacctgcgagcgttcatcaccaacgacatccgcttcccactcgggcttaccagtgtgcgctccccagcgcagagtcccctgcttggccaggcattggtgcagctcgcaccgagcgagcaccgcctgatcgtggtcggcctcgtcgccatcggtctcgcgggcacggcgctgctcattcgagcggcttggccgctcaccgtcgatcgggcgatcctcgtggcagccctcgtgctgctgcttgccacggtgctcgctccgcagacgcgcttcggctacctgctctatccgttcgatctcctcgccgtgctcgtgctacgtcgaaccacacgcgtgccgatcgacagcgaccagatcaatcccgacctcagacagacagcgctcgcgcgactagagcgctgacaggcagactgcgcggccacgactggaggcgcgtcgccgacgtgtcactcagtcgtcacgaatccgggccgggacgacgcccacgacgaggcagagtcgaggcgtggttcgcgttcgtccctcgactggaccagactcacgggtcgatcaaccgtacgacgagttctacgacgccgacgggtgcgttcggcccgtctacgaacaactcgctcgcaccgtcgcgagccttggcgcagacgaactcgcggtgcgcaccatcgagcgcgacatggctcacgccgatcggggcgtcacgtacgatcaccaaggggtcgaggccgtcttccccttcgatcccatcccgcgcattctcaccgagtcggcctggcgtcacatcgcagctggcgtgcgacagcgcgtacgcgccctcgaggccttcctcgacgacgtctacggcgcccagcagatcctcgccgacggcgtcatcccgagggcactcgtgctgcgctcgacacacttccgccgcgaggtccacggcctgcgacccgcgaacggcgtacgcgtccacgtcagtggtgtcgatttggtgcgcgacgccgacggcaccttcctcgtgctggaggacaacctccgcgtaccctcaggcgtctcctacgcgctcgacaaccggcgcacaacgacgacgcgtttcccagagctcctgcgcggctaccacgtggaatcgatcgacacctacccgtcgcagctcctcgccgcccttcgtgcgagcgctcccgacggggtcaacgaccccaccgtggtcctcctcacacctgggccctacaacgctgcctacttcgagcacgcgtacctcgcgaggcgcatggggatcccgttggtccaaccctccgatctcatctgcagcggcgggcgctgctatctccgatccacgcgacgctcgaacgaggtgcacgtcatctaccggcggatcgacgatgcctacctcgatcccgtcgcctttgatccgacatcgctcctcggggtcgccggcctcatcgtcgcggcgcgtgagggcaccgtcaccatcgcgaacgccgtcggcaacggcgttgccgacgacaagctcatcggcacgtgggtgccgaccatgatcgactactacctgggcgagcagccactgctgggcatggtgccgacctaccgcctcaacgatcccgacgaggtcgcctgggtcatcgccaatctcgaccgactcgtcgtcaagcccactgacggcgccggcggtaagggtgtcgtcgtcggtacgacggcgaccgacgaggaactcaccaacctcgctggagagcttcgcgcccatccctaccgcttcatcgcgcagccgatcatccctctgtcgacccaccacacgctcgatggacgcgcgctccacgtcgacctccgccccttcgcgatcaaccacggggaccacatctgggtcatgcccggaggccttacgcgcaccggtccggcaccgggagtcctcgttgtgaactcgtcccagggcgggggatcgaaggacacctgggtcctgcgtccgggcaatggtcgagtacggacgagtcgctccgtgatcggcctcgtcgaccaggtacgcgccgacatcgacacgccgaatcccgaggcgacccagtgatccgcccccgcgcggcggcctccacgtactggctcggtcgctacctcgaacgcatcgacgcaacggtacgggtactcgaggtccagatcgacgcctccgtccagcaccgaagcggtctcccgtcggctgcgctcgcgaacagcttggggatcgccatcccagagcagctcgcatctcgcgacgacctcgtccggcttcttctcaccgacccggcggtgcccggctcggtaccgttctgcgccgccatggcgctcgcagacgctcgggacgtacgcgacctgctcacgagcgagctgttcgaggcgatcaacgccaccgcacgagccatcgccaacacggctcgaaccgcgagcaccatcccgtgggcacgcgtcctcgcgaccggacgcgacgtccacagtcgcgttgcgacctgcttcggtctctgcgagatgacgctcgcacgcgacggctactgggcgctcttcggcatcggctccagcatcgagcgcgtcgagatgacggcccggatcctcggcgcgtggcgagcacacgcctccaccgaggaggattggcacaccctgctgcgctcggtcggctccctcgagatccacctgcgacgccacgggatccgcgggagcacgccccaccgtgtgctgagcgacctcgtgggcgcgctcgacaacccgcgtgcgatcgccttcggcctgaacgaggttgcgcgtcgagcgcgcctgctgccacgcagcctggtcggggcccgtgtcgccaagacggcagccgagttggcacacgagcttcaccgcacccccgagaggatcggcacccgcagcggcgaggtggctgcccttgaggcgagccgaaccctccatcacctcatcgagaccacgatcgccctgccgagccagccgccccgctggcagctcagcgatcagctcgcctccgaggtcacccgatgaggagatcccgttccaccctcgccacctggcacaccaccgaactcagctacgacacccctgccgttcggtcctattccgagctgcgcatgagccccacgacggggagcagccagcgcgtgctccgacaccgcatcgagctctcccagccagcgcaccgagtccgctaccgcgactactggggctcggtcgtcacgtacttcgacatccaacgcccacatagcgagctcacgatcgtggccagctcgaccgtgcgatgcgcgccctggagcacgggatcggtcgtgacgctcgcgacgctcgcgcggcccgagacccagcgagcactcctcgagtacctgctcccgacgcccttgacgaccattgctgagcccgcgatcgacctcgaggtgggcacggacccactggagcgggcggaggccctcgccgccatcgtccatgacacgatcacctacgctccgggaacgacgaccgtcgacaccacggccgacgaagcgtgggcccgacggtctggggtgtgtcaggacgccacgcacgtactgtgtgcgctgctgcgtcatgcaggcatccctgcgcgctacgtctcgggttgctttgctccgcatgctctcgaggtctccgaggccgccgagggcgcaagtcacgcctgggtcgaagcgtgggtgggccactggcacccgctcgatccgaccaacctcttcgcgccgtcagagcgctacatcaccgtcgcccgggggcgcgactaccgcgatgtggccccgctgcacggcatctacgaaggtccagggcgacagacgatgcgctcgagcgtacgcatccagcgcgtcagctgagacgcgctccaccgccgctccctcgacctggttgcccctgcgacgcgaccggcgggcagcctggcgatccgcacggtgagtgagcgagcggacagcatcgcatgtgtggagcctcccggagaggccgctctctgccgtgaaccagccccgaccggtcaactccgaacgatgagccccacatcggccctccgacctctggttccctggtcgatccgacgaccaacgcgcacgcatccgcgtgcaccccgtgcaaccctgagcgccagcacgcgcaggttccaggtcgcgctgggacgatcgacgtcgagccgcttacgccatcgccggcagtgcggccgtacgacatgcaccgcgggacttgcgctcgagccgcccgcagattcgctcgacaggaggcgggtggctcgcctgccatctgaggtgacggtgacgaaggtgcgcaggtgcccccggagcgagcggggacggcgtcccaccgaccggaccgtggcgagaaggccgaggctcacagagccgcgtgcacgccgacctcgtgggccagaggcggcccaggtgccgctcggcacgcgagcgggaccctggtgatcgcccggggcagccctccacgtaggaccgcgcgagcgtgtcaggtaccgaaaggtgagcccatcgctcctcgtctgtcgcgggagcggaacgtcgggctagaggacgaccgcagcgaccacgaggatcgccagcaccaccgtcgccacagcagccatccgtccgacgcctgcggtcgcaaagccgatcacggacgccacgacgccagcgaggggggtcgcgagcaggatgaccgcgccgagcagcacgatgccttccccgcggccgtgccgaagagcccgtaccagcccgccgagccccaccggaaagtgcgcacggcgcccgacgaggacgtggtagctgatcggaccgacgacgaagtgaggatggctgacgagggtcaccacgagcccggccacgaccagcacgaccgcgatgacgacgccagccccgaggacgcgtccgacgacgttcgcgacctgcgcgtccggatcctcgacgcgtcgctctcccgacgcgctcatccgatgcccttctgcaacatctcgacggcgacgaccacgagcaccgcgatgaagacccagcgcaccacggtcacgttcacccgcgtgagcaggcgagccccgagcgttgcgccaccgagcacaccgaccgcgatggggccggcgaggatggggtcgatctggcctcgcgacaggtagatcgccgcactcgccgcggctgtcatgccgatcatgaagctgctggtcgccgaggccaccttgagcggcacgcccatcaacatgtccatcgtcggaacgttcaacgcaccagagccgataccgaggagcgccgagaccacgccggcaccgaacatcagcaccagaccgaggaggctgcgctccacccgatgggcaacgaggacgccgccatcaccgatcggcgctgcgccatggagttggagggcatcggcgatgcgatcgtcgcggggctgctcgatgcgatccccactgcgtcgacgcagcatggcgacggcagagtagacgaggatggctgcgaacagcaagaagaggaaccgcgtcggcaccgcgcgcgacaggagggcaccgacgatcgcgccgagcgtggtcgcgatcgcgagatacagcgcgagacgcacgttcaccatgccgcgacggacgagccgcgacgcgccggtcgccgaggtcgccaccacggtcacgaggctcgccccgaccgccaggcggatgtcgacatggaagaccagggtgagcaccggcacgacgacgattccgccaccgagtcccaccagggacccgagcaggccagccacagcggcgatcactatcagcgcgatgatgaagacgagcggtgtgatgaccatcattgtaccctcgtgggtatcagatcacgacgccggcgccgtacgaagcgcggctccgagtgccgcacccgcgtgccgggccacctcgatcacctcgcgaaccctcgcctcactgatcggcccttcggggtcctcgagccgtaggcgcaggccgagcgagcgccgaccctcgcgaacgaacgtgtcgaacgctgccacgtcgcgcaccaccgggccgatctcctcgcgcacccgagccgcgaggcttgcggccgcgaggtcccagggcacctcgaacgagaggtcgagctcactcgccgcgaaggcgccaagggtcgaggaagccgtgaggggtcggggctcggcgagccagtccgcgtccagctcgacaacgccgtagcgccaccgtcgagcacccagcgcagcggccacatccggcgcgagctcaccgaagacaccgacgaccagcccatcatcgatcaccgccgcctggcggctcggatgcagtcggggccacccaggaccaccagggccgagctgcaccgacccaggaccaagctcgaggccggcccgagccacgagcctcgcgagccaacggcccgcctccacgccgccgtcatgggcgtgggcgacgatgagcccgagtcgctgtcgctcgttgacgacgcgtccctcctgccagaagaccggaccccactcgaagaatcgcgcgggctcgagacggcgtctgaccgcgtgatcgagcgcaccgacgaggcccgcagcgaccgtggtgcgcaacacgctctcttcggggcgcaagggattggcgatcacgggtgcgacgcgctcgctcccgagctgctcctccaccgagggcgacaccatggtcacgctccaggcttcgaaggcgccctcgtccgcgaggagcgtcgagagggcacgttcgcgctgctggcgtagcgtcgggccatcgcgtcggggaccgatgaggggcgtcggggccaccgcgtcgtagccgacctgacggagcgcctcctcgacgacgtcggcgacgtcggtgacgtcggggcgccaggtggggaccccgacctgccagccgtccccgtctggctcgaggtcgaacccgaggcgcgagagcccggcatcgggttcgaacgactcgagcaccactggatcgcccgcgatcgccaccgcgctctcagcacgcaccgcgatccgtcgcggcgtcgtggcgtacgcaacgtcggcgaccagcatcggcgtcgcgacacccacgagagcggcaacacgggcgcacaccgcgtgcgcgacggcggggtccaccccacgctcgaaccgccacgacgcctccgtccgaagacccgtggcgcgcgccgcgcgcgcgatgcgctctcgtgggaacgccgccacctccaagaggacctgctcggtctcggcgttgacctcggtctcggcaccgcccatgatgccagcgagccccaccgcgcgatcgctgccgtcgacgatgacgagttcaccaccggcgagggttcgttctcgatcatcgagggtgacgagccgctctccaggacgagcactgcgcacccccaccacgccaccagccaaacggtcgcggtcgtaggcatgcgagggctgacccgtctcgagcatcacggcgttcgtggcgtcgacgatggggctgatctgccgcatgccgctcagcacgagccaccgcgccacgcgcggctcgagcaccgcgccacgcacctcgaggctcgcgagcacgagtcgatcgacggcgccctcttccaccgtcaccgcgcggggatcctggcgcgtgagcacccccgtgacgtcgacgaagggggcgcggaagcgcgcagcgaggtcgcgcgcgacaccgcgaactccggaggcgtccggtcgattgggttccacggcgatgtcgaggacgacctcgtcacggacccccagagcctcacgcaccggcacgccgagcgggagcgacggcgagaggatcgcgaggccgctcgcgtcggagccgagacctgcctccggagccgagcagagcatcccttccgacgtcaccccacgcagacgccgggccccgatctcggcgccgttcggcaggcgcacgcctggcagcgccagcgggacgacatcgccttcgacgaagttccatgcgccgcacaccaccggacggatgcgacccgatccgtcgtccacctcgacgagtcgaatgcggtccgctccctcgatccgatggatggcgagcaccttggccgtgaccacgccgtccgccgcgaccgggtgctcttccacgccttcgacgacgagcccgagggagtcgagcgtgcccaccagcgcgcgaacaccctcgctgtgcgcacgcagtgggtccgtgaggccgagcgcctcgagcggcgtgaagacctcgagccaaccgatgggcaacctcatacttcacccctcgtgcgcaccagcagccggaggtcgttctccggcaatacccgcatgtcggccagcccgtagcgcatctgcaccagacggtcgatgccgaaaccgaacgcgaaccccgacacacggccgggatcgagcccacctgcctcgagcacgcgtgcgtgcaccatgcctgcaccgccgagctcgatccagcccgtgcccgagcaggtgcggcaccccgccccgccacagatcgtgcacgtcacctcgaactcagccgacggctccgtgaacgggaagtacgcaggacgcagtcgcgagtggattcccggtccgaagtacgccgtcgtgaaggcctcgatcgtccccttcaggtgcgagaaggtgatcccctcgtcgaccacgagcgcctcgatctgatggaaggccggcgtgtgacgtgcgtccggggtgtcgcgccgatagacgcgccccggcaccaccgcgtagatcggcaacgtgcctcgctgcatgagacggatctgcgctggcgaggtgtgcgtccgcaggagcagcggaggcgaggcgtcgacgtcgaggtagaagctgtcctgggcggcccgtgcgggatggtgctccggcacgttcagcgcctcgaagttgaaccactcgtcctcgacctctggacccgaagcgacctcgaagccgaggcgccagaagacgtcctccagcgccatgcgcgctcgcgccacgaggtgcctcgccccgggaccctcgaggggttcgacgagcaggcccacggagggatcagagcgctcgcgctcagcgcgctcgaggagctctgctgcgtcgagacgtgcctcggccgcctcgatggccgacgtgagcgaggcgcgggcctcggccacgacccggccgagtaccggccgctcctcgggatcgaggttgcgaatcgaccgtgacagcactgccagtgggctctgcggcccgagcgcagcctcacggatcgcagcgagctcgtcccgatccgcgaccgtcgcaaggcgctcgagcgctccttgcacactcgccgtcacgagagcggtgtctgcggcgccctgaccgtcgccaccctggtctcgcacgctcgcccccatagaccctcgtccttcctcaccaccgcgacctgcggccaaggctagccccgggtcgacgcacccgccccgccaccgagcgacacccagagcgcgagtgcacccgccaccgcagcgttcagcgactcgagccggggcggcacgaccaacgccgcgcgctcgtcgagctcgccgtcgaccgccgcactcaggccagcgccctcggcaccgacgacgagcacgcgccgctgtgtctcgggcgcgagcggcgacggtgcgcgcgggtcgagcccaatgacgcgcgcgccccggactcgcagctcacggagcgcaggcgtgagctcgtccacctcggcgatgggcacgcgctcgagcgccccggccgccgctcgagccgccttgggattgaacggatcggccgatcccggaccgacgagcacgcccaccgcgtccgagagcgcggccgcggtgcgcaccaaggtgccgacgttgccgggatcttgcacgccgtcgagggcaaggacgacgagacggtcctcgagcgcctcgaccggaaccgtgacccgtcgcagcaccccgacgagaccctgcggagtcgtcgtggcgctgatggcggccagctcgcgctgcgtgacgacgacgaccgaacgcgcagaggccacgaggtcggcctcgcgacggatggcctcgtcgaccccgacgagctgctccacgtgcgctcccgccgccaccgcggcacgaaggaagcgtgcgccttcgagcacgtagcgaccgtgtctgcgccgcgcggctgccgacctcacgagctcgcgcagctcggcgcgggcgtcaggacgcagcgcgctcctggttggcttcggcaagccgcaccaacgcgccgaacgcgcccgggctccgcaccgccaggtccgcgagcacgcgacgatcgaggccgacacccgcgcggcgcagaccagccatgaagcgcgaatacgtggtgccctcggcacgcgccgccgcattgatgcgctggatccacagccgacgaaactcgcccttgcgcgcccgacggtcgcgataggcgtactgcagcgagtgcatcacctgctcgtgggcggctcgatagcttcggctcttgttgccgtagtagccgcgcgcgagctcgagcaccgcacgacggtgcttgcggctgtgcaacgaccgcttgactcgtgccacttgtgtcctcctccgaagccctagcgtccgccgagctgacgcaacgcgcgacgggtgtcaccccgcgacaacacaccctcgcgatgcaggcgccgcagccgcgacgacgacttcttgccgagcaggtgggaggtgaaggcgtgccgacgcatcagcttgcccgtgcccgtgcgcttgaaccgcgccttcgcacccgtatccgtcttcatcttcggcatcgcaactcccgtctcctgccggcgtcacccgctcgcgatcggtccacacccaacgagcggcgctggtaaccacgcatccatccccgaaaccccgtctgcgacggagcgctcgagcggtcatggctgcctcgacaagctcgcgccgggtgcggcgcggcctatcagcgtagtgtgtctgtcgaccgagttgggcctcaggcgcgcgccggtgcgggtcggcgatctggtgcgagcaccatcaccatgttccggccatccagcttcggcatcacctcgacgtgagcgacgcccttgaccgcctcgacgactctcgtgaggatctcctgaccgagttccgggtggaacacctcacgaccgcggaacatgatcgtgaccttcaccttgtggccctcggcgagaaacttggccacctgtcgcgtcttcgtgtcgaagtcgccctgcgagatcttggggcggtacttcatctccttgagctgcgacgccgaggccttgcgcttctgctcacggactcgctgggcttggtcgaacttgaacttcccgtagtccatgatcttcgcgaccggtggcttggccatgggtgccacctcgacgaggtccatgtccatcgctcgggcgatttgcagtgcctccggagtcggcttgatgccgagctggttgccgtccggtccgacgaggcgcacctcgcgaactcggatctgatcattcacacgggccccgtcctcgggtgcagtggcgataggagactccttccgtcggaaaaccaccagcgtggcggccagcagccgcgcctcacgattgtagcccaacgcgacgaggcaagcctcgattccccgaaggccacggcgctagactcatggcccgtggccaccgacgaacgtccgccatccgacctcgctggcgaggtgcatggtccttcgtccagcgacggctccacggcgagcaccgcggcgccctcggatgcgcgcgccgaggaggaggccgcacgcctcagggccgagctcctcgacgccgacgttggggatctcatcgccaaccacgcctacggtctgttcgagctgacgcggatctacctcgccgccgaaccaccccggctcgctgacgctaccctcgtcatcgacgccctcgcaggtctgcttgccggcgtcgccgatcgcctgggcgagcgcggccagctgctcgaagccgcactccgccaagtgcagctggcgttcgtgcgccttcgggacctcacccacgacgagaccgcctcctgagcgcgcgtcagtcgagcttgtgcacccaggtggcctcagaggcgcctcgaaaggacggcgcgacccgaaccagcacccgctggccgacacggacctggcgcgacccgtcgtcgaccacgatgcaatgaaacggcacctcgactgacccctcgaccgcgatcgccccgaggccgacgtgggcgtcgaacgccaccaccgtcccctcgcgcacctcgtagggatcgacgacggcgcgcgctggcgcctcttccagactgccgcggacgcggcgccgagaccgacgcaccgctacctacggcacgatcttcgacagcgggatctcgaggatgtccgtcgcgcccgcgtccttgagcgacgggatcagcaggttgatgcgctctctcggcaccaccgcctcaaccgcgaacccatcgccgccgtagagctcgctcacggtcggggccttcatcgaggggagctcggcgatgatctgcgccaacgccgccgctggggcgttgagcttgacgagcaccgacccgcgtgccgccagtgcgcccaccaacaacgtgcgcacctgctccatggcgtggcgccgctcggggtcggcggccgcgacgggattggcgatgagctcggtataggacacgaggagctcgtcgatgacgcgaagtccctgggccgcgagcgctcgaccggtctcggtgatctctacgaccgcatcggcgatctcggggaccttcgcctcggtggcgccgtaggaggcgagcacgtgggccttgatgccgagcctggcgaagtagcgctcggtcaaacggggatattccgtcgcgacgcgaacgccatcggggagctgtgcgggttcggtgacggcgctctcaccggcgaccgcgagcacgacgcggatggggcgcgacgacgccttcgagtagcgcagttcgcccagcgacacgacgttcgcgccggtctcctcgacccagtctcgcccggtgatgccgagatcgaacagaccctcggcgacgtaggtcgggatctcctgtggccggaggatgcgaacctccgcgatgcgcggatcgtcgatcgtcgcgcggtaggaaacctcgctctcccgctcgatcgtgagatcggcggcgcggaacaagtcgaaggtagcccgctccagcgagccctttggcaccacgaccctcagcacgaaccgtcatcctccttgagtgcatcgatgcgtcgatagacatcggccatgcgaacggccacgagggctgcctcgtagcccttgttgccgtgcttggccccggcccgatcgaaggcctgctccaaggagtccactgtgaggagtgcattggccaccggcaccgtggcctcggccgcgagacgagccagctgggcgctcgcctgcgtcgcgacgacctcgtagtgatcggtctcgccacgaatgaccgcgccgacggcgatgatgcccgcgatcggcgtgcctgccgtcacgagtcgacgcgccgcgccagcgatctcgagcgctccgggaacccacacgacgatgggctcagccgcacctgcctcctcgagcgcccgccgagccccatccaccagcgcctcgccgaccagctcgttgaagcgcgccgcgacgatgacgaagcggtcagtgggctcggcacgtggtcggccttcgagcttcatcgttctcccctcgcgacgtcgagcaggtgccccaacttgcgcgccttggtctcgagatagcgcgcgttctcgggtcgcacctcggtgacgatcggcacgcgctcgacgatctcgaggccgaatccagtgagtccacggtacttggccggattgttcgtgagcagacgcatgcgtcgcacaccgaggtcggcgaggatctgggcaccgatgccgtactcacgcgcatcgaccggcagcccgaggcgctcgttcgcctcgaccgtatcgagcccctcgaactcctgcaagtggtacgcgcgcagcttgtgaccgagcccgatgccgcggccctcgtgcccacgcaggtagaccaccacccctcgtccttcgtccgcgatccgtgcgagggcggcgtggagctgcggaccgcaatcacaccgatacgacccgaagatatccccggtcaagcactccgaatgcacccgcacgagcaccggttccgtgtcgtcgatctcgcccaggctgagcacgagatgctcgtccccgggctcgaggacgctccggtacaccaccgcatcgaacgctccccattgggtcggaatggtcgcctccgacccctcgacgcgtgcgacgagcgtctcgcgcgccgcccggtagcgaatcaggtcggcgatggagatgagcgggacgccccaggcagcggcgaacgccgccagttcggggagccgggccatggactgacgatcctcggtcgtgatctcggcaagcatcgcggcaggccgccgaccggcgaggcgggcaagatcgacccctgcctcggtgtgtccacctcgcttgaggaccccaccctcacgcgcgcgcagcgggaacacgtgaccaggtcgcacgaagtcgctagggcgcgcgtccgggctcgcgagcagcgccacagtgcgggctcggtcctcggccgagatgccggtcgtaccgccgcgcgcagcgtccacggtgatggtgaaggcggtcttgcggggatcggtcccgtgctccaccatgagcggcagctcgagggcgtcgaggagctgcgactcggccgacacgcagatcatgcccgaggtgacgcgcaggtagaaggcgacgtcgtccggacgcaccgcgtcggcaggcatgatgaggtcaccctcgttctcacgatcctcgtcgtcgacgacgatgaccatctcgcctcggcgaaacgcctcgatggcatcctcgaccgacgagaaaggcgtcgccgctgttgtctcactcatgcatcctccgcttcgcggccaagccggaccccctggagccgcgcgacgtacttcccgatgacgtcgaactcgatgttgagcaccgcaccgacctcgcaggtcccgaggttcgtgcgacgtcgcgtctctgggatgagagcgactctggccgaggccggcgcgagctcggcgaccgtcaacgcaaccccgttcagcacgatggtgcccttctcgacgacgagcggctcgaaccgctcggggtagtgcaccacgatgccttcgtcgtcgacgtccgtcacggtcgcgacggcgtcgacgtggccgagcacgaggccgccatcgagcagcgtctggagcgtcaccgaccgctcgacgttcaccagcaccccgggctcgagcgcaccgagattggttcgccgcagggtctcgggcacgacgtcgactccgaccacctcgtcactgatctcgacggcagtgaggcacgccccgttgaaggcgatggaactccctggggcgatggcgacatcccagtcgctgcggtcgaacagcaatcgcccgtcacggcgctcgaggagcgctacggtccgttccacgatccccgagaacacccgactacctccgggcgctccaccggatcgaccgcgccccgtcgaccagcctaccggcagccgatcgctccgaggacctgcgactccaagccccagtaggcatcctcgagcgccgtcgcggcggggagtcgcacccaggcgacgagatcctcaccgacccgtcgatgcgcacgccaggccccccgaatggcatcctccaggagccgcccctccccgaggtcgaccgcgtgccgagcatgctcgtcgcccaacaggatcggtgcgatggcgacgagcagctcgtcgaccagtccctcggcgagataggcaccgagcagggtcgggccgccctcgacgaggacctcgacccacccgcgagccgctccggcagcgagcagcgcaccggggctctcgctggcgaccacgaagccctcggggacgtccagcgggcgacgactcgcgaccaccctgaccggttgacgccgcgcgagtcgcccgcccggtcgcgcggtgagttgcggtcgatctcgctcgaacgtcccccgaccgacgatgatggcgtcgacctcggctcgaagtcggtgcccgagctctcgcgcagcttcctgggtgatccacttcgactgcccccaccgatccgcgacggcgccgtcgaggctgcaggcgatcttgccgacgacgaaggggcgcccgcgcagccggtgcgagaggtacggggccaggtcgtcggcgagcctcgcgcgcatcgcccggggcgcgagtcgcacctcgaccccagcggcttgcagggcctggatccctcgacctcgcacccgtggatctggatcgatgaggcccacctccacacgtgccacgcccgcctcgatgatcgcatcgacgcagggcggcgtgcggccatggtgggcgcagggctcgagcgtcacgctcatctgggcgccgcgagccagggcaccggccgcagcgagagcggcgacctcggcgtggggacccccgggatgggccgtccggccgacgccgaccaccacgccatcgcgctcgatcaccgcaccgacccacgggtttggcggtgcgaccgcacgggagcgacgtgcgagccgacgtgcacgctcgagcggagcgatcacggcgccgcgtgcgggtgcgcgtccccgccgtcgatcaacagcgccaacgcatgatccaggacgggcagcaccgcctcgagcgactccaccgcgccggtcgccgacccggggaggttcacgatcaggctacgcccacgggtgccggcgaggccacgcgacagcgcaccgagcggactcgccgcgcgcatcgcctcgcagaagccgggggcgtgacgctcgagcacctcggccgtgccctcgggagtctgatcgcgcggcgtgaaacccgtcccacccgtcgtcacgatgagccccgcgaatcccaacgatgcctcgcgcagtgcgcgtgccaccgatccggcgccatcggcgatggcgctccgggcctcgagctcgaaccccgcccgctcgagtgccgccgcgagcgcctcgccggatcgatcgacgcgcgtcccgcgcaccacaccgtcggagaccgtgatcaccttcgccttgcgcttcggctccatctagaactcctcgctcgggatcgctcgaacgtgcagctgcgctgcccgaagcccgcgaacgaagtccgcaccgctcatcggtcgcccgccttcggggatgacctctccgagctcgtaagcacctcgtgccgtgtgcacgatggcccgaccgtgatcgagttgcacggtcccgagcggatcggccgcctctcgctcgaggggacgacccgagcgtacgatcacgcgacgccgtccgacgaagcagaaggctcgctccagacgcacacgccgatcccacacgatcgcggcctcggcgggacgcagacggaggtcctcggacgtgatccgcggagcccaactcgccgctccggcctgggggacccccgcttcgagggatccgggctgttcgaggagaccgaggaggagcgacacgccggcgtcggtaagacgacggcgagcctcgctggcccggaggccatcgatcagcaccgagcgcatcgcgaggatcgggcccgcatcgagctcgggctcgagacggatgatgctcacaccgctgcgatcgacgccagcaaggatggcacgctcgaccggagcggcacctcgaaactcaggaagcagcgagtagtgcacgttcaccaccggaacaccggtgagccaggcggcaggcagcaaccggccgtaagcaacaacgacgcagacctcggccccgaggtggtcaggagggagcgcctcgtgcacctcgacgccgagctcctgcgcgcggcgcgccgccacggtcccggccaccgcgccgccacgcccacgtcgcttgggtggccgagtcacgaggccgatcacgtcgtgacccgcctcgacgaggccatcgagatgtcgcgccgtctcctcggtcgagccgagcaggagcacgcgcatggtcagttgccgagccagcgctcacgcgcgatgcgttgcttggcctcgcgccgctcctcctcgtcgagtcgctcgatgagcagcacaccatcgagatgatctgtctcgtgctggaacacgcgcccgaggaggtcgctcccctccaactcggcgacctcgccgtcacgggtgacgtagcgcaggagcaccgtgcgagggcgctcgatcggccagaagtagccaggaacggagaggcaaccctcctcgtagcgccacgtccccgtacgctcgacgatctcggggttgatcgcaacgtccggaccgtcaccgatgtcccagacgaacaggcgcagatcgacacccacctgcggggccgcaagcccgactccgggagcctcgtgcatggtcacgatcatgtcctcgatgagctgatcgaggcgagcgtcgatcgtctcgacctcgcgagctcgatgcgagagcaccggatcgcctatggttcggatcggcaggatcggcacgccaccacgctagacggccgaggcccgtcggggcgctaaccctggttcacggtgggggtcgttgctgatgcgatctctcgccacgagccctgatcgagctggaggaggccgacaccggtcagattcggattgcccgccacgacctcgaccgctccgcccgaggtcacgccgaccccttgggcccacgctggtgccgcgatcgccctcgtgatcaccccgccgcttgaggtgaccggttcgaactccaccaatgttgcgcgagccccatgaggcacgagcgcgaccgcacgggtcccggaggctgcgagcgacggaccgagcgaggcgtcactgccgagtgacaccgttgcgaccacgcggtcaccgacgaggtcgacgagctggagccgctcgcgatcgttcgtcgcaacgatgacggcgaccagcggacccgtcgccccatcgacgaccgcactcgtggcgaccacatggcccgcgagtgccacggtgcgagcggtgcgcgccgcgaggtcgaccacggcgagacgcgcactcgagccacagctcaccacgagcgtctcgccgtcgggtgcgagggagcgcgccacgggcgagacgcaccccacctgatgctcgagcgccgcgagggacgcagacgagaccagcgtcgtcgcgatcgtgccgttcggcgccagatcgacgatcgactggtcgccgagcccaaaggagcgtgtcccgacgatcgcctcgccgccaccggtggtcgcaacgaccgatccagggaacggcgccaccgccgtcgtgaactcctgtggcgtccaacctgcgctgtccgccgaccacaggaccgagtagggccaggtcccatgggcgacctcgccggcatacaccggcagacccgccgaccccccggacgcaagcacgatgccagctcgggtcgacacgccgagcggggtggcgagggagagcgagttcccttgttgcacgagcacctggccgtgttggtagctctggacctcgatcagctcgccaccgctcggacgggcgacgatggccgcaaaattctcaggcgccggaggggcttgcgtcgctgcactcgtggctgttgcgcaggccgcaagcaacgcgccgagcgacgccacgaccgcgactctggcacctcggccacgcgtccagcgcactcagacctcctcgaccaggtggacatacagcgacgagatgctggtcgccaccgatgcattcagcgacggatccatcggtatcaggtagcgctcggtgaggttcggccctaccacatagccgatgtcctcatgctgggtcatcacgccatccaccggctgggacacgccgaaaccgagcgcctgccacaccttcgacagctgcgtgagcgaggggctggtcaagaagtaccagttggacagtccggtcaggttctctcgttggtcgaagatcttgaccgcctgcaccgaatggatcacggggttgaccgcgacggcaacgaacaccgtgttggcgcgcaccgacggaggcagcgccaagtccgccgtgcggagttcttgggcaatcaacggacagtcgaaggtgcacaccggatccaggttggtgagcaccacccgcttgccggcgaactggtcgatcgagaccggaacgcctcgctgatcgagcaaggtgaacgagggtaccgggcggtcgatggcaaagggcgtgtccgaagccgccagcgcgagcgccggcgaggcggtctgattgatggcggcataggccagcggaccgatgcccatgagcgcgaccaccacggtccacgtgccgagcaaccgcccagcgatccccacgccactcggccacagaccgcgaacatcgaccgactctcgagcaggactcacgacgccgacgacagcagcgccagcgagcacgagaccgggcaccatggagttcgggtccgtgccgacgcccccgaggaacccgaagtcctggacgaaccaccacgccaggagcgacaggaccgcgagcacccagaacgcgggccataccaagcgcttggccagaaaggcaaccccgacggcaatgaggacggccgcgacggcagcgttcacgacgaccgtcgtcgtgccatggagtgcgttcgcgagatcgaccatcggccgcgccaggaacgatggttggggcgtcccggccatcgtccggatcatcgcggggatctgtccgtgatagaagccacgaccaggccaagcctcgaggaccccgaacacgaagagttcggcgcccacgaggccgagcagccagcgtggaaggcgatccggttgccacgcgctccacggcgcaagcagcgctgccgccgcgaccacgtacaggaggaccgccccaggggccccgaagagccacgaggcccccggcgcgaggatgccacccatcgcctcgccacccacccacacggtcaagccccagaggatggcggcgacgtagccgaccttggcgaacgcccctgacttgccgaggagcaaccacacgccgatcgcgagctggatccacaccgcacccgtcgctgcccagagcggatggcgctgccacgcgtcgatgccgagctgaacgaggtcgaccagccagcggggactgccctgcgcggctggctggatgacctggcccacgagcgacgtcggcatggcacgctgcatctggagcagcccatcgacgatccacagggcaccaaagccccaacgcaggatcgctctcgctcgcggctcggcgacctcgtacaccccctcgtccgccgaaccagcgacctggacgcgtgccgggttggtggcgcccgcaaagaggaaatagcgggccgcgacgagcaccaacccgatcaagacgagcgcaatcgcctcgagccccaaacggtggtagaacggccccgcaagacccgaactgctcagggctgcactgcccatacccgtcattgcctaagcctccttgggctcaccgaccggcacgtaccgagacccgcggttcccgacagagcctgtcctgacaaccggattctagcggccgaaggccgaggctacggggccgctctgtgcaccaaagctcagagttctcgcgggtcgagttcgacccgaaccgcgcgcgcatcgagcgttcgcggcacggatccaaggacaacgcgcagctcacggcgggtgggagcggtgaggagccagcgatcgggggcgagctcggcaacctcgaaccccggcacgctcacctcgctcagtgcatgcacaaaggccgccgcctccggtccggagacgacggcggtgccgtggtctgggtcgagaccgagagcggcacgctcgtcgcgtatggcgcgcagcgcgcgtcgcgcgtcgcgctccgcgagcacctccgggagccacgctggcgcgtgctcgaccacgagatccacctcgccgcggttcgatgcgacgagcgccactgcccggtggatccagtagaggcccagctcctccgcgaggcggccatgagagccgaagagacgctccggctcgacgagtacgaccagatctaccgagccagcactctcgagcgcctcgatcgtcccgacgaccacgcccgcccgtggatccgggcccttcgcgatcggctggcgtaccaccggctcgaggcgtgccgcaacgtgctcgaccgaccagcgagacacccgcacggcgggtgagccgcacacgccacagcgcagcggacgtagcgcctcgcacgtccgacaccagccccgttccgggacaccgcgcctcgcagggagcacgaccaagcgcccaccgcaggcggcacacgtgagcgttgcgccacacgcccgacagaccggagcgtgccccggacctcgagccgggacgacgacgagcgccctcgggtccgcgcgccggcgccgggctaccgcgagcccatcggcgacgaccccctcgattccgcggtcgagatcggcggccccgaacgtccgcacgacgggccagggtcgaggcgctcgagtggggacgcgaacccgggcgcgcgccaggatgtcggcgggcggcaccgcactcacgaccacgagtcggctccggctgacggacgcccgcaccccagcgagatccagtgcctcgaggtacggactcgactcgtcccgcgcgttcggatggatcgggtcgagcaccaccaccgcatccggcgtcgcgagcggcgcgagcgcgcctcggcgaccaccgatactcaccgtcgtacgaccgcacgcgagctggtcccagtcgtcggggaaccgtgccgcacggaccccgacccgggcgagcgcgtctgcagtgtgtgcggcgatcgctccggtgggcgccgcgatgaccactcgctcgccgaaggcgccagccgccatgaggcggccgacctcctcgggcgccgagacggcgagcggcacgaggaagacctcgggtgtgacctcgctcgggtcgacgaggcgctcggcgagctgaccccgggcaggctcgagcaccggtgctccccgcaccttcgggcgccgcgcagcgcgcaagagcgtgacgggactcgccaccgcccacatcgccgcggcgagcaccgcctcgatcacctcgggaggggggcccggtcggacacgacggagcaccgagcgcaacgaggtggccgacgggtgctcgcgcgctcgggccgggcgcgcaacgacccatccgctgacgcgtctcgcaccgaagggcaccacgacctcgtcaccgagaccgacctctgcctcggggtcgacggcgtaggtgaacggcccgggccggccgaccacgtcgacgatgacgtccgccgagtccgcgggaaggtcgccctccacctcagccagtgatgtcgagcgcgctccgcagcgcgtcgagccgatcgagtcgctcccacgggaacgtgccgtcggagcgcccgaagtgcccataggccgcggttcgccgatagatgggttgacggagccgcagcgcatcgatgatcgccgctggccgcaggtcgaacacctctcgaacggcatcttcgatgcgacgcggatcgacctgctccgtaccgaaggtctcgaccatgagcgacaccggatgggcgacgccgatcgcataggccacctggagctcgcaccgcgacgctgcgcccgaggcgacgatgtgcttggccacccagcgagccgcataggccccggatcggtcgaccttggacgggtccttgcccgagaacgcgccaccgccgtgacgcgccgatcccccataggtatcgacgatcaccttgcgaccggtcaggccggtgtcggcgtgtggtccgccgagctcgaaccgtcccgtcgggttcgccaggatcttgaggcccgagacgtcgaggtctttgggcaccatcggaccgatcacgacgctctcgagatcagggagcagcagggtggcgagatcgatgccgggctggtgctgcgtcgagaccagtaccgtgtcgagggcgacgggtcgaaacccctcgtagcgtacggtgacctgggtcttgccgtcgggtcgcaggtacgggagcaccccagcccgtcgcacctcggcaaggcgctgcgcgatgcgatgggcgagccagatcggcaagggcatgagatcgggcgtctcatcgcacgcgaagccgaacatcagtccttggtcaccagcgcccagggacgaatacggatccgcctcgccgctcctggcctcgagcgcgctcaggacaccagaggcgatatcgggcgactgctcatcgatcgtgaccacgacgccacaggtgttgccgtcgaaaccgtaggactcacggtcgtagccgatgtcgcagatggtccgacgaaccaccttgggaatgtcaacgtagctgtcggtggtgatctcgccggcgacgaccacgagacccgtggtcagcagcgtctcacacgccacacgggccaccggatcctgcgcgaggatctcgtcgaggatcgcatccgagatctggtcggccatcttgtcggggtgaccttcggtcaccgactccgacgtaaacgcgtagctgcgcacagcgctccttccttcgagggcgctcgaacaacctagtggagccgatgcgatcgcgcgtacgcgacggcgtgcgcgagaatgcccgcagcgatctgctccttcgacgccaacgccagctcgccccaacggccgtctcggtcgagcagcacgacctcattggtcgccaccgcgaagccggcgtccgcacgggacacgtcgttgccaaccatgatgtcgacgtcgcgggctgcccgcttgcgctccacctcggtgcgcggatcacccgtctcggcggcgaacccaacgatgatttggtgcggctcgcgatgagcgctgagctcacccaacacgtcgggtgtcggtccgagttcgatcgtcagagacgaacggccggcccgcttgatcttggaagacgccgtcgccaccggagcaaagtccgccaccgcagccgcctgcacgacgacgtccgccgacggctggcgctcgcgcatcgcagcgaggagctcctcggctcgctccacccgcaccacctcgacgagctcgccgaccggaccggcatcctcggtcgtcaccaacgtcaccgtcgctccagcgagcgccgccaccgcagcgatcgctcgcccctggcgaccagacgagcggttggccacgacacgaaccggatcgatcggctcccgtgtgccgcctgccgagacgagcaccttccagccggcgagatcgagctcaggtgccgcctcgagcagctcgagccagagcgacatccaccacggatcgacaaggcgtccgagccctcgatcgcctcccgcaagccgaccggtcgtcggtccgacgagcacggcgccgtcggtgcgcagtgtcgctaccgagcgttgggtcgctggcgacgaccacatctgggtgtgcatcgctggtgcgagcgctctcggcgcgctgctcgcgagcagcgtcaccagcgcaacgtcgtccgcgatcccggcggcgaccttggccatgaggtccgcggtcgccgggtacacgatgatgcgctcggcccacgacgccaagcgcgtgtggaccgatggctcacgaccgaagagatcgtcgttcaccatgcgtccggcgatcgccgacagcgacgcggcaccaacaaactcccgagcggcggccgtctggatgacctcgacgtcgtgccccgcatcgatcagcagccggatcagctcgagcgccttgaacgctccgactccaccgccaacgacgcacagcacgcgtcgcgtcacgccgttactccgcttcgtcctcgaccaactcggtcacgtcctcggccacgacatccggaacgatcatgccggcagcgatctcctcgaacgccagcgacaatggcttcgcgacgtccgactccacctgcggcggaatcatcgcgcccagcccttcaccgagatgggtgcggtagtcgttgatctggcgggcacgccgcgcggccaaggtaatcagaacgaacttcgagcccgtgtgctcgagcagctcctcgatgggcgggttcaggagcgaacgcccggcttcagccaccacaacctcctcgacggacctcggagcctacctgctcgagccgactactcgggccgaagggctgcgccgcggacgatcccggccacttcatcgatggcccgctcgaggcgatcgttgaccacgatatggtcggcgaggccgatcatcgcctccacctcgttcgccgcgatggcgagacgggactcgacgtgcgcgtcgtcgtcgcctcgagcgcgcatgcgacgctccagttcgtggaagctcggcggcaccacaccgatgatcgccgcctcgagctccagcatgcgcacactcctggcaccctggacatcgatctcgaggatggtcggatccccgcgctcgagctccgagcgcggggtgccgtacaagcgcccattgaacgacgcccactcgacgaacatgccctggtcgatagccgactcgaagtcctcgcgcgagacgaactcgtacgcctcgtccccctcaccgggacgacgaggcctcgtcgtccacgatctggcgaggtgggccgatggcagcgacccagcgagccgacgagcgatcgtacccttgccgaccccgccggggccgcagatgacgacgatcagtggcccttggtctcctcgagcaggcgctgacgctgcaccgatccaagaccctggacgcggcggctgtcggcgaccccgacctccgccatgatgcggcgagccttgaccttgccgatgcccggcaacgactcgaggaccgacaggaccttcatcttgccgacgatctcgtccgactccgctcgctccaggagctgcgcgagactgagcgagcccatcttcaggcgctccttgatctcggcgcgggctcgacgggcttctgcagccttctggagcgcagcttgacgctgctcagggctgagcgatggtggcaatggcatacagcgcaacctagcagagcttctggccgtctagggctcgatttcgcctgaatgttgcctacgaggcctctcccgtcgccgctgcgaacagcctggcggccacctcgaccgggtcactcgcctcggtcaccgcacgtccaaccaccagcacgtcggcacctgcctcgagcgccgctcgtggcgtgacgacctgccgctgatcgtgctgggcacccgatggctcccggatccctggcacgacgcgaacgagctccggccagcgctcggcgacggttcgcaggtgatcggcgccgacgaccacgccctgacagcccgagcgtacggcgacgtccatccggcgctccaactcggagaggtcgagcggagcctgcgacgtcagcgacagcacaccgagcgcgatcggtgtcggagcaccgacacgttcagccccctcgaggaggccctccacgccagcgcggagcatggcctcacctcctgcaacgtgcaaggtgacgagtgcgacgccaaaggaccccaacacccggctcgcgcgatgcacggttgtcgggatgtcgtggagcttgaggtccgcgaagatccggaatccttggtcggcaagggccgacagcaccgtcggaccggcggcggcgtagagctcgagccccaccttggcgatggagaaccactctcgcaacgacagtgccagccgttgggcctcgacggcatcgtcgcgatcgagcgccagagcgaagcgctcccgaagcgcctgagcctgcatcatccactccctccttgacgccgaagcgcccttgcgtagcggtcccagctgtcgacgccgctgcgcgcgagccgacgttcgatctcggcgagcacgaggacgggacgtcgtgggtcgacaaagagcgcggtgccgatctggacggcatcggctccagcacgaacgaagcgctcgacgtcgtcggcggtcgcgaccccgccgacgccgatgatcgggacggtcggcaacgccgcacgcagatctgcgaccgcccgaagcgcgatcggctgcacagcgcggcccgacaagccgccccctcgcgccgtgccgagggcctcacgaccgtcgtcgtaccactgcgcaaagagggtgttgatcgcgacgagtccgtcggcgccggcagccaccgcggcgtgcgccacgtcgacgatgcgatccgtattcgccgagagcttcacgaggatcggggtcgcaacctcgtcgcgcaccgcgcccaccacgcgagcggtggcgttgggatcgtgcgcgaacaacgcccggtcggcctcgagattcgggcacgacaggttgagttcgatgtagaccagcgatggcgcgatccgagcagcgcgccgaacggtctccccgtagtcgcgcggctgacgtccccagacgctgagggcgaccgggatcctggcgtcggccaaggagggccacgtctcagccagccatcggtcgatgcctggacccgccaacccgaccgagttcaccatgccacccggtaccggagcgaggcgaggcgctggattgccctcggtggcaacggtcgtcagcgacttgacgacgtgggcaccgagtcgctccagagccacagcagccgcgagctccgtgccgtaaccgccacacccggccgccgtgaggatggggttcgccaagacgagccgaccgcgtgcaaccgagaggtccgccactcaggtttcctcgtgataggcctgcagcggccgcacggtcagcggctgacgtgcgagcgcctcgaccgctgccacagccgcgcgagcggcctccagcgtcgtgatcaacgggatcttggcttcgagcgctgccgtgcggatgcggtaaccgtctcgccgcgggccactccctctcggcgtgttgatgatgagcgcaacctcgccggagcgcaccagccgtacggcatcgacgaaaccctccggcgcagcacgctcgccgagatcctcttcctcggtgaccttcgcgacgaggcgcgcaacagggacgccgtgagcctgaagccaggaggcggtcccctcggtcgcagcaaggtcgaacccgtgggccaccagtcgctcggcgatcgggacgagcgcctccttgtcgcgatcggcgacggtcacgaggaccgtgccctgctggggaagacgcgtaccggcggcgagttgtgccttggcgaacgccatcggcatcgtgcgatcgatccccatcacctcaccggtcgagcgcatctcgggcccgaggatgctgtcggccccgcggaacctgccgaacgggaggaccgcctccttcaccgcgacgtaactggtgacgcggcgaggcacgaagaggccctctcgttcgagatcacgcagggtcgatcccagcatgagacgcgtggcgatcttgacgagcgcgacacccgtcgccttggcgacgaacggaaccgtccgcgacgcacgcggattggcctcgatgacgaacaccgtgccgtccgccacggcgaactgtacgttgatgagcccgaccacatcgagtgcgtccgcgatcgcacgcgtctgggcctcgatctctgcgacgagggcgggagcaagtgagaccggcgggatcgtgcacgccgagtcacccgagtgaacgccagcctcctcgacgtgctccatgaccgcaccgatccagcacgcgccctcgcgatcgcgaaccgcgtcgacgtcgacctcgatcgcaccttcgaggaagcgatcgatcaggatcggtcggtcctgcgagatcgcgccctcggccgccagatcgacgagccgagagaacgcgctgcgcagctcgtcctccgagtagacgatctccatggctcgcccgccgagcacatagctcgggcgcaccaacacgggcaggccgatcgcagcgaccaccgcctccgcttcggcgagcgaggtcacggtgccgcccgggggctggcggatgccgaggcgctcgcacagggcagaccaacgccggcggtcctccgcgacgtcgatcgagtccggcgaagtgccgaggaccagcgacggatcgatgtctcgagccagcttgagtggtgtctggcctccgagcgacacgatgacaccctggagtgagccgagacgctgttcctcggcgatcacgtcgagcacgtgttcggtcaccaagggctccacgtacaggcgcgaggaggtgtcgtagtcggtcgagaccgtctccgggttcgagttgaccatgatcgcatcgacaccggcctcacgaagcgcgaatgctgcatggacgcagcagtagtcgaactcgatgccctggccgatgcgattcgggccagcgccgatgatgatcacacttggccgattcgatccgacggtctcgctctcctcctcgtaggtcccgtagtagtacggcgtgcgtgctgggaactcgccagcgcaggtgtcgaccgccttgtagacagcgcgcacccctacggtgtgccgatgctcgcgaaccgccgtctcgtccacaccgagcagccacgcgagttggagatccgagaagccccatcgcttcagatcgagcagttcgtcggcaccgagtgaggcgagatcgcggccacggatgtcggctgcacgcgcgacgatgcccgccatttccccgatgaaccacgggtcgatccggctcagctcggcaacgcgctcgatgctccaaccgcgccggagtgcctcgccaacggcgaagactcgctgctcggtcggcacagcgacgagcgtggccagggcgtcatcggagtacgcctgccaggtgacctcggccggatcggcgccgaaccctccccgcgaccgctcgataccgcggagcgccttctgcagcgcctcggcgaaactacggccgatcgccatggtctccccgaccgactgcatccgcgtcccgagaataccctcggcaccttcgaacttctcgaagacccagcgcggcaccttgaccaccacgtaatcgagtgccggctcgaaactggctggcgtgacacccgtgatgtcgttcatgatctcgtcgagcgtgtagccgatcgccaagcgtgtcgcgatcttggcgatcgggaacccggtggccttcgatgccagcgcgctcgagcgcgacacacgggggttcatctcgaccacgaccatgcggccgctggtcggctccacagcgaactgcacgttcgagccgcccgtctcgacacccacgcgtcggaggatctcgaacgagagcgaccgcatgcgctggtactcgagatccgtcagcgtctgtgcaggagcaacggtgatcgagtcaccagtgtgaacccccatcgggtcgacgttctcgatcgaacacacgacgacgcagttgtcattcgcgtcgcgcatgacctcgagctcgaactccttccaaccggcgatcgactcctcgaccaacacctcgccgaccggcgaggcgatgagaccggcccgcagcatcgcctcgaaggagctggggtcggtcgcgatcccggttccggctccgccgaggatgtacgagggtcgcagcatgagcgggtaaccgagctcgtcggcgacgtcccttccctcctcgagggaccgcacgagccgcccgcgcaccgccagctgctcgtcgatgctcatgagcagctggcggaatgcatcgcggttctccgcgagctcgatcgaggccggtcgcgccccgagcatccgcaccccacttcgctcgagcacaccagacgcatccagctccatcgcgagattcagcgccgtctggccgccgagcgtcgggagcaccgcatcaggccgttcggcctcgatgatgcgctcgagcacctcgagcgtcaggggctcgatgtaggtcgcgtcggcgaactcgggatcggtcatgatcgtcgctggattcgagttcgccaaaatgacgcggagcccttcctctcgaaggacccggcacgcctgtacgccggagtagtcgaactcgctggcctggccgatgacgatgggaccagacccgatgacgagcaccgactccaccttcggatccctaggcatgcgaacctccaccgagcagtgacagcagctcgtcatggatctccgacgactgctcgagcggaccgggggcggcctccggatggtactggacgctcacggcgccaagtgccggcaaccgcagtccctcgacgaccccgtcgaacaggttgcgccgggtcacctcggccggcgtgtcgagccggccgagcgacgcctcgtcgaccgcgtacgagtgattctgggcggtgatcgcgacgcggccggtctcctccaggcgaacgggatgattcgatccgtggtggccgaacggcagcttgatcgtctcggctccggccgcgagggcgaggagctggtgcccgaggcagatcccggcgatcggcaccacaccgagcaaggaccgaacgagctcgatgggacccgtcagtgcggcagggtctccaggcccgttcgacaggaacaccgcgagcgggtcgagcttctcgagctcttcgagtcgtatggtcgccgggacgacgacgagccgccatgggccacgcagggtctcgagcatccgctccttcaccccgaaatcgatggccacgatcggtcgactggagcgcgcgtgacccaagggctcgagctcgcgaggttcgcgacgggtgaccgcgcgcacgagatctcgcccttcggtaccgacggcgacccgaactcgctcggcggccgcgtccggatcaccggtcgtgatgatgcctggttcggcgccagcggcccgcaccaggcgaacgagtcgcctcgagtcgaagtcgacgaagagtgggacgcgtgcctcccagagccacgccgcgagggtggtgtcggccgcatggttcgacgccaccaccgagtacctcggcgccaagaccgcactcacccacggccggacgctttgcacgtcggccctgcggacgccgtaggttccgaggtgggccgtggtgaagcacaccatctggccgtagtaggacggatcggtgatggcctcgacgtagccgctcatcgcggtgttgaagaccacttcggcctcgacgtcatcgaggagcggctcgacaccggcggggatgaccacagcgccacggaacctcgcacccgagcgcagcaccaaccacgccggtattcgctgtaccgactcctcacgcacccacatagcggccttcctcgacaaccacctgacctcggcgcacgacccagcggatcgacccgaccaactccctcgtcgcccatggcgaattcgtcgaccggtacgccccgtcgccgccgccgatggttctcccacagggatcgatcacgacgacatccgccagctcgcctcgtcgcagctcgcgcgaacgaccgagcacgcgggccgggccgatcgccaacgcctcgaggacacgcacgagggcgcgccgcgcctcgtcgccaaggtgctcagagctctctggccgcgcatcctcgatcgagccacggagcacgagctggtcgagcacggcggtccaggtcgcagggaacgcctcgacgagaccgagcatgccgggtgctgccagctggaccggcaccgtcttcgctcgctccggatgcggggcgtgatccgtggcgatcgcgtcgaacgcgcctccgaggagcgcttcgagcagtgccatacgcgtcgcacgcgtacgcagcggtgggttcacgcgaaagcgcgcgtcgtggctcaggagttctgactcctcgaggccgaggtgatgcggcgtgatttcggacgtcaccgccaagccctctcgctgcgccgcacgcacaacattgacgctctcgcgggcgctcacatgctggaggtggtagcgcgcaccggtcgcacgaacgagagcgacgtcgcgcgcgaccagtgcaacttccgcaacctccggaacaccgtcgtagccgagacggtccgccagcgctccggcgttcatgacgccgcggctcagttccgggatggtcgcatgctgcgccacgacgacccccgtgctcgcggcggcctcgaggaccgcgaccgcgacgtcggcacgccagagggggtcaccgtcatcggagatgatgcgaacaccggccttcgccaggctctcgacgtcgacggcatgatctcctgcacgctccatcgtcgccgacgccgcctgcacgacctcgaccgggagcgccgcaaagcgatcagttgctgcgcgccatcgctcgacacggtcgatcgcggggaccgtgttcgccatggcaaccaccgtcgtaaagcccccacgcagcgcctggatggcgatgtcctccggcgtgtcggccacctcaccacccggccaccggaggtgggcgtgcaggtcggtgaaggcgggggccacgacggccccgggagcctcgatcacccggtcgccgcgctcgggaccctcgaatccggcaatccgtgcctcatcgatccgtatcggcacccgttggaggctcccgtcgacgaggacctctgcgcctgtgactacaatccccaccctgcctcctcggcgagcgcttcgagaacggcgacccgagtgggcacaccgtaggcgtactgcaggccatcgagcatccgaggggacgagagcacgatatcgtccaattcgaccccccgattgacgggcccgggatggagcaccacggcatcgggccgcgcacgctccaggcgatgcccgctcagctgaaacctcgcccgatagcccgacagatccacgcgctcgttcgctcccacgcgctcgtgctggatacggagcatgtagaagacgtcgacctcgtcgaggacgtcatcgattccatccgtgacgcccacggcaccaagggccttcggatccaacgaccactcacggggagcgacgccgaccacctccgcccccaccgaagcgagaagccgccctaccgaacgcgcgacgcgcgagtggcgcagatcacccacgatcgccacccgacacccctcaagcgcgccaaacgcatccgcacgcccgccccgagtccgagcaaggacgcagacgtcttggagcgcctgcgtcggatgctgaccgacaccgtcgccagcgttgacgacgatgccatcgaagaatctggctaccacgtcggccgtaccaacccacggagcccgcacgaccacgccactcgtcccctgcgcagccagcacgcgcaacgtgtcgcgaagactctcatccttgacgagcgagctgctctccggatcgatgcggacggtccgcccgccgagccgatcgattgcagcctcgaacgacagcgccgtacgcgtcgacggctccaggaacagcaacgcaacccgtcgcccctccagacaccgcgacgccgccgcgccatgaacgagctcgtcgacacgcgcgcccagcacgccaaggcgccccgcatcgagctgctcgacccccaggaacgttgcgctcatcgcccttccgcctcgatccacacaccggccgcatcgacaaccacgtactcgttacgcgctgtcggcaggttccgacccacgatgtcgggccgaatcggcagctctcgatgtccccgatcgacgagcaccgcgagcagcacacgctgcgctcggcccgcacgcaagacggcctcaagggccgctctcgccgtacgcccagtgaagaccacatcgtcgacgaggacaacggtccgtccctcgaccttgatcggcggcaaccatctcggatcacctgccggctccgcatcgtcgcggaactgcgtcggatccacgacgaccaacggtaccgctacggagcgaatcgactccaacgtgtcgacgaggccacgagcaaccgggacaccgccgtcggcgatcgccacgaccacgagatccgctccaccgcgcgtcgcctcgacgacctcatgcgccatccgacgcagtgaacgaacgatgtcgtcagcgtccaacacacgccgccgacgcatcgcaacctccgtttcggcctcacaggaccgtccttaacggctaccacgacgagcctagcgtgtcggctctcgccgcggcacggacggacgaacctcacacgcgcgcccgagaacgatcgatggcggggagcttcacgccccccgccatcgtcagcgaaccagcgagatcagccggaccctaccggcggctaccgagccgccgccgagcgaaaaatccgaacaccaacgacgctgcgaagatcccgatcggaatcgcgaacgtcatgtcagccgctgctgagtatccggtgacacttgcgaacattgacactccctcttgttgtcgtcagccccaacacgaaagacccatgacgctcctactgtatcgcgacgagaccagctcgggcgaccactaccaggagcactacaggaacaactctaccgacccacggcagcgaaccaccggccgatctacgggcgccgtcgcaccgaacgaccgatccgcacaccaccagtgagacgccccttgagcccgtcccgttcctcggcgtccaaccacagcttcatcttctgcgccccgagcacgaaccacacggccccaccgccgatcaccaagatcgccgccgcgatctgctggtcggtcatcgcgccaagaatcccatcctgatggaccaggtagccgtaccaggtgcccggtgcgaggcccatcgcgatacccacgcccatgatcaccatggccgaggtccacgcgacgatgacttgacggatgtgggtgatctggggcctgccgtctcccatcagcaccgccattgacagtgctcctgcagtcccttgggcaagcaacgtcgccgtaccgacgaccggcacggcgtggatccatgactgccagaaaccctcgaactgacccacgaccaacaggtcatcggcgacggcaaccagccagacccatcgcaccgcccacgcgacgagcggcccacgcccagcgagcggctcgtccgactgcgtcaactcgtgccaaaagagcgcgagcggcaccgccaggaccacaatgctcaccagtgcatgcaccgcgaccacagccgcggacgccaccatgaggagcggattcgccaccagaccgagcgccacgacgacccaacccactcgacgccacatcgaaacgcgaccgcgtcgaatcagagcagccccaacggcgacgacccccacgctgaggagcgccgcaacaacgttaccgatcacgccagcacccccttgcgacaactcctcgcccgacgacgaccctctgcatccaggccatccgtcgccgggaatcgtgctggcggggcacccggaaacccgcgtgccccggccaacactcaactcactcgagttcccaccctcctagtggaggatgaagtacacgtaccacgaaaagatctggaccaacacgaagaagatggagaaggccccgaagccatcgaggtttgctcggaagttctccgccaggcgatggctcgaaacgccgacgccaccgtcgacccggaagaactggtagctccgaatcgcccgcatcaccaacacgaagatccagtaggccgccaggaacaaagccaacgcattcatcacagcgaacgcgatgtacaccccggcatagccggaatacccaggcgggaacggcaatctcgtcaggctccagatctggaaccccatggcgagcagcagcaacagcacattagcgaggcctgccacgatgaagtccatcgtgaacccacgccgcaggcgccgattcgcaaacagctgcaccagcagaccagccagcgggagcagcatgacgaggaagccaaggatcttcgaggccgtcaatccgtgtggatcccacaggccgttggagttcaacgactgaaggtagaagaacgagaagtagatcccgccgtagaacgcagccgcaaccgggatcagcgttcgagacgccgtccacagcgcacccagctgcgcatcatggtagtactgctcctcatcgatcgcaggcggctgggcctgcacacccgtagccactactcctcacctccagcgacgacagcggcctgctcagccgacggatggagctcggcaaccggaccccgatccttcacgccgtactggtacgggctgcgaagcacgaccggaatctcctcgaagttgtcggccggtaccggatagccaacctgccactcaagaccctccgagcgccacgggttcggaccagccggcgtccgccagacggcgagcgaccagatcagattgaacacgtagagcaggattccgaagccgagcacgtacgaggagatcgacgcgaactggttcaggtgctggagccgaagggcgtactcgaacacgcggcgcggctgacccagcagaccgaccatgaagagcggcaagaaggtcccattgaagccgagcaggatgagccagaaggaccacttcccgagcttgtcgttcaaccgcacaccgaacagcaacggtgtgtagtagtagatcgcgccgagcacgatgaacacgagctgacccatgatcgtgaagtggaagtgcgccagcacgaagaagcttccgtgcaccaacgtgtccaccggcacgtccgagttgaacactcccgtcacgccgccccagaggaagttccagaacacggcgagaacgaagagcatcgggacctcgaagcggatctttgcgcgccagagcgtgcccatgctgaccaggtacaagaagccggtcgggatcgagatcagctccgtggtcagcatgaacagcggacgcatgtccgggttcatgcccgacatgaacaggtgatgctgccacacgaagaagctcagcgcagcgataccgatcatgcccgccgccgaggtcttgtaggcaaagaccggcttgcgtgcgaagaccggcaagagctccatggtcatcgcgaagccaggcatcgccatgaggtagacctcgggatgaccgaagaaccagaacagattctcccagaggaagctcgagccgccgtggcccgcatagagcatcgacgtgcgcacggcacgatcgagacccatgatgaagaggccatctgcgaacaccggaaccgagagcaacatcgtgaaggccgtcgtcagcaaaccccacaccaggatcggcatccgagaccacttcatccccggcgcgcggtagttgatgatcgtcgccaccatgttgagcgaaccgatgatcataccgatgccgaccagagcgaaaccgacgtcgtaatcggactgtccgggtccaccctggatcgagagcggtgcgtagccagtccaaccggcctggaatccaccctgccacagcgccgagatgatgaccatgtacgccgcgacgaggagccacagcgacaccgcctcgaggcgggggaaggccatcttcttcgacccgatcatgagcggcaccaggtagttaccgaacggaccgagcacgagcgacgtcgccatcgccatcatgatcgttccgtgctcaccgaccacctcgatgtaggtatcggccgcccagatgtggtacgtcggcgacaagagctccgtgcggatcgcaagcgccagcaaaccaccggtcaggaagaacagcagcgtgacgaacaggtactgcacgcccacgaccttgtggtcggtcgagtacgtgaagtgctcccagaacgtccgcttctccgacttcggcgggtccttcggttcccatccgagaagcttctggatcgggtagttgaagaccccgagtccagcgagaaagcctacggcaccgaagatgagtgccaagtacacggcgatctcgttctggccggagttcactaccaccgtatagcccgaggcaatgaagttgccgagccaatggccgaacgcgtagaagatcgcgcctccaacgaggccagtgaagaagttgcccgtgaaccacgcacgtgcgaacttcaaccctcgagcctcgaggtcacgctgatcgacgatcgccgcgctcggcgacatctcaacagccatcgtttcgttcccttcctcagcgttcctagtacgcaaccgagtgaccgttggggtcgtagctcgggtagtagccaccaccggcccccgagtacgacggcgtgtacgtcaacgcgaacggcggcaggagcttggtcacaccagcgttcgcagcctgcatgttcgtcgcccacgtctcgaacgacgatgctggcaacacctcgccgtagttgtacatcgcaccatgccagatcccgcaaagctcgtcgcaacggacggtgatcttgcccgtctggctcgtcgtctcggtggtcgcgacgttgttgacgcccggattcgcatccgccttgactccgagctgatacgcccagaagtcgtggatcacgtccagagacgtcacatcgaagaccacgcgcgcgttggtcggcagatacagctcagtggtctccatccccccgaactgcgggtaccgataggtgaaccgccactgttgcgcgatgacctgcacgacgagcggcgtcgagcctcccggcgtccacgccccctgcggcgttgcctttgcccatgagtagttccagatcggcgacgggccagacccactccccatgtcatggttcgcgatcagctcgtaggtaccgaataccgccaggccgagcacgagcacggtcgaggccacgtaccagattccctggatcttccgattgccgaagaggacaatgccatcctggtcctcttcacccttacgggctcggaagttcacgagtgcaaaaccaccgtacacccagaccatgaacaggactgggaccacgagcaccatcagaatcttgaagtcgaactgctgggccgcagccgacgtcgtcatggtgccgggcggcatgtggggcccccacacgaaccacgtcagatagtcgacgatcgccgtcaggacgaaccagaccgcaaagatctgccaccccttggatcgcgcgaaagccttgcgctcctcacgctcctgttgtgtcagcgccatcacgccaccaccttgaagaagccagccatgtagccagtctcggccataggaccaccgttaccttcgaggtagccaacgccgcacgggatgaagcactgccagcggtaggtgtgcgtcgtgttgccggagtagaacgtgaaggtgatcacgttgtgcgcctccgacggattgcacggaccctgctggcagaagttcttcgcattgccgttgacgccccacaccgggatgttcaggccgagcgacggggcatcgatggtgtgtgcgacaccattccccgaggcagcatcgagaacgctgaccggcttcccgttcagatactcgacaccgccctgcgtccccaggaccttgccccagtaggggttccgcaacggcccgcccgagtcgtactcgtagaccgtcacgtgcacgtacgtcttctcaggaacctgatagatcgtcgtgcgtacccacttgccagcggcatccttcgcgtaccagcccacccattgcgggtgaggaccggtgccgacggcaccctcgacctgcaacgtcaggtcgacggtgttcggctgtgtcggcgacggagttgccgccaccgtcggcgggtacgttcgcaagtatccgaagatgccaaacaggatcaacccgatggcgatcgccgcggatacaagaacgatgcccgcccttgctcccttagacaacctcaaccccctatcacctagggccttccccactgcgcctccggcgaggctgcgagcgcagctgctcgaacgagctcactgcacccggacgaacctggtgctaaccgtggtgggccagcgcgtccaacttccgaagccagttctccaaggtggacgacgaaatttgaccctgcaccgcaccgatgacgcgaccgtcgggtgcaacgaagaaggtgtcagggatgcccacgagcaggtaggacgactggagcgatccggcgtcgcgcacgactggatacgagacccccgtgcgcgccagaaaggcgagtgcagccgatcgctggtcattttcgtccacaccgaggaatgcgacgctcccggcggaagccgccgccgccttggcgagcatcggcgtctcggcgttgcacggtccgcaccacgacgcaaagaagttgatcaccaacggacgcccacggaaggatcccggtccgagcttcgacgcgctcgaatcgttcgcgaggaccggcagcgaaaagccaggcaccgtacgacccacgagggccgaaccagacgacgaggccgtgagcgaggccgaggccccgttcgttgcggatcgcgcaacacccacggcgtacacgacgtacccaaccgcgaccaagagcgcaagcaccatcgcgaacatgaagacgcgggggcgccggcgaaggtcggactgctcgtaggtgctctcactcgtcgtccgcgtcacctcgacctcacgatgacatcgacagccatcccgacgaacagcaaggacaggtacgtgatggagtaggaaaacacgcgcatcgccgccttcggagagagggagcgcaggagacgtaccgcataccacacgaaccccgcaccgagcaggaccgcagcggcgtcgtacacgaggccgagcccggcgaccgggcccaggacgagggccaggagcaccagcacgaccgagtaggccacgatctgccacgccgacgcgcgacgcgaggcgaccgaaggcagcatcggaacccctgcagccgagtagtcgtcggcatagcgaaacgccagcccccagaagtgcggcggcgtccacacgaagatgatgaggaacatgagccacgcggcgagcgagagctcgtcacgcaccgcagcccatccgacgaggaccggcgccgcaccggccgctccaccgatcacgatgttctgcgacgtcgatcgcttcaaccacatcgtgtacacgccgaagtagaacagcgccgccgcgagcgcgatcgaagccgcgagcacattggcgcccacggacaggatcgcaaacgcggcgacctcaagcgtgacagagaagatcagggcgccccggggcgacacatcaccggtgacgagcggacggcccttcgttcgccgcatgaccgcgtcgatatcacggtcgaaccacatgttggccgcgttcgcaccgcctgccgcaagggtgccaccgaccacggtgatcgcgatgagcgagagggatggcaggccacgcttcgccacgatcatcgccggaaccgtcgtgatcaacaggagctcgatgatccgcggcttcgtcagcatcacgtagccgcgggctgtccgcacccagctccgagagtcttcgaccagcaccggcgacacccctcctcatcacagccacctgtccagtcattcgggcaggacggcgtgctcagcactcgttatcctaccaaccaggtcgtcatctcgtcaaccggaagcaggctttcgtgcatacgcaagacacatcgcctcggcgttcgctcagcttgaacccagccgcgctcgaccgcgcgccgggtccctccatggttgggcaggtcaggggcctgctgtccggacaagctgcgacgacgctggtcgttgtcgacccagcatggatccgctacttgacgggattcgacggttcccacggcaccctactgatcgatctgcgcgatgaggatcggcaccttctgtgtacggatggccgctacgtcgaggctgcgggtcgggcacttggggcgcgagggctcgacgggctcgttgaggtgctcggagacgaccccctcaccacgtcgcatcaccgagacctgctgcgcgcaccactcgctctgctcggctcgtgttggtcgctctcgaccctacgactgctgatggagatcgatccgactcccatcgacgcacagcctctcctctggccgcttcgggccgtcaagcaaacctgggagctcgagcgcatccgcgcggcagcccgactcgcggacgacgccatggatgctgcccttgcgtcgctcgccgacgggccaatctcagaacgccttctcgcggcgacgtacgagttcgagctgcgtgcacgaggagccgatgaacccgccttcgcgaccatcgtggcggcgggatctcatgcctccgaaccgcatgcgaggccgagcgagcggctgatcaggccaggcgacatcctgctggtcgacttcggcgcaacggtggacggctatcgctcggacgccacccgcacgatgctgccgagcgaaggagcagaccctcgagtccaggcgtactgggacatcgttgcggcggcccagagggccggaatcgcagccgcgaccgtcggcgcgtccgcgcacgacatcgagacggcagcccgcgccgtccttcgcgaggccggcgtcgaagagctcctcctccatggagtcggccacgcgctcggcctcgagatccacgagcggcccttcaccgcgcacgatcgagatcccctcgccgaagggacggtcatcaccgtcgagccgggtctctatgtacccggagagcttgggatccggctcgaagacacgatcctcgtgggcgcagaaggcccagagtgcttgacccggcccgcgaccgagtctcgaacgagaccaggttccgcagctcgcgtgcgcagctaagctggtagctcgcatcgcgcggacgtgcgtccgttgcgcccattcactgttccgcctcggaaggagcccctatggcagtcgctacctcgacgaatgacctcaagaatgggatgaccctggacctcggaagcgacggcctctttacggtggtggagttccagcacgtcaagccgggcaagggcggagcgttcgtgcgcaccaagctgaagaacctccgaaccggcgcggtcatcgaccgtacctaccgagccgacgagcgcatcgaccaagccatcatcgacaagcgggagatgcaagcgctctatcgcgatcaggacggctgggtgctcatggacacgcagagctacgaccagatcacggtggatgcggcgaccctcggatccgcgatgcagtacctgcgcgaagggagcacggtgctcgtcctcagctacgaaggctcgatcgtcgccgtcgaactgcctgctgctgtcgagctgaccgtcaccgagaccgagcctggtctccaaggcgaccgagtctccggcgcccgcaagccagccacgctggagaccggactggtcgtccaggtccccctcttcgtgaacgtgggtgacaccgtcaaggtggatacgcgcaccggcgactatctcacgcgtgcctgaccgacgcgacgactcgcacgacgtgcgcgccgtttggcgcgagcgcgtgctggagctgctctacgaagccgatacgaagggcgaagcgcccgcggacctccttcggggggacgagccagcgttcatccgcgaacggatccgaggtctgacggagcgacgcagcgagatcgacgcacagttgacggcccacgtcatcggatggcagctcgagcggctcgcacccatcgaccgtgccattctccgactggcgaccgcagagctcctggaagcatcgacgccgccctctgtcgccattgcagaagcggtgaaactcgccgaccgctattcaaccgaacgttcggccgcgttcgtcaatggggtcctcgcctcgatcgccgtcgacatcgctggcgagggccaccgcggcgagcccgaccgcgaacccagctagctcgcgacgcgaccgagttcggcacgcaagaagctgggcatgccgctcgtcgagctcagctccacccgttgaggcgagatgccgagctggcgagaaacgctcgcaagctgtgcgttcgctgttgccaggacggtgtccatggtgtgcaggcgccctgcgatcaacgtgacggtgctcatgtcggtcggatgcaccagcagcgtcttcatgtacgcgagcaccgacgctgcgttcgggaacgcccacgcgtagacctccttgaccaccggcgtcaggttgaagtggttcaaggagttcggcggtgcataggtcgccaagttgtagaggtccgagttgaccgcgatggtgcagtactcctcgtcttgttcgatgatcgttcgcgcctcggcgagctggttggacgccttcgagacgatcgcaccgagcgcccgatagccgtcgttgagggcgaccgcacagccccctgcgtcctgctgcatcgtctgcacggcgccgcggaaatcgacgcgctcttgggcaacggtcacgcgctgcgggtacacgatcgcggcctcgatggcgacggacgcgacgaccactgcgccgacgatccagagcaccttgcgacggcgagcaggcgtccggggctcaagcgttggatcagctcggttgacgggtcggggcactgtgctcctccagatcgagtggttcagatcgcgtggcgacggggccgctgctacgccctctcggcgagggccggttcgctctccagtctacggacccacacgcactcgctctcgcaccatctccacgagggcgagcacggcgagttcataggagcggggcccgaacccagcgatggatcctgccacgacgcgcgcgatcgtcgaccgatgacggaatggttcgcgagctgccggattcgacaggtgcacctccaccacggggatcgtgatcgccgcgatcgcatcggcaatcgcgtacgacgtatgggtcagcgcgcccgcattgagcaccacaccatcgaccgatcgaggcgcacgctgcaggagttcgatcacccgagcctcgctgttggtctgctcgaaggtcacggctgctccgaccgaggccgcacgttctccgacgcggcggcgcacgtcctcgagcgtctcggtcccatacacggtcggctcccggaccccgagcaggttgaggttcggaccatcgatgacgagcaggcgcaccgccgtcatgcgcgtgcctcgtcgattgccgcgacgatcaccgcctctggcacgccgtggaccagctcgagaccgctcggtccatcgaggaccatcgcgagtgaccctcggtgcttcttgtccgctgcgagaaagaccatcacctctgcggccccgatccacggcggcacgcgatgtgcgaggccgagacgcgccaccacctcgacgtgctggatcacgcgatctcgcgtgatcctgccgagacgctcggcaacgatcgcctcgaccacgaggccgatcgccaccgcctcgccatggctcaagggccggcgacgcgccaaggcggctgcctcgatggcatggcccaccgtatgcccgtagttcagcagtgcgcgctcaccgtgctcgcgctcatcgcgctccacgacgcgcgcctttgcctgggccgcctcggcaaccgcctcgtcgagcgggagctcgaccagacgatcgaggccaaggaaggcgtacttcgccagctcgccaagaccacttcgccactggcgacgaggcagtgtcgccagcacatcgaggtcggcgacgactcgtcgcggctgccagaaggcgccgacgagatttttaccggcacgcaggttgaccgcggtcttgccgccgatggccgcgtcgaccataccaaggagtgaggtcggcaccgcgacgaagtcgatgccacggtggtaggtggcggcaacgaaacccgccaggtcggtgaccacccctccaccgatggcgatgaggccatctccccgagtggccccggcgctggcgagctcctcagccacccgctccaccaccgcgagccgcttggcgcgctcgccattgggaacctcaatgacaggccagggccatgacgcagggaggggaatcgcggcttgggtcaccacgaaggcctggcgccagtcctccgggacgatctcgcgagagtcctggaggatgccgctcccgaccgtgatggccacctcgtgctgtggcgttcgcatcgagaaccggcgggtcgcacggcctcgcgctgcccacgctgatcggagtgcgctcggaggaccttgcaccatcagcgctccagcgcaccgtcgcgccacggtagcgccgcctcgtgtgcgagatagctctcggcgttgcggcgaaactcggcgatggagtccccgccaaactttctcagggcttcgtccgcgagcaccaaggccaccatcgcctcggcaaccacgcccatcgcgggcaccgcggtcacgtcggtgcgctcgcgaaaggcgatcgaccgctcccccgtggcgagatcgaccgtctcgatcacaggccgattcagcgtcgcaaggggcttcatccacgcggttgccacgatcgggctcccattgctcacaccgccttcgatgcctccagcgcggtccgtcggacgctcgagctgcgaacccacgatggcatcgtgcgcgagcgaccctcgcacgcccgcgacctcgagcccggcaccaatgctgacggccttgacggccgggatcgacagcaacgcctgaccgaggaggccatcgagtcgacgatcccagtgcacgtaactccccaacccgaccggcacgccgtgcgcgacgacctgggcggccccgcccagcgagtcgccaaccttcgcggccgctcgcacctctgcaatcatcgccgcctcgacagccggatcgagacagcgcacctcggaggcgtcgatacgctcgcgatcaccaagcgtcggcacggtctcgacgctcacccgggcggcacccagctgcacgacgtggctcacgatcccgacaccgagaacgccgagcagggccttcgcaacggcacctgctgcgacccgagcagcggtctcgcgtgccgacgctcgctcgagcacgttgcgagcgtcatcgaagccatacttctgcagaccggcgagatcagcgtgaccaggacgtggcgccgtcaacttccgggcggtctggcccggatccggcgacatctcctcggtccacttgcgctcccactccgagttggcgatctcgagcacgatcggcgatcccaaggtgcgtccatgacgcacgccgccgatgatcgtgagcgcatcctgctcgaagcgcatcctcgggccccgcccgtagcccaagcgccgccgcgcaagctcagcgctgatggcgtcgccgacgagctcgagtcccgcggggacaccctcgatgatgaccgcgagcgcacgtccgtgcgattcgccaccagtcaaccagcgcagcatgcgctcaggctagcgagacgccgagcgcactcacgtgagtgccgtgagccacgatcaaagccacgagcgcacccaccgcgatcgctggcccgagaggcaggcggtcacgatggctcccgccgcgcaggagatgccagagcgcaccgagcgcgccgaggctcaaggccacgagcgccgcgaggaccgggacccaccagccgagcggcgcctccacggctccgagcatgccgaggagggcaatatcaccacgaccgagccccccgcgcgacaaccagcgtacgagcatccacgcgcccaccacggcgagcgcaccgccgatcgctgcagccacagcgcgcagcgcgtggggaccgagtccgaagatcacgacctccgtgaccagcgcaccatcgacgagcgagcgcggaatgcgtcgggtctgccagtccacggtcgcaccgaccaccgcgacactccaggcaagcgcctcggcgacgagcgcggcgcccgtcacgcccgaccagctgagccaccacacaccaagacccgccgccacgccagcgccaccatgcaggaacgtcgcccgtcggctcttcaccgcgccccgccgacgggcgagcggtcccacggcacaggcgaccagagcggcggcaaccacagcggctgtcgcccggacaacagcgacggacacgtacgatccgtcgaccgagtgcctccaaaggtttaccgttcggcaagatccgaccactacggtcgagccatggcaccgatgagccagagcgccgacgaccaggactggcgagcattcgacgggctctggaatttccgacccgtcgaggcaatccttgccaacggtcaccgactccgtcccggcaggcttctgcgctcggagcaaccgtaccgactcgacgccacccaacgacgccaactcctcgagcgctacgcgattggcaagatcctcgacctccgaaccgccgaggagtgcgccccgacggagtccatcgacgcgccacgaacgcacctaccgctcccggacgtctcgcgtgacccacgcatcgcagatggttcgcgcaacctggccggtgcctaccgcgcgatgctcgacgaccacgctccgacgttggttcgagccatcgacgccatcggggtgccaacgccggtgctcgtccactgcacggccggcaaggaccgaaccgggatcgtcgtggccctcaccctcgaactcgtgggcgctcggcgggacgacatcgtgcgcgactacgtcgagagcggacgacgtctcgcggcgttgaccgaacgtgccttggctcgcggctacgagccgacgtggcgcgagctcgcgcccgaagtgctcggtgcgcctccggctgcgatcatcacggttctcgagacggtcaaggaacggtggggctccgtggatcggttcctcatgacgttcgggatgacgccaatgcgcatcgaggcgatccgaagctcgctcatcgcatgacgccacgattgcacgcgcgccaaccccaacggctccgcccgaggccggcgtgtgcggcgccgcatcacgagcgctcgcgctcagtcgctcgcgtcgaccccttcaagggccttggcgagcaggttgccaagctggcgcaattcctccggagtcagtcgactgccaagcgcgccgtcaagcgtcgcgaccacaacgggctcggctcggcgcgccaccgtgcgtcccgcctccgtgatcaccgcatacgtcccgcgccgatcggtcgggcagccacgccgcacgacccactcggcttcgaccagccggtcgactcgccgcgacagcgcgctgcgcgacaccaaggcagcatcggcgagctcggacaggcgaacccgtccctcgggagcgctgtcgaggtggtggagcaccaagaactccccgagaccgatgccgcacgcgctctcgagctcacgatcgagcaggtcgacgagccggccctggagaacgagcagcgtgccgaacacctcccgggtcagggggtgctgggctgttcggacaggcgtcgacggcgatactgcttgcatgtgcaactacaactcctatacttcagcatagtcaggaacccatgacacaaggaggaaagcgatgacgctgagcgcacaggatctcggcatcgacacggggcggtggaacatcgacccgacccactcgacggtcgagttcgtcgtcaggcacatgatggtttcgaaggtccgcgggagcttcgagaagttcgagggctacgccgacatcgccgacgacgtcacgcagagcacggtcactgcgaccatcgacgcatccacgatctccacgcgcgacgagaaccgcgacaaccacctccgcagcccggacttcctcaacgtgaccgagttccccaccatcaccttcacgtccacccgcatcgagcccgcaggtgagaactggaagctcgtcggcgaactcaccatccgcggcgtcacccgtcccgtcacgctggacctcgagttcaacggcacctcacccgacccgtacggtgggaagcgtgccgggttctccgcgaccggcgagatctcccgcaaggacttcggtatcgagtggaacgctgccctcgagaccggtggggtcgtggtgagcgacaaggtcaccatcaacatcgagatcgagctcgtcaaggcgtaaggatcgagcgaccatactaccgagaaggggccgggtccgaagacccggccccttctcgcgtaccacgagcgcacggcgggcctcacccggatcccgatcgcggtcacgacgagccggtcacgacgagcgaggtgcgcaaaccagggccgtcgcctacttcttctcaggttggtagtacgggttgttgccggcggcgtgattcgtcacgtcgacgacgtcacgaatctcgggtacggcatctcgaatggcgaccgcgatgccctgcgtcagggtcgcagaagccagtccacacccctggcatccaccacccatcaacacgtaggccacctcgtcgacgacgccgacgagttccgcatacccaccgtgagctgcgatggccgggttgacctgctcctgcaggatgctgtcgacacgtcgggcgagatcgctcgtgagcgcctcgggaccgaactctggtagatcgctctggcgcgtcggggcgttcggattttcaatgacgaggtcgccatcgtcgccgacgtcgagcgtcgcgtcgcgcagcgcctcgatcgacgccgcaggaatgacgacaacgagatcgcccacctcgacgatggcgtctgcaccggacgccatcgccagctcctgcaggtacacgtcgtaggtccactggtcgcccgtcgaaccagtcacctcgatccagagcgcgatcggcgcctccgcttgctcttcggcgatcgccgcagcgacgacctccgctgcacgctgcgacacagccatcagtcccaccgcgcgcctccttccgctcaccactacgatcctatcgacgtggcacgccttgccctcgtggtccccgcgcatagttaccgagggaacgatttcctcgcagctgcaacgccacaccagctcacgatcgtcaccgatgccgaggagccactcggaggtgaccacatcgtgcgatcttcgctctccctggatgcgtccgagacagatcgcctcgcccaggtcctcgtcgagcgcagcgtcgaagcggtcatcggcgtcgacgagtactccgtccagctcgcagccgatgtctccgatcgcatgggactcagccacggccgtggggaggcaatccggcgggcgacacacaaggaccaactgcgcagcaccctcgatcgcgcggaactgccacagccatcgtggcacgtggccgacagcgtggccgccatcgacgtcgactggctcgagcgcgcgctcgggcctggcccgtgggtgctcaagcccctcgaccgaaccgcctccgagggagtcgtgcgcgtcgatgcgtccacactcgcctggggacgcgaccaactcgcagccgtcgtcggatcgcacgcgccggtcctcgccgagaccttcgtaccgggagccgagatcgccgtcgaggcgatcctgaccgacggcgcactcgagatcgtcacggtcttcgacaagccagacatcggcgatggaccgacgttctgggaagcgacgtacctcgctccgagctccatccctctctcagtgatcgaagaggttcgtgtgctcatcgaacgagctgcacgcgccctcgacctccacacgacgccgatccacgccgagttacggctccctgaaggtcggccggtgatcatcgagctcgcgccacgcaccatcggcggacgctgtgctcgagccattcgtctcgacgacggtcgtcatctcgaggatctcgtcatcgagcgggcactcaaccagccacgcacgatccctgcggcccgccgtggtggccccatcggtatctggatgctccccacgccccacgacggcaccttcgagggtctcgacggcgtggaagtggcggcagcgatcccaggcgtcgagcgcatcgagatgaccacgaccgccggcaccacggtgtacgctcccccacgaacccgcagctatctcggcttcgtcttcgtgagcggacgaagccgccgacgcgtgctctccacgctcgatcaggtccgttccgtgcttcgtccccgtgtcgctcccgcttcctagactctgagcggtgaccgctccgcgtaccgacgcagcacgagtactcctcatcaccacctacgacctcggacaccgtccccaactcgcggcgttgctccaggccgagctcgccgaccgactcacggtggtcgacggcaaggccgatgccgcagtgctcgcgagcgagattcgatccgccgactggatcatcctcaccacaccgatgctcaccggcgcgctgatcgccgagcaggtcctcgctgctcacactgacctgctcgccgctcggcacgtcctcctggtcggcgcctacgcaacgacgacgctccacgcgctcggcgagacacaccacgggatcatcgcactcgaccgtgacgatcctgagctggtccttggcgccatcgaacccgagcgaccgctccgccgaggcgggcgtcgtcactaccgcgtgacgacgagcgaaccgctggaccgctatcgacacgccgagcgcaacgggagctggcagctcgccgggtacgccgagaccacgctcggctgccgccatggctgcctgcactgcccggtcgccggcgcgtggcacggtcggatcgtgacgctggacgcgactgacgtgctcgccgacatcgatcgccaggtggaagcgggtgcctcccacctgtcactgggcgacgccgacttcctctcggcgccccgtcatgcgctcgccatcttgcgctcggtccacgaacgtcacccgcagctcagcgtcgacgtcaccatcaagattgccgagctcgcagcggatccaaccctccccgcgcgtctcgccgaactgggcgtcgccttcgtgatctccgcggtcgagtcgcttcgcgacgacatcctcgaccgcctgggcaagggtcaccacgcgcacgacgtcctggcagctcgtgacgcgctcttcgcagcaggcgtcggcctccacccgaccttcatcccgttcacgccatggagccgcctcgaagaccttcacgacattctccgcttcgtgtgggattcgcatctcgaagacgtcgtcgaaccggtgcagtacggcatcgagttgctcgtgccgacgtcgagcctcctcgagatcggccccgagttcggcgacttcgacccagcgacgctgagtcggcggtggaatccgagcgaccctcgtctcgatgggctcgctccgcgcatccgcgccatcgcagcgcgcagcgctcgctacgacgagggcttccgagccgtctgggaactggcagggctcggtgctctgccgtctcgcgggccgcgccgagcacccgcgcccaccttgatgagcgaggcatggttctgctgcgcagcgcctccacgatgaccgacctcgacgacctgctcgatggtctctccgacgcccagcgcgaggcggtcctcgccccggcgcccgttcgggtcatcgcacccgcaggctccggcaagaccctggtcctgacgcgacgtatcgctgctcagatacgactcggcgccgtacgaccccgcacgtccgcagcgctcacgtttacgagagccgccgccttgtctctgcgtcaacgcctggctcgcaccctggatacgaccttgccgatcaccacgacgatccatggtgctgcgctcgtctggctgagcgaactcgctcggctggaggggaaggccctcccaccagtcgtggagtccgaaaccctcgtgcgcgccgcgcttccgaacctctcgccggcggagcacgcggcggtgagagctgccctccgcggccagcgaccgacgtcacccgcgcacgaagcgcacgtccgcgcggtccatgagctccgacgacggcgacgcgtcatcgatctcgactccatcgtcggagagctcgcacgacaactcgaacgccagcccgaacggcgcggactcatcgggatcgaggcgctgttcgtcgacgagttccaagactcgacgcccgaccaacttcggctgttccgcgcgctcctcggtccggatctggccggactcaccgtggtcggcgacccgaaccagtccatctacggctggaacggcgccgacccgaacgtactcaccgacctcgaaccgcccggcttgcgcaccgtgacgctcacgacgaactaccggagccgcgacgagctcgtccgtcacgcgaccaggatcctcgatccgcagccacacgttcgaggagcacgtccaggcggtcgaccacccacgctgcgcggctacgccacgccagagcgagaggctcgagcgctcgtgcgcgaactcggcgggctccacgcgctcggtgtcgcctggcgtgcgatggcggtactctcccgcaccacgcgcgcactcgagcccgtgacggcagcgctcgaggccgccgagattccagccgtcgtgctcggacggacgcgcacggtctcggccatgctcgcacgactgcgctcgctgcgagatcgacgcgcgaccgtcgggcacctgatcgacgagctgagttcgatgcaggtcgacgacccttcgcaccagcacgagctcgaccaagttcgcgacatcgccatcgaactccaccgtgtcgatccactcgcagacctcgcgaccttccaggagatcctcgagcagcggctggcacggcgtctcgacgcggtcaccatcgcgaccttccacaaggccaaaggcctcgagtggtaccacgtccacgtcctcggcgtcggagagcgcgcactgccgcatccgcgagcacggacgagcgcgcagcgcgaggaggagcgaaggctgctctatgtcgcgatgacccgagcgaccgattcgctcagcgtgagctggcatggcggggggccgagtccgttcctcgcaccgatcgtcggtgatcgagcacccctccgccccacgccgagcgcagcggccagaggagccgtcgcgcgccaacgcgcgctgcgccatgccctcgtcgcccaacgagctcgcctggcgcgcagcttcgcgatcgcgccgtcgatgctgctgagcgacgagagcatcgagaccttcgtacgaaccccaccacgatgcgcggacgacgtggtcgcgcacctcacacgcgttccgccagccaggcgccgcgcggtcgctcgcgccatctgggcgtgcgtcagcgcgcctgccgacagctaagcgagatccacgacgagcggtgcgtgatcggaagggcgaggagcccgccgggcctcgatgtccacatcgaccgcaaccacgttgcgcgcgatgtcctcgctggcgaggaccaggtcgatgcgcatccccatcccacgacggaaggcgccctgccggtagtcccaccaggtaaagcccggatcgtcagggtgaagcgcgcgatagacgtcggtgaggccgagcccgaggagcgcatcgagcgcgcgtcgctcgggcaacgacacgtgggtcgcgccttcgagcgcggacggatcccagacgtcgtggtcgctcggtgcgacgttgaagtcaccgccgaccaccacaccgtcggcaaccaggtctgcgagatgtgcccgcagctcggccagccacgtcagcttgtagacgtagtgcggatcatcgagcgcacgaccgttcggcacgtagacactcatgaaccagcccgcctcgagcctgaccgcgagcgcacggggttcctcggtcgccagaggcgctcgcgcgaacccggtcccatagcgcacctcgcgaggagcctcgcgggtcaggaccgcgacgccgttccaggcccccgtgccccagtgggtcacgtgatagccgagcgagacgagggaatcggccgggaactgatcggtggccaccttggtctcctgcagcaggagcacgtcgggggcgacacgctcggcccacgccaccaccaactcgatcctggcgcggatcgagttgacgttccaggtcgcaagccgcatggtcacgcggtcggcgcgatcacgaacatcagctcgacctcggcgacgatcgcgtcaccgaccctggcatgtccccgaccgcgtccggccctcgtcgacagcgaggagagctcgacctccaatcgcagctcgtcgcccggcaacacctggcgccgaaaccgtgcccgatcgaccccaccaaacagcggtagccgaccagcgaagcgctcatcggcgagcacggccgccgcgcccagttgcgcgatggactccacctggtagacgcccggcaggaccggccgccctgggaaatgaccggccaggatcggcaggtcgaccgggacgcgccacctgcccgcggctcggagacccggctcgagatcgtcgatcgcgtcgaggagcaagaaggggggtcgatgtgggatcaacgtggtcggatcgatcgctgccacccgtcctcctcggtcctccccgatcgcgcccctcgccgcgccgtcaccggcgacctcgagcggacctaccctagcgggctaggcgacgtcacgaacctgcgacttcacggccgcgagcagggcaggcgtcactcgcttgagcccgtgcgcactcacgacgtgctcctggatgtgggcgagcagttcctcatccgtcgccgccgctgcatgccagtcgcacagggggatcacatccccgcaccggaactccttcatggttggccctccttcttgacgaacactggatctgtgacccggaccacgccgtcgagcccaacgcactgccgcagcgccatcgccgcgaggaacccaccgaggtctgcgcccggaaggcccacgttgcgctggccacgacttccctgtggcggcacgcttcctaccagcgtcatggtagctcaccgcgacgacgccggaccgaggttggcccaccttgcacccataccatcatcggcgaccgtccaagacgcaccgaacgacccgcgacggcttcacgacgccacacgccgcgccgtcggcgtcgacgaccacgatcggctcgagcgcaccgtcgtcgcgcacgagcgcccgttggagcagcacgtcgagggggtcttcttcgtggacgacgaggggtcgttcccaacgctggcgtcgctcgccgttcgaccaacagcagccgacggccaggggtttgcgccctgtcggctgcagcacccaccaacccgtcggcggtgcgtcggccagtgcgccgatacgttcggcaggctcaaggtactcgccagcgcagctgtcgttcgaacgtggcctgtggacgtgcatgagtcgttcacgcagcacctggtcgagatcgatcggctcgggtgatggacggccaaacaggtaaccctgcgcaagagggatgccgatccgcacgatctcttcgagttctccgtaggtctcgaccccctcggcaaggagccacgcatcgagttcaccgaggaatgcgccgaaggcggatgcgagacgactgcgcgccgcgtcacggtcgatcccgttcacgagccctcgatcgagcttgacgatctccggtcgcacgacgaggagcgccgcaaggcccgcgtacccggcgcccgcgtcgtccatggcgatgatggcgccgcgttcccgaaggaggtcgagtctcgcggggagatccggcaggtcatggagcggaacgtgttcggtgagttcgatgaccaacccctggagcgagggcagtcccacgacggcctcgaaggcgcgcgactcgagcgtcactggactcacgttgatcgcgagaaagtgctcgccgagcagatccgctcgtcgctcgagcgcagcgagcgcacacaaggtctcgagctccgcccccacgccaaggtcccaggcggcagcgatcacgcgatcaggtccgatcctgcccatggggtcgagccgcgcgagcgcctcgtagcccgcgatccgcggaccgtgcaggttgacgatcggctgcaggtgcgtgcgaggagcgatccgacccgtgacgagatcgtccacgaggtccgccaagcttcgcgggcggacaccgtcggagcgatcagcgcatcccactccctggagatccacgcccgcctcctgctcggctcctgtcgcttccagcagtggtgatctcggctgccggagcgcccacctgaagcgacggccgccgcggcgggctcacttggcgcgatgggggcgcgagcctagactgaagctgatggcgagcgcacccgacaacagcactgtgcagcattcggcctccgaacagttcggacccaacgactggttcgtcgaggagatggcggagcgctaccgagccaatcccctcctcgtgcctgagagctggcgtgcgtacttcgagggtgagcgcgtccccgatggcgtggcgacgaagaccatcgccaccgctacggcgaaagagctcgttggcttcgaggctccaggcgtcgcgacacctccgacgacggcgacaccggcgccgacttcgcctccgcacaacggagccacaccccagaccgcgccgttcacccctgcatcgtccccagaagccgtcgacccgctgacgccgccgaggagcagcgctcccgagacggcaccgcacgcgtccgaacccgcagtctccacgacgccgaccgtcccgtcagcacagcccctccgtggagcccagggcgccttggcacgcaacatggaggcctcgcttgcggtcccgaccgccaccagcgtgcgtgccgtgcccacccgcgcactcgaggtcaaccgggcaaccatcaacgatcagctccagcggctcggtcgatcgaaggtctcgttcggtcacttggtcgcgtgggccatcgtccgtgcgctcgtcgagcatcctcggatgcacgcctcctacgtcgccgacgccgacggacgcgggcaccccggcatcgtcatcccagagagcgtgaacctgggcatcgccgtcgacgttcagcgccccgacggcacccgctcgctcctcgtgccggtgattcgcaacgccgacaccctcggtcctcttgggttcttcgccgcctacgacgatgcggtccgcgcggtgcgctcacagcaggcatcgcccgacctcttcgtcggggccaccgcctcgatcacgaaccctgggacgatcggcaccgagcactcaatcccgcgtctcatgcccggtcaaggggtgatcgttggcgtcggggccatcgcctaccccgccgcattccaggctgcagacccacgactcctcggcgaactcggtgtctcgcggacgatcaccctcacctcgacgtacgaccatcgcatcattcaaggcgccgagtctgggcagttcctcgcgacgatcgccgctctcctcgaaggagaacaggacttctacgacgagatcttctcggcactccaggttccctacccgcccatgcggtggcaggccgaccacaccagcatgcagcccgacgcgaccgagcggctcgccaagcaggtccacgtccagagcctgatccaccactatcgggttcgtgggcatctgctcgcgacgctcgatccgctggacctgacccgtcccaccatgagccccgaactcgatccggcaacctacggactcacgctgtgggatctctcccgacccttcctcgctgaagggctcgtcccagggggtcaggcgtccctcgaaaccatcctccaggtgctgcgcgatacctactgccagaccatcggctacgagttcatgcacatccagagcccggacgagaagctctggatccaacaacggatcgagggctcgcaccaaaccctcacgaaggatgaccagctccgcatcctcgcaaccttgaacgacgccgaggcgttcgagaagttcctgtcgacgcgctacatcggccagaagcgcttcggtctggaaggtggcgagtctgccatcgtgttcctccgggaggtcctcgatcacgccgccgagacggggacacacgcagccgtcatcggcatggcgcatcgcgggcgcttgaacgtgctggcgaacatcgtcggcaagtcctatcgcacgatcttcgccgagttcgaaggcaacctcgacccctcgagcgtgcagggctcgggcgacgtcaagtatcacaagggtttcgagggacactatcgcactgcgagcggcagcgagctgcccgtcacgctcgcatccaacccctcgcacctcgaagcggtcgatcccgtcgtcgaaggcatggtgcgcgcgctccaggatcagcgtggcacgctctacgagttcggtgtcctcgggatcctcgtccacggcgacgcttcgttcgccggccagggcgtcgtcgccgagacgctcaacctctcgcagctgcctggctaccggactggcggcaccgtccacctcgtcatcaacaaccaggtcggcttcaccacgaacccatcggaggcgcgctcttccttctacgcctccgacatcgccaagaccatccaagcacccatcttccacgtcaacggcgacgatccggaggcggtggcgcgctgtgcgcggctcgccgtcgagtatcgagcgaccttccacaaggacgtcgtcgtcgacctgatctgctatcgccgtcacggacacaacgaaggcgacgaaccgagctacacgcagcccgtcatgtaccacgtgatcgagcagcacccgtccgtgcgccgactctacgcagatcagttggtacgttcgggtgcgatctcggaggacgaagccgaccaagcgctcgaagcgtacctccagcggctcgcgacggcgcttgccgagactcgcgaggcagcaccccccaagccgaccgagctgccgccagagccagcacgcgacgtcccactcccgatcgtcacgaccgcggtcgacaaggctgcgctcgactacgtgatcgagacgatccatcgggtgccagaggattttcacctgcatccaaagctcgctcgccagttcgagacgcgccgggccctctacgagcagggacagctcgactgggcgctcggggagctcgctgcctacggcacgctgctgctcgaggggcacgacgtccgcctcagcggccaagacacgcgccgcggcaccttctcgcatcgtcacgccgccctctacgactacgagacgggcgcgatggtccaacccctcgctcgcttgcgcgacgacgaggtgccggtgccgcacgcgtccccgatcgggcgcttcatggtgtacgactcctcgttgtccgagtatgcggcgatggggttcgagtacggctactcgctcgtccagcgatccgctctcgtcatctgggaggcacagttcggcgacttcgcgaacggcgctcagatcgtgatcgaccagttcatcgccggagcgctcgacaaatgggaccagcactcgggtctcgtgctctacttgccgcacggctacgaaggacaggggccagaacactcgtccgctcggctcgagcgcttcctcgcgctcgctgccggacccaaccttgcggtcgtccaaccgtcgacggccgcgcagctgttccacctcgtgcgcgcccaggttgcgcgcaccccacagcggccgctcgtcgtcctcacccccaagtctctgctccgtgcgcgtgagacgcgctctgcgatcgccgcgttcactgacggaggtttccagccggttctggccgacccgttggtcgacgacggcgagctcgagccgacctcagtgcgacgactgatcctcgcaagcggcaaggttgcctacgaggcaatggccaagcgagccaagggtgagctcgccgcgccgaccgccatcgtgcgcgtcgaccagctctacccctggccccgtgaagcactcgccgcagcactggcgaccttccccaacctcgccgaactggtgtggctccaagaggagcccgagaacatgggcgcctggccgtccgtccacgagctgctccatcgcatggacctcaatggggcgcggctgcgccacgtctctcgcgtgcgcgctggctctccggcaacgggctccgctgcgatgcacgcgctcgaacaagccgacctacttcgtcgcgcgctcgaggcacccctgccctaggccctcgcatgccgtgctcggctcgcgtgctcagtcgaggcgacgaatgaagtcgcggaccgcctcggcccaggccgctggcgccgacaggtgcaccccgtggggagcgcccctcacacagtaggcctcggcatcgatgctcgccatgagtgttgcaagtcctcggcgatggcgagtccctgccagctcgccgatgcccgcttgcaccgggaccgagatccggtcgaggtcgatggcaacctcaccagcagcgagctcggcgagttctcgcgtgaaggctggggcctctgctcggcgctccgcaaggaagttcggcccgagctgtgcgagcgcagggcccatcgctcgacgcaggaagtcgctcaccagctcctcgaggtctggttcgggaacctcacccgccagcaccgaccgagggtccactgcccacggtccccaccacgccgacgtcggcaggggcgcctcgaagacactcacgccacgcagcgtgggcggaggatcgctcgccaaggcgagtgcgagcgtccctccgagcgaatgaccaacgaccaccgtcgcatgctcgcgccccaccacagcccgcaggtctgcgaggtgcgccgtgaaggtggcgggccccatgtcccgagagcgcgcgtaaccacggcggtcgtagagcacgacctcgagcggtgcgagcgctcgcgcgaagcgtcgaaaggtcgcagcacgatcgagcacgccgtgcaccacgacgacgcgcggctccgagcccgcgaagcgatcgaccgccaagtctcgacccacgctggcagcctacgaggccgacacgcagacccgctccctcgtagactcgctgcgtgcgcgccgtagccccccgaaccctcggcctcgccgaggccgcgctcggcggcggcttggcgctcggccaatggctccgcaggcatccacacgccgcgcgagccctcgtcgtcggcaccgcctacgacctttgcgcgcgggggccagcgggtctcggtctcggtcttgcgattggtgcggcacgtccagccctgcggggcccgatcgtcgcggggttggcgctctcggctcgcagacgactgggttggttcgcaggccacgccctggccgccaccgctgcgctcagcgccgtgcgcgcggtgcttccaggtccgcgaaccgatcggcgagccgtcgtcgtcgtcaatgcgcacgccggctccacgcgcctcacccgacgcgccctgacccatctccatcggctggactcgaacgtcggcgtcatcgtcgctccgcgagatgccttcggcgcaagcctctctgccgctgcccgccagagccccgaggtcctcatcgtcgccggcggcgatggctccatcagcggtggggccgaggtcgcggccgatcacgaggtcgtgctcggcatccttccgaccggcaccggcaacgacaccgctcgaggcctgcgcatcccactcggcccggaggacgccgcgagcgtcgcgatcggcggcgtcgagaccgccatcgatctcgggctcgccggcactcgtttgttcgtccacgctgtgtcggtgggtgtgatcgcgcgcttcgcggaggcggtccagcaccttcgcggccgagcccggccgctgctctacccgctcgccgcatggcgggtctggcgccactacgacggagtccgcctcgaggtgagcgtggatggacaacctgtccactttccagggacgctcgtcgaactcgcggtcgtcaacaccccacggctcggagggcgtcttggcatctcgctcccgccgtcgcttgcggccgacggccgactcaccgccatcgccgtcacccgctcgccgctctcgctgctggtacgatccttggcctccatgatgcagcagaggcctcaccacccgcacgggaccctgctgacgcgcgacgctcgagtcatcacgctcacgagtgccacgccgaccctggtggcgatcgacggggagccaatcgccgagaccccgatcgatcttcgaaccctccccgcccgcctccgcgttcacgtaccggcgcaacctcggcgatggcgtggcgcggcgtcggaccaccgcacgccaggagacgacgaggcagctagacgccagcagcggtgagcgaaccatcccgcaccgcccacgagagggcggcgtgcacggttgggtgctcgaaggcgaagccgcttgcaccgaggacgctcggttcgacacgctgcgacacaaggaggagctcgcgagccatctcggaaccgaggaccacctcgagcaccggagccgggaccgggagcacggccgggcggctgacgacacggccgaggactgcgacgaagtctcggttccgcaccgggtccgggccaacgaggttgactggtccgtcgagctcggtgtcgatggcgtggacgatggctcgcacctcatcgaccaagctgatcggactcatgaactgccgaccatgcccgaagggccccgcgagaccgagccgcgccatgggcaggagacgagtgagcacgccgccatctggagcgagcacgacacccgtacgcgcaaggaccacgcgaccgacgacctcgcgggcccggagcgcctccgcctcccaatcgaccacgacccgagcgaggaatccctccccggcggtggactgctcggtgagcacctcgtcgccacgatcgccgtagaacccgatcgccgatgcgcagaccagcacgcgaggtggactcgtcagctgtcgcaagccacgtaccacagaccgggtgccgacgacgcgagaggcgtagatcgaggaccgaaccgccgcattccagcggcgctcgccgatcggcgcacccgcaaggtgcaccactgcatcgacgccgtcgatcgcgtcgaaccacgcccgctcgtcgttggtcgagaagatcggcgttcccgccgggtccggggcatcgccccgtcgaagcgcgagcacctcgtcgccacgagcccgcagcaccgatacgagcgcccgcccgatcaacccgctcgcaccactcaccgctacgcgcatgtcaccctccatcgtgtcgacactcgcaccaacgcctcggtctaccgagatcatcctggacgctcaggcatatcgttccgcgcgggcgtcgacacgaacgcgaaagcacgtccaggctggccgcggatacccgcggccagcctggaccaacgcacgatggtcgcaacgatcgaaccgtcgcgacctgacgctcacgcttcgtgcgacgtgagcgcatgcgccgaggcgccacgctcgatctggatacggcgcggacgagcggtctcagcgagcggaaccgtcacccgcagcaccccgtcctggtaggtcgcgctcactcgggacggatcgagctccgaaccgaggtagatcgaccgctggaacgtgccggcgaagcgctcggcgacgacgacgtccttggcgtccgcccgcctcaccgcgcgcgcagccttcaccgtgaggacgttgcgctcaacggtcagatcgatcgactccggatcgacgccgggcaggtcgaactcgacgacgtagtgatcatcctcgcgataggcatcgaccggcgtgaacaccgagtaaccctcagtggtcacaccctgcaccatgctcatgagctcacggaacggatccgtacggaacagcaccatggcacacacctccttgccagtcctcgactgtcacgatcgtcgtgacacttacgacaacaccactctagcaaatctattcccaaactgaccattttcttgagtcacttgccatcatgtttcttgaccctcactccccagtaccgaactcccgatggccactagactgtcgatcacgagcagacaacgcctgtggcaggtgggtcgagcggccacgaccatcgcggcccgcgacacccttcgtcgtatcggtatcgcgctcacgccaggtcccagcaaggacgcggcccagcgagcacggacactgcgcacgacgaccgacgtagcggccgccgtcgcgggcatgcgcggcctcaccgtcaagcttgcgcagatggcgtcctacgtcgatcccgccgcccccgacgacgtccgcaacggtctcgcgcgcttccaagacgccgcaccgccgatgagcgccgacctcgcgctcggcgtcctgcgcgacgaactcggcgaacggctctcgcggttcgccgagatcgaagaggagccccgggccgcggcctcgatcggtcaggtccatcgcgccacgctccgcgatggcaccaccgtggcgctgaagatccagtacccggacgcgcgcgaactcatcaccgccgacctcgagcaagcgccagccatcgtcggccttctgcgcttcgcctttccctcgatgcgcgtcgacgacatcgtcgccgaactcgccacgcgggtccgcgacgaactcgattaccggcgcgaggctgccgtccaggctcgcttcgcacgggcctacgccggccacccgcgcatcgtcatcccccgcccgatcggagcgctcacgacgagcagggtcctcgtcaccgaatggatcgatggcgcaccctttgcgagtgctgccaccctcgagcccgaggagcggtccgagatcggcgagatcctgttccgcttcgtcttcgcgagtctctatcgcctccgtctctacaacggcgacccgcatcccggcaactacctcatcctcgacggaccacgcccgcgcgttgccttcctcgacttcggattctcgcgctcgttcaccgccgacgagatggcaaccttcgaggcgctgatcagggcgcgtgtcgtgacgcccgaccgccacgccttcgccgagacgcttcgagcagccggcctcgtcatcggcgacgaccacgacgacgacgtgctgtgggagttcttcgctccctactacgaactcgtcgagacacctggaccgcgcacggtgacgccggcgtgggcctcgggcatccttcgtcacaccttcgaccgatcgcacccgctggccagcgccgtcaacgtgccaccggcgttcgtcgtggtccaacggatcaacctcggcctctatgcactcctcgccgagctcggtgcgacggccgactggcgtgccatcgccgaggacatctggccattcgtcgctcgcgccccgatcacaccgatcggccaggaggaggccgcctggcgtctggagagggctcgatgagacgcaggctctggtggttggtgcccatcggcatcgccgccgcgatggtcggcgcgcgccaactcctcgaccaacccgcgatcgtggtcccggaggctgccgccgtgagcgccggcatgctggtgtgggagttgcccttgttcacccaccggccattggcgaccgtggcgctgatcgatctcgcggcgttcggcggcgtccaggccgctcgctacgtctcgctgcctgagcccgccctcatcgctctggtgacggtcgccatcctgggggccttcgtcctcttcgacctccccgccctgccagcgctctcggcggggctgctaccgatctacctgcacatcgtggtagccgcgtacgtggtggcggtagcgctcaccatggtgcccgtcgcactcgtcgccgaacggcgccaccgagcaagtcgccgccacttcggcacccacgagcttgcccagatcgcgccagcgagcgccgttgcggtgctgctcgccagcctgaacccgttcctcatgcttccgccgctctacgtcgccacgaccgaagcagccctcggcgctcgcccaccagcgggtcaggaggccatccgtcgttccgtggcgctcgcgacgggcttcgccggcgcgctcgtcctccatctcgtggccccgcccctcgtcgtcgcccccgtcgcggtcgcgctcgccgcgttcgtgagcagccagctcggcgtgtcccttccacctgcgatcgcgttcagcctggttcccctcctgtttccagtgaccgccagcacccttctcgccctcggcggactcgtcggcatcgtcgcaaccgccctcgctccgtggctgcccaacgccttcggccgtgcgcggatcctcctcgcctcgttctcgtcgggtaggctcacggcatcggtggatgacgaggcgctgcctgtgggcgatggcgagtaggcgatggacgaacgccacgaggagcatggcgagggagcacggtgaaggcaaccacagcgatcgagcgatcgcacgcgagcggcgagcgctccacgggacggatcgtacgtggcctgatcgtcgcgatgcgacccaagcagtgggccaagaacgctctcgtcgtagcggcaccgctcgcagcgggcagcatccttcggacccacgtcctcgtgccgacagccctcgccttcgtcgccttcgtcgcgatctcggccgcgacgtatctgctcaatgacactgcggatcgagagcgcgacgccgcccacccgaccaaacgccgacgcccgatcgcggccggcatcgtcccggtatggctcgcccttctcacggcaaccatcctcggcctcggggccctcctcctcgccgccctcgccatcaacctggcgacgctcgccgtcctcgcgacctacgccgcctcgacgcttgcctactcgctcaagctcaagcacgaaccgatcctcgacatcgcgatcgtggccggcggcttcgtgctgcgcgccgtcgcgggaggcatcgcagcgcacgtcttcatctcgcactactttttgctcgtcgccggcttcggcgcgctcttcgtcgtggcctcgaagcgctatgccgagctcaccgcgaccgacggcgagagccgcacccgcagcgtgctcgcttcgtactcaccaggcttcttgaacctgactcgggcactcgctgccaccacgacagtcgtgacctactgcttctgggcgttcgagcgcagcgccgggctatcggatggtcgcctcgtgcttggcttgtcgatcgtgccgttcacgatcggagtccttcgctacgccctgctcgtcgagcacggccacggggaggcccccgaggacctcctcaccgccgatcgcacgctgctcgggatcggcatgctctgggtcgcgctcgtcggaggagcgatcttccttgtctaggcatatgagccaacccatcgacgcggcgaccgatcaggccccacccttcgaggagcgttggacgctcctcgaagggtggggccgaacgccccgctcggcggcgtggcttcgcgaagcgacagacgacgccgtcgtcgatgccctctgtagccagggcccccgcccggtgctcgcccgcggcctcggacgcagctacggcgacgcggcgctcgcggcaggcgggatcgtgctggacatgaccagccgccagccggtcgtcaccctcgaccagcatcgcggcgtcgccgtcgtcgacgcgggtacctcgcttgcccacctcgctgcgagtgtgctcccccacggttggttcctccccgtcacccccggcaccaagcacgtcaccgtcggcggtgcgatcgccgccgacgtccatggcaagaaccatcaccgagacggatcgttcggcggctacgtcgagcgactctggctggccacgccggagggcatcgtcgagctcgcgccacccgatgagcgtttctgggcgaccgtgggcggcatgggactgaccggggtcatcctccgagccgccgttcggctcatcccggtcgagagccgcttcgtcctcgaccgagaagtcgcgacgtcgtccctcgacgagaccatcgaggtcctcgccgacgacagttcggttcgctactccgtcgcatggctggacgcgacggctaccggagctcgcctcggccgcggcctcgtctcgttcgccgaccacgcacccgccgacgcactcccggcctcgctcgctcacgacccactccgactgccgcgcgagcgaacgctgcccgcacctccagatcgcatcccctcagggctgctgtcggtgcccacgattcgggcgttcaacgagctgtggtaccagcgtggacggcgtcggccggagacggccctcgtcgacctgcgctcgtacttctatccgctcgacgccgtgaacggttggaaccgtctctacggcccacgaggtttcgtgcagtaccaagtggtcgtcccgaacgacgccgtatcggtgatcaggcgcatcctcaccgacctcgtcgagcatgggcatccgtcgttcctcagcgtgctgaagcgcttcgggccagcggggaacggttggctctcgttccccaccgcaggctggactctcgcgctcgatctcccggcgcgccggagcgacctcgagaccctcctcgtgcgcctcgacgccctcgtgctcgaggccggaggtcgcgtctacctcgccaaggacggacggcttcgacctgagtccgctcgggcgatgtacaccaggatcgacgacttccaagcgctgcgtgcacgcctcggtgtacgaggcgtcatcagctccgacctcgcccgccgcctgcacctcgactagcctcgtggcgtgctcaacgccaacggtcttccccaacagctcctcgtcgtggggggtgggtccgatctcgcggtcgcgatcatcgagcgcctcgcaaccgacggccccctcgaacgcgtcgcgctcgccggaccgcggccggccacactcgaacgcgctcgcgaccggatccgtgagcacctcgacgaggtcgccacgttccacctggacctcgccgatccacgagcggtaccgagcgacctcgaaccagccctcgagtggctcggcagtgtggatgccgtcctcgtcgcggcaggtgtcctccccgaccaacacgctgccgaggccgaccccgccatcgtcgcgaatgcctttgcggtcaacgccaccggacctgcggtggcactcagcgtgctcgccgatcgcctcgagcgggccggcaccggtcagctgatcgtcctctcgtcggtcgccgccacggtggtgcgccggcgaagctacgtctacgacgcgtcgaaggcggcgctcgatcgctttgccctcgggctcgccgatcgcctcgaaccggcggtcggtgtccacatcgtgcgcccgatgttcgtcacgacccgcatgaccgagggtctcgagcgaccaccgctcgcgctctcgcccgaacaggtcgctcgcgcaaccatcgcagggatccaggctcgccaacgagtgatctgggtgccccgggccgccgcgctcggggtcatggtgctcagcgtcctgccgcgcaccgtcctccgacgtctcccgatctgacaggcaacgtccctcttaccccgcgaccgcggtgcccccgaccagatcgacgccgccaggcgcaggggcgctcggggcgccgccaagccccacgatggcgccggaggacaacaccagttcgagaccggcacctgcgcgcgcagcactcaccacggtggcagagccgacatcggcgctcgcgaggtccgatgcatcgccgaaggcaaagacatcgccgttcgcaagcacgagccagtagccctggccgtcggccgtcggcacgagcgtgaccactggggcagggagcgggtgcgagccgccgaggcctgagtagccggcactgtaggtattgccgtagaagtgggcgtcaccgaagccaaagacgccgccgtcggcggccaccaaccagtagccctggccgtcgggggtggggctgagcccgacgaccggtgcggcgagcgggtgggagccgccgaggccggtgagacccaaggtataggtgttcccgaagaagggtgcgtcaccgaagccaaagacgccaccgtcggcggccaccaaccagtagccctggccatcgggggtggggctgagcccgacgaccggtgcggcgagcgggtgcgagccgccgaggccggtgagacccaaggtataggtgttcccgaagaagggtgcgtcaccgaagccaaagacgccgccgtcggcggccaccaaccagtagccctggccatcgggggtggggctgagcccgacgaccggtgcggcgagcggatgggagccaccgaggccggtgatgccaagggtggcggtgtcaccgagactggtggcaccgtcggcggccaccacggtcccatccgccgtgacgccgcgaagcccgacgttccccgtcggcgacgacgatggtggagcaggcgtcgttggcgaggtcgtcgtcggggtggtcgccgactgcgcgttcgtcgccggggtgccgaccgccgcgatcgcgcccaccgcaccgccagcgggtgcggtggcgccgatgctcacccctccatcgaagccgacgagggcgcccgacgacaggacgatggagtagccctggccaccgggaccgggcacgagtccgatcgcgctcgccgttcccggcgtgagcgatccgtagctcggcgcatcgccgaagccgtagaccgtaccgtcggcggcgagcagccagtagccctggccatcgggggtcgcgagcatggcgacgatcgggctggcgggtgccgccggaagcccgccgaggttcgtggcgtcgccgaaggcgagcacggtgccgttcgcaagggcgagccagtagcccttgccgtcaggggtaggcacaagcgccacgacacgcgctggcagcggatgagcaccgccgaggccggtgaagccgcgcgtgtaggtattgccgtagaaacccgcgtcaccgaagctgaagacgccgccgtcggcggccactaaccagtagccctggccatcgggggtggggctgagcccgacgaccggtgcggcgagcgggtgggagccgccgaggccggtgatgccgagggtataggtgttcccgaagaagggtgcgtcaccgaagccaaagacgccgccgtcggccgccaccaaccagtagccctggccgctcgggtcgcgggtgatcccgaccacgggtgcagccagggggtgggagccgccgaggccggtgatgccgagggtagcggtgtcgccgagactggtggcaccgtcggcggccaccacggttccggctggggtggtctcgagcaccccgttgccgaggctcggcgactcgggcggcgtcgggggcggtgcgggggctgaggcgctcgcgtcgttcgagatcgcgatcggtccgctcgcgacgaaccaggccgaggggagtccgagagcaccagcgaacgttgcgcccgagacggtcaccgacccgttcgtgccgctcacggtgatcgaggtcactcgtccgccgtcgttaccgagcccgttgcgcgcatcgaccgcgagtccggtgggtgtgccgatcgaggggaatgcggcctcgaccgacgcgagcgagacgctctgcgtccaggggttccaggggttacagatgttgccgtagcagcccgcatcgtagggatcgggaacggcgggaaacgtaccgggtgccgtgtaaccgccatcggaggccgagtactgcgtgaacgcaggcgctccggaggcggtcacgagcacctcgtgcgccgtgtccgccaccgcctgctcgaccagcggccgatacggcgcgctcaacccgttgttcacaccgccgtagacctggcacgccgaggtgtcgcagatggtcgcgaacccgtagccgttgccgaccgcgagcgcataggttcgggcctcgacggcctgagcctcgagcgcctggaaaccccatggttccccttgcggaccggaagcgccgaggaggccccatgaggccggcatctcgttcgccaccacaccgagcacgtaggactcgagcccgagctcattgacgagcaccatctggcccgagccatcctggagcacctcgagttggccgcgatagctccgctcgctgccgccgggcccacaccacacgagtgccgacgaggccggctcgtcgacctgctgaccgaccggcggcagcgacggcggcgacacccacagcgaaccaggtgcgctcgtgaggttactccaccctcctggggagccgcagcccgtggcggcttgccccaccgccgcaaccatggtgccaccctgatccgtgagctccaccgggacgttcgcaccgacgctgacgccaccgacgctcaaaccggatggatcgaagacgacaacggggcccccgttggcctcggtgatccagacgcgcactgcctggtcggcagccgtcgtgagcgtggtcccaccgtagaagtgcgcgaggatggcctgataggagtcctggcccacactggcgtagccgatctcgccgaactgcgaagcgccggagcctccaccgacaccgaacccggtgaaggtgagctcgccgctggtcgacgttggcgtcatcgccggtgcatgcgccggcgccgcgacaagggctccgagcgcgatcgctgcgcccgcgagcggaatacggcgccctccgacgcgcacgctggtcctcggcaacctctgccccctcctgcgtgagccctccttggccgagccgagcgcgccttctcgacgctcggcccacactacaccatcggcacgcgccggagcggtcttgacggacgtagactccaaggcgccatggcctctcgcgacctcaccgccaaggacctcactgcaagggaactgcgcacccatctcgacgagacccgagcagcacttcgggctcgccttgcgccgtcgctggagcggacgttgcgtgaagcgctggtcgatctcgagccgctcctcgggccccgcgcgcttgccgaacggttgcggcgactcgcggcggcgtcctatgtcgaggccgacgtaccgacccaatcgcgaatcccggggctcgccgtcgtcaagcgcggcgtgcacgctctcgtggcgtggtacgtccgtgcgatcgtgcagcaggtcaacacctttgccttcgagacggccggtgtcctcgaagcggtcagcatcaagctcgacgagttcgagcggcgcctcggtgccgtcgaggctccgagcgtcgcaccggccacggccatcacagtgccgtggcctcccggcgcgaacgctgcgatcgtggcggcgctgaccgaactcgagccgggggctcgcgtgctcgtctcggacgcgacgaacgacgacctcgcgaccgccctggccgccgcaggcctcgacgtcctcggcacctcgctcgatcaggaggcggccgatgcactcgccgccgacggtatcgacgtgcgcatcctcacgatgaacgaactgctcgacgcaacggcgcccggatccatcgatgcggtcgtgctccgaggcaccgaggtcgagttcagcgacgtcaccgccaagcgtcgcctcatcgcatcggcccggcgcgccgccaagggtcccgtcgtcctcgtctggaacgagcccgagcgcctcgccgccgaaccgagccttgcgggcgtgctcgcgctgcaccctgggccgttgcccaaggcggcgtgggaactcctcctcgcagagcgcggcgagcggcccgtcctcgcgccggtcgccgacgggctcaccatggcggtgctccccggctgatgagggttctccacctcgtcccgtcgctcgcgccccacgacgccatcggcacgcacactcggctcctgcacgaagcgctgctcgctgccggcatcgactctgagatcgtcgcagacgaggcactcgacggcgcccaggccacgccgttcgccgcgcttcgtcgacggcggctcgatgccgccaccgtggtgtggtaccaggcatccacgacctcgccgatggccgcatgggttaggactcaggtccgtgcacggcgcctcctgacctaccacaacgtcaccccgtggcagtaccaggagcagaccaacgtcgaggttgcccgtgccctctggagggcacggggcgaactcacgcacctcgcgccagccgtccaccttgcgagcaccgtctcgcgcttcaatgcccgcgatctgaggcgactcggggtcgacgaggtgcggatcctgcccccactcatcgagctcggtgagcccgcagagcctgcgccggcccggccatctggctcgcgatggatcttcgtcggtcgactcgtaccgcacaagcgccaggatcgcctcatcgcagcgctcgcgatctaccgtcgcacgatcgacccctcggcgacgctcgcgctcgtgggcaaggcgaccgaaccgagctggcgcgcgcgactcgtcgacctcgccgcggcgatcggcgtcgaggcggccgtcgagttcatcggcgacgtcgacgagtcggggctgcgtgccgagtggcgcgaggcgtccgtgtacgtctcggcctccgatcacgagggttttggcttccccctcatcgaggcgatgagcgctggcgtgccggtggttgcgctcgcgcgtggcgcggtcgctgagaccatcggacgagcgggcctcctcgtcaccgacgaggcgccccgagcgctcgccgaggcggtcgccctcgtcgagcacgacaccgaggtgcgttcggcgctcagcgccgaggctgctcgacgacgcgctgcactcgatcccgcgcgggtcggccccctgtatcgagcgctggcctgggaggcggccgggtgagggtgctccagttcgtgcctgccctcctcccgcacgacgccgtcggcaacatcgtgcgcggtctcgacgagcgactccgcggcatcggcgtctcgaccggcatcgtggtggcgggcgaccgaccgcctccgggcgcaaccagcgttcgccacacccagctccggcctgacgacatcgtgctctaccaccttgcgagccgctcgcccgagggtgcgcgtctggtcgctcgccacccgaacgtggtcgtgcactaccacaacatcacccctccggagctactgctgccgtggctcccgacggacgcactcgagctccagctggccaggcgtgaggccgcgcgcatcctgcgagctgctcggctcaccatggcggtgagcgcctacaacgcagacgacgcccgttccctgggggcacgtgacgtcgccgtcaccggcaccctgtcgcgccacgatcagctcgtcgcagcaccatcaaccgaggtcctcggatggctgcgcgcagaccgcgatcgccgagggtccccgcacgactggctgttcgtcggacgcctcacaccgcacaagcgcgccgaggatctcgtcgccgcgctgttcgcctaccgacacgccaccggcaccgacgctgcgctcaccatcgtgggacggccggcctcgcgacgctaccttgcccatctccgtcggcgcgtcagcgtgctcggactcaccgcccgcgtccgcatcctgacccatcccctcgcaccacgcgccctggcggatcactttcgagcggcgagcgtctacgtcacggcctcgcgccacgaggggttcgggctgccactcctcgaggcgatgtccttcgggctgcccatcgctggcctcgcggctgcagcggtcaccgagacggtccagacggcgggagtgctcgtcgaccgcgccgacccagtggagctcgccgccgcggccgcgacggccgccgagctcgggccacgtcttcgtcccgccatggacgaacggctccgcgcgtatgacagcgacgccgccttcgcccgcatcgtcgagggactccggagcgtcggcctcgaggtccgagcgtgagggtcctgttcgtcacgcctcgttggggtcccgacatcgcgggcggtgccgaacgagccgcgcgcgcctggggggtggccctcgcccggcgcggccacacggtccgggcgctcacgaccacggcgaccacgctcgactggtccccggtcctcgatgccggtgagaccaccgacgatggcgtcatcgtcgagcggcaccacgcgaccgctcgcgacggcgacatcgatcgcgcgcttcgagccgtcggaccgctcgccgcccacctcgagcgcaccgctgcgcgccgactcatcgagcgtcaagggcccgtcatcgacgggatcgaggatgcagcgcaaaacgccgacgtcgtcatcgcctatccgtacctctactggaccagcctccgcgcgaccgaggtcgccggtcgccggacggtggtccacccggctgcgcacccggagccgctcgtcgcgctcagcgcactcgaacccgtcttcaccgcgcccggcgggctcgtctaccagacggcgagcgagcgccgcacggtggaagcccactggccaacggcgcaggtgcgctcgctcgaactcgcacctccgctggtcgcgtccgcgcgcgagcgcgtgccgtgggacgcacgaacgatcgtgctcgcggtcggacgcttcgagcacgacaagggttccgaggccctcatcgcactcgccgaggcacttcccgacccgttgcgagtcgtcgtggccgggcccgttgtcgaaccgccgcgacgaccgagcccgctccagaccctcggcgttgtcagcgacacgagactcggccagctccgcgccgaggccatcgccacggtgatcctctcacgctacgagtcctactccctcgctgcggcggagtcactcgccgccggggtcccgatcgtcgtcaacggctcgaacgacgtgctcgtcgagctcgctaccacctccggtgccgggatcgtcgccgcggacggcatcgacgtggccgcagcgatcgtagccctcgcgaccgatcgcgagctggcgtcgcgcctcgagacagccgcactcgcctgggcacagcaacgcccgggtgccgacgaggccgtcgaacgctacgaggccttcctcaccgaggtcgctgcgcacgcgcctactcggcgaagaagctgacctcggtcgccacgaggccgcccacaccgaggtgttggtcgacgatcttcagggcggtatcccattggcgccgctcgaggagctcgccgctacgcgcctcgacgacgctgagcgagagctggtagatgccgggagcgagcgggacgtcggcgacctgaaccaagaacttgcccgcgccgtggacgacgaagggatcgagtcccatctcgcgcgtgtgtgcggtgagcacgggggcgccctgaggactcaccaccgcgagctcgaggtgcaccggggtcggacgcccgtcgcgctcctcaagggcgaaacggagctcgagcgggctacgcgcctcgagcgtcaccggctggtccacgacaacaccgttcgcccggaggtcctcgaccacgacgtggcggggcgcctcgtcgagctctgcgacgaccggtgcctgggttccgagcccggagcctgccaactggagctgcgtcagcagcgagatcgcctcctgtgtcggtccaccgcccaccaggcggccgtggtcgagcacgaacgccgagtcacacaccgcgcgaacgagctcgggcgagtgcgacacgaagatgatcgtgcgaccctcggcctggaactcgcggatcttcgcgatgcacttggcctggaaacgggcgtcgccgaccgcgagcacctcgtcgacgaggagcacgtcgggatccatgttcacggccaccgcgaagcccagcctcgcgtacatgcccgaggagtagaacttcacctggttctcgatgaaggggccgagctcggagaactcgatgatgtcatcgatgcgctgatcgacctcacgccgcgacatgccgaacaaggtcgcgttcaggtagatgttgtcgcgccccgacaggtcggggtggaagccggctccgacctcgagcatggccgcgacacgtcctcgcacggcgacctcgccgcgactgggcgtcaggatgccggcgatgcacttgagcagtgtcgacttcccggatccgttgtggccgagcagtcccaacgtgtgaccctgctcgacgtcgaaggtgatgtcgtcgagggcggcgaacgactcgtgaggcacacggccccagtggacgaatcgctccttgagcgacgtgtacttctcctggtagagacggaagaccttggtgaccccgcgtacctcgaccgcggtctgacccaccgctagagctcctccgcgaagttgccttcgagtcgtccgaacgcccacagggcaaccacgaagagcacgacaccagcgacgaggacgccgagcacgccccagaagtaccacatcgggcccgccgtcggcaagatctggacgacggtgtgcgacgcgaccgagtagggatccgtcttggcgtagaacgtcctctggaacgcgagcacgaccggcgtcaccggattgaggagatacacccagaccgggatgtgatggtctgcgaacttgttcgcgacgagttcgaacgcgtacacgacgggggttgcccagaaccaggcctggagcaggatctccatcagatggcgcacgtcacgcaggtagaccgtgatcccagagacgaggatgccaaggccggaagcgaacacgagcagcgcaacgagcccgatgagcgccacccacaggtagctgaccgacggcacgacttggaatacgacgaggaacaccgcgagcaccacggcctggaacacgaagaagaccgacgcggagccgaccgaggccaaggccaggatctcgcgaggaaacgcgaccttcttgacgagtcccgcgttgtccacgactgcgccggtcgcgcccatgatcccggtctggaagaggttccagcagaggagcccggtggcgaggaagatcgcgaacaacgggatgccagaacccagcaccttctggaagacgatgtagtagatcaagatgaacatcgccgggttcaccagcgaccacaagaacccgaggaaggagtccttgtacttgacgcggatctccttgacgatgagtccgcgcagcagatcgcggtagcgccagatgttcgcgagccgctccgtcaccgacacgcgcggccgcaccagccgtatggcgagcgcgcggttcgggtcgtagcgcttcgtgtcgccaggctgggacgctgggagatgggtgtccacccgcgccctcacgcctcggtcgacgaagcgctgcgctgtccgtaggacttcgtgcgaatcacttgatcgatgaagccatactcgagcgcctcgtcggcggtgaaccagcgatcgcgctcggaatcggcctggatccgctcgaggggttggccggtgtggaacgcaatgcgctcggcgagctggcgcttgaggtacgtgatctgctcggcctggatcgcgatatcggccgcctgtccctgcatctgtgcgagcggctggtgcatgaggatgcgcgcgtgcggcaaggcgtagcgcttgccatgcgtgccggcacacaggaggaactgggccatcgaagccgccatgccgatggcgatggtcgagacatcgcagctgacatattgcatggtgtcgtagaccgcgagcccgtcgtagatcgagccacccggcgagttgatgatgaacgagatatcgcgttcgggatcctcagcagcgagcagcagcagctgcgcgcagatctggttcgccgaggcctgggacacctcggtcccgaggaagacgatccgctcacggaggaggcgctgaaagacgtcgccaccagcttcgataccagcggcgtcggcaagatctcggacagaaccctcgacaagggcaggtagggccatgcccgctaggctagcgtgcgttccccgacgggaggctgacggggtcgcgactcgacgtcgaacgcgggcgtggcgaaattggcagccgcgcgaggtttaggtcctcgtgtcgtaagacgtgggagttcgagtctccccgcccgcaccggtcatcggcggccggcgcacagccgatcttcagcgtcaccggtcgcgatcagcgaaagctctcgcccagtcggcgaagccgacgagcgcccgccttcgatgcgacagcgcgtccttccactcaccgagttcggcaaacgttcggccgtcgccaccgagcgggatgaagatggggtcgtacccgaatccctgctcgccacggggctcgagtgcgatggccccctcgacgacaccctcgaagcatcgcggcgggtcctcgtcgaccacggcgcacaccaccgccacgaagcgggcacggcgactacgcgtcgatccgagctcctggagcacacgcgcgatacgctccgcatccgtcggcccatagcgagcggagtagatgcctggggcaccgtcgaggccgtccacgacgagtcccgagtcctccccgatcacgatcggcgctcgcccgcgtcccgcctcggccttgatgatcgcgttctcctcgaaggtcgacccggtctcggcgacctcaccgacgtcgatccccacgacctcgaagtcggtgaggatgcgtcgcgcttccgccaacttgtgcgaattcgaggtgacgagcccgaccctcacgcgagctggggtcctcgctcgaggagctcgccgatgccgcgctccgccagcttgaggagctcgacgagggtcgccttcgcaaagggcgccccctccgctgcaccttggacctcgacgtagcgaccgccgtcggtcatcaccacgttcatgtcgacgtcggcgcgcgagtcctcgtcgtagtcgagatcgaggagcggctccccgtcgacgacgccgacggacacggccgcaagacgaccggtgagcgcagctggctgcacgagaccgccctcggcgaggcgctcgagcgcgcgctcgagcgccaagaagcccccggtgatcgcggccgtcctcgtgcctccgtcggcctggaggacgtcgcagtcgacgacgagctgatgctccccgaggcgctcgaggtcgaccacgctgcgcaacgctcggccgatgagccgctggatctccacggtgcgcccctgctggcgcccgcgcacggcctcacgggccgtccgtgtcggcgtcgaccccggtaggagcgcatactcggcactcacccatccccggccctgcccccgaagccaggccggcacgcgctcctcgagcgagacggtacagagcaccgcggtacgacccatacgcatgaggaccgatccaggcgccatctcggtgaagtcaggtgtgatcgccaccggccgcagctcggctgccccgcgccccactggccgtcgttccacgtcgcctcctcgctgcgtccggcgacccacgctaggcgctacgcgtgcgccggcactccagcgcctcgacgggcacctgctcgatcgcgccgagctccccagggaacaggcgaccgccgatctcgcgaaagacgacagggtccccgctgcaggcgacgcgcaaagagccgacggctcccgagcgtgccagtccatccgcaccgagtcgctgtgcgacctcgaacgccgcctcctctgccggcgacacgagcgtcacctgctcgccgaccaccgcttgaatctcgcgtgcaagatagggatagtgcgtgcaccccagcagcaacacctcgacccccgcgtcgacgacgggcgccagacgatccgcgatgaccgctcgtacggccggaccggtcgtctggcctgcctccacgaactcgacgagtccaggacaggcgacggcgacgcccgcatcgtcggcgagcgcccgctggtaggcgcccgaggcgatcgtgcgctccgtcccgatcacgccgacacgaccggacccgacgcaccggcgcgccgcgcgcgcccccgccccgaccacgccgatcaccggaaccgcaagctcggcccgaagcgcatcgagtgccacggcggacgcggtattgcaacccacgacgacgagtttcgaaccggcctcgtccacgagccagcgaccgatctcgagcgagaaccggaccacctcgtcggcaggccgcgatccgtacggcgaacgagccgagtcgccgaagtagacgagatcctcactcggcaatagatcgcgcagcgccgcgaggatgttgagcccgccaaaaccagagtcgaagacaccgatggggccgtgcgcgcgctcagccgccaccgctcgacgctccctggaccacctgttcttctcgaacgagcccgcggctgatgcgataggcgcggatgtcgactcgaggacgcgcaagcgacgcgatcacgtagacccaccgatcgtcgaccgcttggcgtacgtccgtcggcgacgggaacgcctcggagtgggtgtgcgagtggaacaccccaacgatctcgagcccggcacgctcggctcgctgctccgcgcgcagcacatcctccggggccatggtgaacacccgtgccgagtgcgcctcgttgcgtccggggaacgcctcgacgatggcacggtcgtcgccgagcagcaggccacacgcctcgagcggataggtacgaaggcagtgcgcagcgatcgcatcgagcaccccatcagccacgcggaccacgacaccacgctaccgcgcaggcaccggccccccgggcaccaggagccggagctatgctgagcagcgctcggcatcggcgaacgaggaggcagacgcacgtggcacggcaaggcgcgcgtcctgcgaaggcgcagcagctcggcggcgtccgcgtgctcgcccagaatcgtcgcgcgcgtcacgactacgacgtcctcgagaccttcgaggccggcatcgtgctggtgggcagcgaagtcaaggccgtgcgcgagggtcacgtccagctccgcgacgcctacgcccgcatccgagatggcgagctcttcttgttccaggcagtgatcagcccctatcgacacgccaccggctttgggactcacgtcaccgaccgccctcgcaagctgctcctccaccgcgacgaaatcgatcgactccgcggccgcttggagcaggagcgtctcacactcatcccactctcgctctacctgcgcgacgggttggtcaaggtcgagctggcgctcgcgaagggccgcacgctctacgacaagcgccacgtcctcgccacccgcgacgcccagcgcgaggtcgagcggctgcgctcacgctatcgacccaatcgcagcgcacgctagactgatcacgccacagcgagtcatgagggggctgcgcatcgcagctatcggtcgcgttgttggcatcgacaagggggtgtaccggattcgactctggtcgacgagatggtggaagcgagccgtgctcaccggatgcacgtcaaacagccggtgcaacaataaacgccgagcctgagctcgcactcgccgcgtaacaccggcgacggcggacggcttgcccgtgcccgcgggctgatcccgtcgtcatcacagggcacttaccgtttcgcagctgttggcgctgcctagcgggacacctcgccaacacaacctcaggggacgtgccaggtcgtccccgaggatctcaacctggctgcgctcggagaagcaccatcaaggagccagaggacgcgggttcgactcccgccacctccactgatgttacgaaaggccaaccggtgtccccccaggaggaggacaccggttgcgcgttcgggccccgttcgcccctcgtcggtacgcgatcgcggctcgcgggcctcaggcggagggaaaggcgccggtcgggagtgattgccacccggtcgatcaggtcgcgcaggagctgctcgacggtgtcagggttggcgacctcgacgatccaggagatctgggcgaagagggcctcgagccgcttgcggtctgggaaccgaggagccgctccgctcagctggctgggcaaccgttctcggtggacgatcagttcatcacgctgttcgatcagctcggtgacccggggcaagcagaccgccgccggcatgtcgccggtctcgaaggctcgcaggtcgtggtggctggccccctgcaacgaggccgcggccgcgagttcggcgagcaccgcgcggcgaagcagatcctcgggaggctggtcgagggggacagatgctgaacaagggtgccaccgtcgccgaggtcgcccgcaccttcgcacatcgccgagaccacctggtaccgctggaaacagacctacggcggcatgcagggcgcggacctgaagaggtcgaaggagctctgcgccgaaggccggcgcctgagacgctggtcattgatctcgccctcgcgaacgacaggctctgacgagctggccgaggggatcgtctgaccccggaccgcaggcgaggcgccgtgcgccggctccaccagcggctctcaggcgtccgagccaggggcgtgccgagtgacggtccagccacgagccacccggcgccgaaggtcgacgaggcgctccagcggcctcgacgaggccatcggcgagatcctgcctgccttcgcgctgccgacgaacgcaagggacaccccctcaccgagcgcacgatcggtcacgcagatgccagatctgcctccacgacgctgcacgtcggcgcaccacgcctgctgccggacatggtggcaccatcggctccgtcgggaacgtcaacgacgacgcactcgccgagaccgcgagcggcctcgcggcgaccgaatgggtgggcccgggctcacccgccacgtgtggccctctggccggcctcacgaaccttgaggaggtgacctcggcctggatgcgccgctccgccacgacgaggtctatgcaccggctggggcaccgtccgccggtcggggtcgagtatgagtacgatgatcgccgagcgcgagaccgttcacacgtcacggcgtgtgcacggaacctgggggcttcaccgtgcatcgcgtgggccctgtgccgatcccgcgctgtgcgtgagtccccgacgatgctgcgacaccaaggaggaagcgtgcgtccgaacgccgtcatcatcggccttggccagctcggccgttcccttgccgaaggactggtcctcgcaggctggaccgtgacgggggtccggcgcgatcagacggcgagcgagcttgctcggcccgacctcgtggtcgtcgccaccggtgaggacgatctcggcccagcgctcgagacactgccgcccgactggcgctcgcaccgggtcgtcctcctccagaacgaactcctccccgaccagtggcgtcgccatggcatcatcgatcccacgatcctcgtcgtgtggttctcccgcaagcccggcgagctggtacgggagctgcggccctcggtcgtcgcggggccgcacgccagcgcgatccgcagcgcgctcagcgccctcgatctccacgccgtcgaggtcaccccatccgaggtgatcagtgccctcgtcgagaagaacgtctacatctggtcgatgaacctcgcggcactcctcgtccccgacccgaccacgagccgcgtgctcggcgagtttcgagacgtctacgacgcgctctgtcgagagacggttcacatccacgaggccgcccttggtcatccgatcggcgacgtcgcggcgctgtgcgacggcgtggccgccatcctcgccaacgagggagagcggcgcctcggaggccgcagcgcgaagcgccgagcggagcggctcgccgcgctcgctcgtacactcggcgtcgacgcccccaccgtggctcgcgctgccgagagcgcctgagtcacgcgacagcttcggacccgtcagggcgacccaggctcggcgaggaagaccgcgacgaagtcgcgccagaacggcaccagatagtgcgtcggcgcctgcgccatggacggcaacaggttcgtcgccacgagtccgttcggcccctcggcgaaggtcgcaaagctcacccagtaggggttgatgtcgagctgcatcccacgaacggcaccagcccacaccagcatcgagcccagcgtcgctggcgacagtcctgggccaccgacccacacgagattgccgtgcgaggtgatgccgaggccgctccgccaggtcgcgagcagattgccgagcgagtagccccacgtcacgaggggattctccgacgccgtcgggagcactgctccgtgatcgaccagcaaggtcaagttctggcgaaccgcgctcacggccggactcggaccgacctcggagccccacgcaccaatctcgactcgcccgttcgtcagctcgacgagtgacgcggcaccctcgacgagcggggctcccacgacgccatcctgctcgaagccaccgttcgaaaccgcgaactggaagccgccctcgaacgccgcgacgagattggtgaccaacgaggggggcaccatgccctggtaccgaaagctcccaccgggttgggtcgtgcccgcgaagagctgcacgacagcgtgtgcctgatcgatccaggccaccccgaccggagcggcccccggcgacggcgccacctccgaggtgaataccaccgcgccgcccgagccgaccgcccccgctggcgtccacgtcaccggcgcacccgtcgggccgacctcgatccggggcatcggccacagttgctcgggggcgccgccccccgcgatgggcccggggtgtgcaaggcgggtcacgccgctcgccgcgtcggaggccgccgggaccgggggcggcacgcgcgctggcgacgagcccttagcacgtgcgctccgtgcgctagtgccacaggcagcgagcaccccgcacgcaacgaccaggcaagcgccgccgtagcgccgacgtcgcgccatggcctcagccgtccgtcgccatcgggcgagtgcgaggtcaggcgttcatgaatcggcgcacagcgatggccgatcccgccgtaccgaccacgatccccaccacgaggacgatgccgagcgtcccgatcacgtcgccagtggtgaggacgaagccggacaggaggtggatctggaagtggctcacggcaaagctgatcaggtcacggagtccgaccacgaccccacccgcgatggcagcgcccaggaggccctggacgagcccttcgagcatgaacgggatctggatgaacgagttcgtcgcgccgacgagccgcatgacggcgacctctcggcgccgagagaagatcgcgacccggatgacgttcaaaatgagcaccgcggccgacacgaggagcacgacggcgatcacgaggatcaccgactgagcaatcgtcgagatctcgaggatcgtgtggatcgccgagaagttgtcgttcaccgcgtagaccccgggctcaccacgcacgaccgcggcgatcgccggtgcctctgccgggttgaccagcgagacacgatagaacgtcgggacctgcgattcaggcaccgcgttcacgagatcgggctggttggcgaggaggcgacggaagtcttggtaggcctgagcccgtggcacgtaggagtacgagcgcaccgtcggcagctgatggagctccgcctcgagcgcacggaactccgatcgcgtcgcgttcggctgcatgaagacgaggagctgcacgttgccctgccactcgctggtcgcggtctggacaccctgcttgatgaggagcgcggcccctaccagcgacagcgacaccgtcaccgtcaagatggccgccagtgacatcaagcgattacgccacaggttggtcgcggtctcgcgaaggaagtagcgcagtgcggtcatcgaccctccactccgatgccgtagacgcctcgaacctgatcccgctggacggtgccggtaccgatctcgatcacgcggcgccgcatggcgtcgacgatgctcgagtcgtgggtcgccatcacgaccgccgtcccggtgcggttgatccgctccagcaagttcatcactccccagctcgtctccgggtcgaggttgccggtcggctcgtccgcgagcaggatcagtgggcggttcacgaacgcccgagcgatcgcgactcgctgctgctcgccaccggagatctgcccggggagtcgatccgccttgtcctcgaggccgacgagccgaagaacctggggcacctgctggttgatcacggaacgcggcttgccgatcacctcgagggcgaacgccacgttctggaagaccgtcttgttcggcaggagtcggaagtcctggaagacgaccccgatgttgcgccggaagtaggggaccctccagttcggcatggtcacgaggttcttgccagccatccagatcgtgcccgagtcggggcgctcctcacgcgtcatgagcttgatcagcgtcgtcttgcccgatcccgacgacccgatgaggaagacgaactctccacggccgatctcgaagctgacgtcacgaatcgcagacgacgatcccgcgtactgcttcgtgacatgctcgaagcgaatcatgcagctccttcccccgggcgcctgcccggtgaggtcacgcagccgctcatcctaccattcgagatcacccatcagggtgcttctcgcgcctccaggcgaggaacgcctcgatgaaggggtcgaggcgcccatcgaggactgcttgaacattgcgatcttcgtacccggaacgatggtccttgaccaactggtagggcgcgaggacataggagcgcacctgattcgcccaaccgacgtccacccgcggcccgctcaaggcatcgagctgtgctcgctgctcttcgcgccgtcgctgctccagcttcgacaccaggatctgcatcgccttcgccctattctgcaactgcgaacgctcgttctggcacgacaccacgattccggtcggtaggtgggtgatgcgtaccgccgagtcggtgacgttgacgtgctgcccgcccgctccggacgaccgatacgtgtcgatccgcagatccttctcgtcgatgacgacctcgccagcgtcctcggcgagtggggtcacgtccagtgacgcaaagctcgtctgacgccggtgctgggcgtcgaacggcgagatgcgcaccaaccggtgcaccccacgctccgcgacgagcaagccataggcgtagcgtccgcgcacgatcgccgtcgccgacaagatcccggcctcttgtccctcggtgacctcgtccacctcgaactcgaacccgcgaccttgggcccaacgctcgtacatgcgcagcatcatctgggcccaatcctgggcatcggtgccaccggcacccgagtggatctcgagcacggcatcgctctcgtcgaactccccggcgaggagcgagcgaatctcgatcgcatcgaggtgcgcagccagcgacgtgaggacgtcctcggcctcggcggcgagatctgggtcgtcgtcggccatctcgatggcgacgttgctgtcggcgagcatggcgtcgagtcgggcgatgagctcgacgtcgtccttgagcgtgccgtagcggcgcgagagctcgcgacccttcgcggggtccgaccagaccccaggatcggcgagtgcggcctcgagctcggcaagctctgttcggcgatcgtcgatgtgcaagaacgctcgggcccgctcgagacgctcggccagtgcccgagctcgctcggcgagttccgctctcgtcacgccgaaccgccctcggactcaggaccctcggtgacgtcgcgagcctcgcggatgaggtccaagatgctcatcgcctgcggatcggtggcgccgaagtagcgcgcgcccgacaggtcgagcttcggcacgttctgcgaggattcggttcggaacaggtaccgcacgaagtcgtcctcgatgcggcgcattagctcctggaacatctcgaagccctcttgctgccacgcgacgagcgggtcctgctgacccatggcacgcaagttgatgccctcgcgcagatagtccatgtcgatgagatggtcgcgccagtgctgatcgatgacgcccaagagcacgtcgcgctcgagcgctcggagcctgggggtgccatcggcatcggcaccgagcgcgcgttcgcgctcgtcgtagagctccaaggcctcgacgaccagcgagctcacaagttgatcgcggctctgcgcgtcggcgagctcctcggcggtgaaggcgctcccccaggttcgccgcgcctcgtcgaccaggcccgcaaggtcccagtcctcgccgtaggccccaggagcgtagacgtccgcgacacgccgaaccgtgcgctcgatgctctggcgagcgaactccgacagatcctccccttcgaggatctctcggcgcctggcgtagatgaccttgcgctgctcgtcgagcacctggtcgtacttgagcacgtccttgcggatgtcggcgttgcgcgcttcgaccgtcgcctgggcacgctcgatcgctcgcgacacggccttggcctcgatcggttgatcctccgggaacgcacgattcatcacccacgacacgacgctgccacccgcaaagatacgcatgagttcgtcctcgagcgagaggaagaaccgcgtctcgccggggtcaccttggcgacccgatcgacctcgcagctggttgtcgatccgacgagactcatggcgctccgagccgatgacgtagagacctccgagcgagcgcacctgctcaccttcgtcggcgcacacctgttggaacttgccgagagcttcctcgtaggcagcacgtccctcatcggtcgtggggtcgagtccggcttcgcgcaccgcgatcgccgcgagcccctcggggttgccgccgagcaagatgtcgacaccgcgcccagccatgttcgtggcgacggtgacggcgccgaggcgtccggcctgggcgatgatctccgcctcggcagcgtggtacttcgcgttcagcaccgcatgcgagatcccgcgttctgcgagcagactcgagagcaactcggacttggcaaccgagaccgtgccgacgagcaccggctggcccttcgccgatcgctcggcgatctcctcgacaacggcgccgaacttcccgagctccgacttgaacacgaggtctgcgcgatcgacacgttgcacgggtcgattcgtcgggatcggcacgacctggaggccgtacgtcgaggcgaactccgcggcttccgtctgggccgtaccggtcatccccgcaagcttgtcgtagaggcggaagtagttctggagggtcacggtggcccaggtgtggttctcctcctggatccgcacccgctccttggcctccacggcctggtgcaacccgtccgaccaacgccggccctccaggatgcgccccgtgaactcgtcgacgatcttgacctcgccccggtcgacgatgtagtcgcgatcgcgcaggtacaggtgctttgcccgcagcgcctgggtgagctggtgcaagtagcccatgtgcgcgatgtcgtagaggttctcgaccccgagcgcgcgctccacccgttcgatgccggcctccgtcgggaggacgaccttcttctcctcgtcgatctcatagtcgacgtccggacggagggtgcgcacgatcgaggcgaagcggtagtagagatcggggctcatctccgacggccccgagatgatgagcggcgtgcgtgcctcgtcgatcaagatggagtcgacctcgtcgacgatggcgtagtggtgcggacgctgcaccacctcctccaacgacgtcgccatgttgtcgcgcaggtagtcgaacccgaactcggtgttggtgccgtaggtgatgtcggcgaggtacgccgcgcgcttggcggcgggatcgctctcgtcggccccgacccgaccgaccgtcatcccgagggcggcgtagatgcgtcccatccaggcggcgtcgcgtgcggccaggtagtcgttgaccgtcacgatgtgcacgcccttgccctcgagcgcgttcaggtaggccgggagggtcgacaccaaggtcttgccttctccggtctgcatctcggcgatccacccgaagtggagcgccatcccgccgagcagctgcacgtcgtagtgccgctgaccgatcgctcgccgagcggcctcgcgcaccaccgcgaaggcctcgaccaacaggtcctcgagagtctcgccctcctcgagccgctgacggaactcggcggtcttcgcacgcagtgccgcgtcgtcgagttgggcgatctcgggttctagctggttgatgagcgggacgactgcctgcagacgcttgaggcgcttgccctcgcccgctcgtaggatgcgatcgaagatccccatgggctcgctcgcggacgacgctcagtcggcgacgcccgcaccctcctcctcggcttgatcgatgagcccgacggtgccatcctcccgccgatacacgacagcgggccgcccggtctcctcattgatgaacaggtagaaactatggtcgagcaggtccattcggaacgcggccgactgcgggtcgagcggctggagcgcgaaacgcttgcgccgcctgatgtcgagtcgagcctcgggtgcttcggcgccaccgcggtgatggggatggctgcgggccaccagtcgacccttcagacgctcgaggcgccgcttgagccgctcctcggcacggtcgaaggactcgagctccgtctcgcccacaccgcgtgcgcgcacgaccgccttcgagaccacgtaggtcacctcggtcacgacgcggtccggattggctgggttgccggctcgctcgacatgcacctcgacccgctcaggggcaccgaggtacttctcgagtcgcgcgatacggtcctcgacgtgcgcgcgctgctgctcggtcagcgtgcagcctcgacaccgaaggtcaactgccatgggccacctcctatcgggtaccgacggtccatgaggccaagtatgcctcttgctcaggagtgagcacgtcgatccggatccccatcgctgcaagcttgagggcggcaacctcggcgtcgatcgactcgggcacgccgagcaccgacggctcgaggcgctgcccctcgcgcacgagccactccacgctcaacgcctggttcgcaaagctcatgtccatcacgctggccgggtgaccctctgcggccgagagattgacgagacggccctcggcgaccaccatgacgcgagccgtggtgcccgactcgctgtcgaccaggtactcctccaccatgggtcgcacgggtcggcgacgctcccctggggccaaccgcgccaatccctccaggtcgatctcgacatcgaagtgcccagcgttggccaacaaggcaccgtccttcatacgccgaacgtgctccggccggatcacgtcacggttcccggtgacggtgatgaagatgtcgccctcggccgcagcctcctccatgggctcgacacggaacccatccatcaccgcctcgagggcggccaccggatcgatctcggtcacgacgacctgcgcgcccatcccgcgagcgcgtgaggcgacacccttgccacagaaaccgtaacccgccaccaccaccgtggtccccgcgagcagcacgttggtcgcccgaatgatgccatcgagcgccgattgacccgtaccgtagcggttgtcgaacatgtgcttggtcttggcgtcgttcaccgcaacgacgggatagccaaggctgcccgaggcctccatggcccgaagtctgatgacgccggtcgtggtctcctcggtgcctccgaggatgcgcttcacctggtcgggacgctccgcgtgcagtcgggagacgaggtcacacccgtcgtccatcgtgatggtcgggtccgtgtcgaggacctggtcgatgtggcgatagtaggtctcggtgtcctcggcccgaaccgcgaacaccgggatgccttcgtgcttgaccagcgacgccgcgacgtcgtcttgggtcgagagcggattggacgcgcacgccacgacctcggcgccgccagccttcaacgtacggaggaggttcgccgtctccgtcgtgatgtgcaggcacgccgcgatgcgcacgcccgcgagcggtcgctccgcctggaagcgctcccggatgccacggagcaccggcatggttcgatccgcccacgcgatgcgctggcggccctcgtcagcaagcccgaggtcacgtacgtcgtagtccacgttgatcctttcgaagaggtctgatcgggtcggccgcggactaggccgcagggccgctgaggtactgcttgagtgcgttcagcatcggaatgggtccaggatccgttccgagtgcctcggcgaggcggagcgacatgacgtcgccgacgaaggcgaggtcgaagaacgtcgcgagttcgcccaccccctggccgtggaccgagaccgctcgatgcactcggggtgcgatctcgcgctccatgaaggcgacccgccgtgagatctgcgggtgctctccatcgtggcgcaagaacaccagcgacacggtggacgcgagcagctcggggtaggcctcgaaagcggtcagctcgttgtggcccgcctcgggcaacaccgacgcaaccgcgagtgccttggcgttctcgttgatctggttcttccatcgcagcgccgccacctgaccgacggcacccgatccgagcacgatcgggatcgtaccgacgagcgccgaagcgagatcggaggcgagcgtccccttctcgagttcgtcgcgtcgctggcgaagacgctcgatggcatggccgatccaggccgaggcaccggggaagaagccgacccgctccaacacgccgagcagcgacaccgtgagcgcaccgagcgccgctcgcggctgcgggatcgagccatcgatggcgacgtgacacacaccgcgctcggcggcaacacgagcgagctccccgccggccgagatggcgacggcgcgagcaccatgatcgagcgctcccgccaggacttcgagcgtctcctcggtgttccccgagaacgacaacgccacggccagcgagcgtggaccgacgaacgaagggagctcgtagcccttcacgaccaccacggggatgggcatgtacggagccgccgtcgccaccgcgacgtcacccgcgatgccgctcccgcccatcccgagcaccacaacatgctcgacctggtcgggagcgggaagatcgcacagtcggccaacggtaccgagggcggcttccatctgctcggggagtccgagcgtcgcatcccacatgcctagttcgtccacggcggtcctccctcgggatcggtgttggatacctccccctccggcgagaggccagcggcgactaggagcgcccgatggcgctcgtcatcgaccacctctgcatcctcgaccagcagatccgcgataccgtctgtgaccgcataggcacggtggaggcggggattgtagagcactgactccgactcgatccagagcaggggcccgtggtcgagcggacaggcgacgatggcgagcaggtccggcgagagcgcactcatgcgtcgcgagactccgccttcgcgacgacggcgagcacctgctgcgtccgccgagcgacctcgtcggaggtgcgtgcttccaggttgaggcgcaagagcggctcggtgttcgaggcccgaaggttgaaccaccaatcggggaagtcgatggtgagcccgtcgaggtgatcgacgcgcccttcaccggcaaaggccgtctcgacgaaggcgagcacctcgttggcgtcgcgaaccttggagttgatctcgcccgacgccgcgtagcgctcgtactccttacgcagcgtcgagagctccacccctgcgcgagcgagctcttcgagcacgttcaccgcgccgatcacacccgagtcggcccggtagttctcgcggaagtagtagtgccccgagtgttctccagcgaagatggcaccggtgcgagccatctcggccttgatgaacgagtgaccgacgcgcgtacgaatcggcaccccgccctgttcacgaatgatctccgggacagcccgggagcagatcaggttgtagaggatggttgcacccggctcgcgctcgagcatgcggcgcgcgatgatcgcggtggtggtcgatcccgacaccggcgcggcccggtcgtcgaccaggaagacccgatccgcgtcgccgtcgaacgcgagcccgatgtcggcaccctggctgagaacccgtgccttgagatcgatcaggttctcgggctggatggggtcggcaggatggttgggaaagctgccatcgagctccggatagagcacatcgagctcgacgtcgagtgccccgaagacggctgggaccacgaggccgcccatgccgttggccgtatcggccacgatgcgaagacccgcgagcgacgacgcatcgacgaagctgagcacgtggtgcacgtaggcatcgagcaggttgtcggtggtgcgagccccgcgagcgccgctcgcgctcaccggagctagtccctgctccacgagcgcttcgatctcggcgagaccggtctcgacgccgatgggagcagccccgggaccgcagaacttgatgccgttgtaggaccctggattgtgcgacgcggtcaccatggcgccgtgcgcatcgagtcggccgctcgcgaagtagagcatgtcggtcgagcagagcccgagatcgacgacgtcgaccccctcgaccacgagaccgtccgcaaaggcactggccagctcttcggacgagaggcgcatgtcgcggcccaccaccacgcggcgcggaccgagcgcgcgcgcaaaggcacgaccgatcgcgaaggcgatctcgccattcagttcgtccgggacgacgcctcgaacgtcataggccttgaagattccactcatcgtcgcagggcactccttcgaccgccgcccaaggtccgtccgagcgacgcggccttcgggcaccacggcagcttaccgcaccggcccgggacgtaggatcgacggcttcaggcgcgctggcgacgacgggatcgtcccgaccgagcatcctcttcgacgagcgacacgacgtcgtcgacggtgaccgcatcaccatctcggcgccaccacttggccccgcaggcagcacaggagatcagcgtcagcgcgtggcgagccacgtcgaggtcgatgatcaccaggtcccgctcgcggcacgccggacacactgtgtccatgagacctccctctctcgtgggcctttggacccgatccaggcttcggcacctggggccaggatctttaccaaatgttgagctcgcgagctggtgcttcggcgaccgccccgctcacggaccccgagagggctacactcacaccatgcacgtggcccctgagcagctcgacgacgtcgagcgcatcgcccgagccgccctcgcccgactcggcaccgagggcatcgacgacgaccaagagctcgcgtggcgcctcgcgcacgtcgtgagcgctctcggcgccgtgcgagcactcgtggacgatccggcggtaccccaagcgctcgcgagctacggtgcagccctgttcctgcgggaagcggcgagcgagctcgtcgcgctcggcgtcatcgacgacctcggtgcgcttccgctcccaccgcgaccgtccgaggcggccgctgccgaggtcgccgaggcgcccacgacgtggtcgctgggggccgacctcgatctcgcacgcgacaccttcgggcgcttcgcgcgcgacgagatcgcaccggtcgccgacgaggtccatcggcgcaacctcgacgtacccgagcgcatcatcgagggcctggctgggctcggcgctttcggcctcagcatccccgaacgctacggaggctccgccaccggaagcgtcgacgacacgctggccatgctggttgcgaccgaagcactctcgcaggcctcgctcgggatcggcggctcgctgatcacgcgccccgagatcatcgcccgggcgatccttgccggtggcaccgaggagcaacgggtccgctacctgccagcgctcgcgtcgggcgagctcatgggcgctgtcgccgtaacggagcccgactacggctccgatgtcgcctcgatcacgacgcaggcgatcctcgggcccgacacggccaccgtgcgcggcacgaagacctggtgcacgttcgctggacgcgccaacctgctcgcggtcctcgcccgcaccgagcccgacccgagcctgcgtcatcgagggctgtcactcctcctcgtccccaaggatcccgtcccgggccacagcttcgacctcgagatcggcgggggccggctcacgggccgcgcgatcgacacgctcggctatcgcgggatgcactcctacgaggtcgccttcgacgacgtcagcgttgcgcgcgagcagatcgtcggcggcgaggagggacgtggccgagggttctacctccagatggctggcttcgagaacgggcgactccagacggtggcgcgagcagtcggactgatggacgccgcacttgcgcaggcgcgcgcctacgtcgccaaccggcgcgtgttcggacgcagtctcgccgactacaccctgacccggcgcaagctcgctcgcatggtcgcgacggtggcggcggcacgggccgccgcctaccgcaccgcacgtcacctcgagacccccgaagggtcgctcgcagcctcgatggccaaggcatggtcgtgtcgccaggcagagttggtcacgcgcgaagcacagcagcttcatggtggcatgggctatgccgaggagtacccggtgagccgttacttcgtcgatgcccgggtgctctcgatcttcgaaggcgccgacgagacgctgtcgctgcgcgtcatcgcgcgagcagtcgcatcgtccagcgagacgacacgatgagcgccctccgccgcctcctcggcgatctgctgtactgggccggcctcatcgccggcacgggggccatcgtgatccacctgttcacacttaccgtgctgacgcccgggcgcctcacccaacaagcacatcagctgctctcagccagcgtcgtccagcgcgcgatcgccgactcgctcgccaacgcgctccaacccatcgcttcggctcagggcgtccagctcacgtcgagcgaaaccctcgctgcggtccacagtgcgctcagctcgccgctcgtccagagtgacttcctcggcgccatgacgaccgcgcaagatcgcctcctcgggaagaccagcgcacccgtcgtgatcggcggacccgccttcacgcaggccatcgccgccagccttgcatccgtcgacccgtccgtcgcccatgtggtcgcaggcgaggacctcgccgtcaccgttcccggagccgacgtgcccaaccttggcttcatcgccaccaacgccccgcgcaccgagcacacgctgacggacatcgcgctgctcgccctcgtcctcgccctcgtgctccacaacgaccggcgcaagctcctcgcccgcatcggcacctggctcgtcggctgctcgatcgccgaggtcgccttgttctggttcctcccgaaggtcatcctgccgcacgtcggcttctcgtgggcccagttcgccgcggtggtcctcacgatgaccggggcggccacggtcacgttcttcctcgagctcttcgctgcaggcgccgcagccatcgcgctcgcgcgcggcgcgaaggcgctggtgtgatggctcagccgacgagcgaagcctcgacgatcacattgtcggcataggacccgccgacgccagggacctcagtgaacggtcccccacaggtcaccagcgcgagtgtgggtggcccttgggtcgtgaagagctgtggatgcacgacggtgttcggcgagagcaccggcttcgtgtcgactcgccactcggtctcgcgcccaccccagttgagatagacaagatcaccggggacgagctggccgatctcgccgagggcgccctcgccctgcccgacccagttcacgtgcccagcgagcagcgtcactccgggcgctccgggcgatggcgtctgctcgtcccaccccaccgtgtgcacgtcggacgggatggtcagctcaccgttcaccggcccctcggcgaccaccggcgcgctcacggcaagcgcagggatggagatctcggcgacctcgcccgacacggtcggcgtaaacggcacgagacgactcccgccttggcggggagcgatcgctctctggctcgcgagtgaccgggctcgcacgtgatcgaggtgggtcagacgcgcgatgcgagcagccggcgacgtcgcgataccgtcgtagacgagccagccccccgcaacgatcgcgagggcggacccgcccaccgcgagccggcgccaacgagcgctccgggcgcgctcagcgacgctcatcgtgcctcgcgcggagggaacgacgacgtacggcgaccgccagcgtcccacatcccacgccaccgagcacgatgccgatgggcaccgcagcggtcgtggtcgacggagcgacccttggcccggtcgcgagcagcacgggcgtgaccgacgtcgagctcgtgcgaggtgtcgggagcgaggtcgacgaaccggaggtcgtgggggtgggtcccgagcctgtcggaagcgaggtcgacgatccggaggtcgtgggggtgggtgatgggcccgtcgagccagacgaaccggagccagaggacccctggccttcccccctccaggttgacacctgctataggaggaagggatgagccagacaccgaacccaccaccgggcgacggccccgctggacgacgacgcggccgctacccgagccagttccgcaaggacgcggcagcgttggttctcgaccagcgccgcaccatcgctgacgtcgcccgtgagcttggcatcaacgagcagacccttggtaactgggtccgtcaggaacgcatcgaccgaggtgagcgagagggcctgacgagcgccgagcgcgaggagctgacacggctgcgccgccaggtcaagcagctcaccgtggaacgcgagctgctcaagcgagcgatggccttctgggtgaaggaggggggacagtgagccgctaccactggatctcccgccaggaggccaagggcttctctgtagcggcagcagcacgagtcatcggggtctctcgccaggcctactacgcctggcgacaccgtcgggaccgaggcgaggatcccgagcacctggtgctcgcgagcgagcttcgcgccatctggcacgagagcgacggcacctacggcagcccccgcatcacccacgagctgcgacggcgcgggttctgcgtgaaccacaagcgggtggaacgcctgatgcgcgagctcgagatggcagcgggcccacgccggcgcttcgtagtcacgacgaggcggggagaggacgcagcgctcccggacctcgtccgtcaggacttcgctcctggtgagccgaagcgcaggtatgtgagcgacatcacctacgtccgcaccgatgaggggttctgctatctcgccacggtggcagatcttggctcgaggcgcatcgtgggctggtcacttgggcgtcacatgcccgatgacctggtggtcgaggcgatccgcgaagcactcgggactcggggcagcctggctggggcgatctttcacagcgatcgcggcagccagtacctctcccggaaggtacggagcctgctcgcgacccttggcattcgccagtcggtggggagggtcgcgacctgctacgacaacgccgtggccgagtccttcttcgggagcttgaagcgcgagctggtggctcgctaccgcttcgcgaacctctcaggggctcgctctgccatcgctagctggattcaccgttacaacacggtccgcctgcactcaagcctcgggtacctaccgcccgtcgagtacgagctctcctgggcctgccgggaggtggccgtggcctaaattcagactgtcaagcaaatggggggaagcccacccgaacccgacgaaccgccagagctggtcggcgacgcggggacggtcaccgtcacctggttggacggagtcgtcgaaccgtcgtagctcacggtggcgacgttggtcgcgctctgggtcgccggcgccgatgccgacaccgtgaccgggatcgttacggaaccgaggacggtgccgctcgccacgtcgatgggctgaccgttcaccggcacgagcgtgcaggtcatggtcccagctgagatggcacacggtttcccgcccggagcgctgtcgctcaaccccgccgacggcgtgaagctcggcgagccgtagctgagccaggtcacgctcggcaagttgtcactgaccgtgagcgggtcggcgatgatgcccgagcccatgatggtgatcgtgtactcgccggtcgtccctgggctcgcgaccgaggtcgggctcccgccgctctcgtaccccttcacgaccgtgaacgtcggtggggcaggctgtgggagcgtgcccacgaacccgtggggcgcggtgtggacctcggggaccacgacacaggggacccccgccgtctggacgcagctcgcagtgttcgacaaggttccctcgatgacgtccccgtcgatctgggtgccgccggtgatggtgccgaagggcgcgaggagcgacccctcccactgcacgccacccgagcctcgctggccatcgagcgtgatggactgcgtcgcactcgacgacggcggcgcggcgacgaagatcgccctgctggcgcccgtcgcgctcaccgacgtgatgaaggagagatccgcctgggtcgggagctggacgatcaaggtggccgacgagggcaccgaataggcgagcgtccactccggggacgccgggtacgcggcctggccggcctcgatggcagccaacgcatgaccaaggttcacgacgacgtcccccgtctgcgtcgacgggacgctgatcgtgatcgtcggacccgaggaacccgtcgtggggtaggtgacgctcgccccgctcgtcaccggcaggcccgagagctcctcgtcgagggcctcgagataggtgttctctgcggcaaagtcgagcggactcgttggggacgccgtcgtcaccggcccgctgccgttgttgtagagcgtccatgatccctgcgtccccgtgggcgtcggggagactgccgccccgtagttcccgaggacgaacgtgcttccgctctggacatcgggtgcaacgagcgcgtcacacgtcacgcccggggggcaggagaacccggggaccttctttccgtcgacggtgaagctcgtcccatgcgcggtaccgatgctgccaccgaaggccgcccatccggtcgtgtcgaccgaaccctcgagcgtcgcgtcaccgccaccgacgtagaagccgtacggaaacggattcgccccgccgagcgtccaagtcgtcgagtcagaactcgcccgggcgccggtgccgacgagtccgaacgcgcccgccatccctgccgacgcgactgcgagcgcaaccgcgccaacgaggcgtcctcgccacgcgaggtgtcgacgctgcctcgtgtgacgacccctcctggtgcgccgccgcagtcccctggtctccgcctcgtccatgtgcgctcccaaccctggctaccggagccggccacccaaccatggccacgctgtgtggttcgatggtactacgtcatgtggcgtcttcgccacattgccctcaaggtttgcaccatcgttgccgataaggccacctggccgctgttcaggaccgcgccttggcgacgtcgggaccacgacggtcctcttgaggcgctcgacgctcagcgtgagggcaggctccctacgaggccaacgaccgatgcgtcagcccacgcactcctgtggcgctgcaccagcgcaccaggccactcgcactcggtcgccgcagcgacggcgctacgacgccgacggcgtcatgccggcgcgacggccacggagggcgaacttctccgccatcttgcgactcgcctcgtcgatcatctcgtccccgaacatgaccgctccacgacggtccgacgtcgtggcctgctcgtaggcgtccaagatggcgacggcgcgatcgaagagttcctgtgacggacgatacgtgtcgttgaggacgtccacctgcgtcggatgcaacgcccacttgccgtcgtagcccagcatggccgatcgaagcgcggaggccttgaggccctcgaggtcgtggatgcgcaagaacgggccgtcgatcacctgcagacccgccgtgcgcgccgccatcaggatcttcgagaggacgtagtgaaagtggtcacccggatactccggaatcgcagccccaccggtgagcaccggcagctgcatcgacgccgagaagtccgccggtccgaagacgagcgtctcgagccgtgacgacgcggttgcgatggcctcgacgttgatcagtccccgggtcgtctcgatctgggcctcgatgccgatgtggccgcgctcgagtccgagttcggcctcgagctgcgtgagaacgagatcgagcgccaccacctcgtcggggcgctgcaccttcggcaacatgatctcgtcgagacgcgggccagcccctgtcaccacctcgatcacgtcgcgcaacgtgagcggcgtatcccaggcattcacccggacgcacaccacccgctcgccccagtcgaacgagcggatcgcacgggccacccgcccgcgggcctcgagcttctcgctgggtgcgaccgagtcctcgagatcgaggaacaccatgtcagccgggatggtcagcgctcgctcgatgaagcgatcggacgatccaggtaccgcgaggcacgaacgacggaggagatcacgagatcgggcacccatgggccccagcgtaccaatgcgggtgggtccgcgtcagctcacgcttccgagagctcgaaccacaagaacccgtacggcgcgagcgtcagtgggtagcctccgtcggctgggacctcaggaaatggggtcatgccgagcagctccaccggcacaaagccctcgaacccacgaagatcgaggcggcagggctgagccttcgaggacagattgctcacgcaggccacgacccgctcgtgctcctcgtcgaagcggaggtaggccaagatcgccggattgtcgacgtcgcgcagctcgaaggtaccgtcaccaaagactccctcctggcgacgcgcgagcaggagctcgcgcagccatctgaggaacgacgacgggttgcgcatctgcgattcgacattgacgacctggtagccatagaccgggtcggtgatcggggcgaggtagaggcgctggggatcggcgcgcgagaacccgccgttacgatcgggcgaccactgcatgggggtacgcaccgagtcgcgatcgccgaggtagacgttgtcccccatcaggatctcgtcgccgtagtagagcaccggtgagcccggcagcgacagcaggagcgcgtggaggagttcggccacgcgacgatcgttctcgatgaggggcgcgaggcgccgaccgatgccaacgttgcgtcgcgcgatgggatcggacgcgaaggccgcccagagaaagacgcggtcctcttcggagatcatctcgagggtgagttcgtcgtggttacgcaggaagatgccccactggcaccgcggcgggatcggtggggtctcggcgatggcgtcgcgaatcggctgcgcactctcctgcttcaccgccatgaacagcctcggcatgagcgggaagtggaagcacatgtggcactcgtcgccctggccgaagtactcaacgacctgggccggaggctggttcgcctcggcgagcagcaccgcgtcgggaaactcggcatcgacgagcgccctgatccggcgaaggaacgcgtgggtaccgggaaggttctcacagcgcgtcccctcggcctcgaagagatacgggaccgcatcgaggcgaaaaccgtcgacgccaaacgccagccagtagcgcacgatctccagcatcgcctcttgcaccgccgggttctcgtagttcagatcgggctgatgagagaagaaccgatgccagtagtactgttcgcgttctggcgcccacgaccagttcgacgactcggtatcgacgaagatgatcggggcgtcgcgatacccgtcgtccgtgtccgaccacacgtaccagtccgccttcggattgtcgcgcgacgagcgcgactccacgaaccatgggtgctggtcgctcgtgtggttcagcacgagatcggcgatcacgcgcatcccgcgcaggtgcgcctcccgaagcagctcggcaaggtcgtcgagggtgccaaggtcgggatggaccttggtgaagtcagcgacgtcgtagccaccgtcgcgcagcggcgactcgtagaacgggagcagccacaagcagtccaccccgagccactcgaggtagtcgagcttctcgatgaggcctcggaggtcaccgacgccgtcgtcgttcgagtcgtagaacccgcggatcagcacctcgtagaagaccgcttgctggtaccacgcgggctcgccctcggcgccccgcagcgaggcgaaccggtgttgggccatcaccgtcccacgaagttcgctcgtcccggcccatcggtcaggaacgaccgcacaccgatgcgcgcgtcctcggtggtgaacacctgcgcgaagagtgcctgttcgagcgcgagcccctcctcgagcgagccctgcgtcccctcggcgagcgcgaccttcgcgaacgcgagtgctgcgagcggacccgacgcgaagcgctgcgcccacgctcgcgccgcctcggtcgcctgccctggctcgacgacgcggtcgacgagccccacgccgagtgcctcggcagccgtgagcggctccccggtcaggacgagacgcttcgcgaccgccaacccgacgagccgaggcaaccgttgtgtgccgccgccacccgggatcaagcccagcgagatctccgggaggccgagcttggccgacgaactcgccacccgtaggtcgcacgcgagggcgagctcgaggccgcccccgagggcgtacccctcgatcgctgcgatcaccacgcgtgggagcgccgcgatggcccccaacgcgcggtggaacgcccgggcggtctcccaccccacggggcgctcgtcgaactccgcgatgtccgcgccggccgcgaagatgcgatcgccacccgtcacgaccacggcgcggggcaagtctcgctccaggtccgaggccgcggctgcgagttcggcgagcaccgcgcccgagagcgcgtttgccttcggccgatcgagccgtacggtggcgacgcctgcatcgtccctctcgacgtggacaaactcactcatcggatgaccctcctcgtgctccgtgccctggagcgatctcgagcgcgtcgaggagtgcgtcggccgcggccccagggtccacggtgcccgcctccacctgcgcccacactgcctggtctgcgtcggccgccgcccggaggacgcgatcgacgatgacacgctccaccgcgcgcctccgccgcgcggccacgcgcgacttcaagatgcctcgatcgtcgagttcggccgcgagcgccacgacggcctcggccaccgcatcggtgccctcaccgctcgtcgcgaccgtctcgagaatcggggggcgcggctctcgatggccgagatcgagcatcgcgacgagatcacgacgcgtctcggcgagccccgcacgatcggccttgttgatgacgaagaggtcggcgatctccatgatgcccgccttgttggcctggatggcatcgccccagcccggcgtgatgacgaccaccgtcacgtccgcctcgccgacgacctcgacctccacctgtccgacaccgacggtctcgatcacgacgaggtcgtagccgaccaacccgaggagtcgaacgatctcggggacgctgcgcgcgaggccacccagcgcaccgcgggtcgccaccgagcgaatgaacacgtcggggtcgtgcgtgtgcccctgcatacgcacgcggtcgcccaggatcgcgccgccggagaacggcgaactcgggtcgaccgcgacgacacccacgcggtgaccccgggtccgccacgccccgaccaagcgatcgaccagcgtcgacttcccagcgccgggcgaaccggtcaccccgaccacgacacgagggcgcgctgaccacagatcggcgatgccgatcggctcgccggcccctgcccggcgctcgacgaccgagatcagccgtgcggtcgcacccctgtcaccagcacgagcccgtccaacgagctcttcgaggtcgctcactcgcctccctcgatccagacctgacccccgagtcgctgcaaggttcccgcaagatcgtcgtagccccgctcgatgtgctcgacgccgagcaaccgactctggccctccgcagcgagcgccgccaccaccaacgccgcacccgcacggatgtcgtgcgcgaccgccgtcgcaccgtggagatgatccacgccgcgcacgacgacgtgatggccctcggagatgatgtccgcgccgaagctccgcagctcgtcgaggtagcgaaaccgaccgctgtagagattctcgctgaccaccgagactccctgggcacgcgtcagcatcgccacgagcatgggcttgtagtcggtcgcgacccccggatagggcagcgtctggatgtccccggccctgaggcgctcagtgacctcggcgacgagccgttgacccgcgtcgtcggcctcgatgtggaagccgaggccgctgagcttgcgcagcaggatctcgaggaccctcgggttgacgccgacgagctcgagacgcccggtcgtcgcaccgagcgcggccaggtaggtggccgcgacgacgcggtcgccgatgacgcggtgacgcaacgggcgcaggcgctggacgccctggacgcggatccgagacgtccccgcaccgtcgatccgcgcgcccatcgacacgagcgcggtcgccaagtcgacgacctctggctcacgagcggcgttgtcgatgatcgtctcgccgctcgcggtgacggcggcaaggagcgcggtgtcggtccccgtgtgggacgggaactcgagcgtcaccggcgcacccgcaaggggggagcccttcacgaggaccgatcccgcgtccatcgtcgccacggcaccgagactggccaacgcatcgagatggatgtcgatcgggcgcgccccgaaatcatccccacccggcggcgcgagccgcaccgcgccggtgcgcgccagcaacggtgcgaggagcacgacggacgcgcgaatctgcccgacgagttcggcaggaggttcgctcgacagcgacgccgcctcgggcacctcgacctcgacgacgtgcggctcgggccaggacacccgagcccccacggcctcgagcaggtgggccatgacggtgacgtcactgatggccgggacgttctcgatacggtgacgaccctcggcgagcagcgtcgcggccatgatcttcaggaccgagttcttcgcgccctgcaggcgcacctcaccctcgagccgcgacgtgtgttggaccatccacgaacgcatcgcgcctccctcacgctctccacgccaaccggccacaacctactcggcgccggcgcccggggccaatggcggcgcgtcctcagggttgaggtcctcgagcgtacgagcacgcgtctctggaaaggcgatcagcaccagggcagcgagcgcgatcggcccgatggcgagcgcggcgatcggggtgccgtagcccaatccagccgacgcggccgccccgaccgcgacgagtcccaccacggtgcccaccctgctcgcgatcgcgatcacaccattggccccagagcgaagcctcgtcgggaacagctccggtccgaacaccgccagcgccggcaccgccatggtcccgaccgcttcgccgacggcgtagagcaccaccagcgccacgccgtgggcgaggaatgcgagcgcgaggagcaccccgccgaccgcgagcccaacggcggcgagcacgcgccgaccgaccgtctcggcgaggcgcgcaccgaaggccaggccgatcccagatggcaggttggcgccgatcgtgaacgccgagatctgccaggccgcaaagtggcgatcgacgcgcaagaactggttccgaaactgggaagccggcaggtagaacaggttgaacagcgcggcagcgatggccacgaggatgagacgaccgcgatgctcccgagaggtgagttcgcgaaagcgcacgggggtcgagtgccgaaagcgggccggatcgcggcggtgacggaggcgtgggacgagcacgaggccgacgatcgcgatcgcgaacaaggcgcgccacgcctcgggtgcgatcccaagcccagccaccgccaccgcgcacagtccggcaccgagtgcggtcgcgagcaccagaaagcccatcgtccacgctcgcccctccgcatgcaccgtctcggcgacgatgacgttcgcgagcagtacggcaaccgtcgcgcccgccttggcgagcacctgggtcacgacgaggccggcgaggtccggtgccagcgctcctgccgccgtcgcgagcgtcgcgagcacgagcgcagcccgcaggacgcgccaccgacccacacggtcaccgagcctcgcgatcggcaacgcgacgagcacgtcgacgcgcaccagccccgaaccgaccccttgcgcgaggggtgaggcgtggagcgtgggggcggcgaaggcaagcgtctgtcccaggagcgttccgcagtacgcaacgacggtggcgacccagaacacggtcgcaacgacgtccagtgacccctgagggaagacccctggcggcagaacacgccgcaccaaccggcccttgccgcgcaccagacgcccgagtgcccagcgcacgagccagccgagtcccggcgcgccgacgtcgcagcgcacctcccaacggccgtctggcaagcggcggcgctcccacgccacgagcgagcccgatccctgcacgaagcccgccgcgacccgctcctcgacgagcagggcgcacgcgacgggtgcatctggtccagcgagcgacctcacccgcacgctgatcggctcgagatcaggaacccaggtgctcgtgcaggaacggaatcatgcgatcccacgcctggcgagcggccagtgcgtcgtacacctcgggtctcgagtcgttgaagaaggcgtggtgcgtgccggggtagatgaagaactccacgtcggcaccgagttcccgcagccgcgcctcgagagcacgcacgcgatcgggagacgcgaagtcgtcgtgctcggcgtagtggccctggatggcagcggtgatacggctgtagtcgggctcggccccctgccacgggatcaccccgtagaagggcaccagcgctcggacctgcgttggcacctcggcagcgagcacgtaggcaagcccaccacccatgcagaacccgatgacgccgacgccctggcgccccgtgcgtcgctccagttcgcgaaccgcaccgaccatgcgcttggaggcatcggagagctgcatcgccatcatcgccttggcggcctcgtccggctcgtcgacgacacggccgtcgtagaggtccggagcgagggcactgaagcccgctgccgccagccgatcaacgacatctttgatgtgatcgttgacgccccaccactcctggatcacgacgacgccagggcccgtctcgccaaccggctgcgcgaggtagccagtcgcgtcgtggccattcatcggaaagtgcacggtctcgcccatgcgcccatgctagccagcagggagtggcggcgtcagtaacgtccgccgagcttgcggtggtcccagctcacgatccgctcgggctcgaggcggatggcgacgcgcttggaggccgaacggcgcatcgcctccgcggcctccgcagaacccagctcgtagcgagcgagcagaccctccccgacccggcgcaccagtacggggtcgtcgctgagcacggcccgaccctcgatcagcacgccgcggagctcgtcgtagcgatcgccgagttcgacgagcccgctcgcggtcgcctcccgcgcaaggttgcgcgccttctgcgagcgcgcatacgtccacgaccacaccacaccgtcgaggacaacgtaccacaagggcaccatgtggatggtcccacgaggcccgtgactgccgaggacgagtgtcctcccctcgctgagcagggctgcgatctcgtcctgggtcatcgccacgtgactacgcctcgacggcatcggcccctccctccagctgcgccagtccgggggcaagtcgcggccacccgtagcgcgacggcaggattcgccgcccgtcgacgagcaccgccaggtccgcggtcgcgaacaggcgggctcgatgcctgttggcgaccactcgaaccagctcgtcgggcaggagccgccaggtgcacgtctcgaccgtcgacggcccgacgccgcgtcgggcgacgagcgtcgggccaaccgcgagttctccgccacggccatggagtccgcaggactcgaggtgatcagcgagctcgatcccagcccggtaggcctcctccagtggatcgatgaccccgagcacgcggttcgcgagcgcgagcacctcgacgccgacgcggggatgggcgacaaggagccgaagcgcgctcgtgagttctgggggcgtcgtcggctctgcagcgatgacgagcgcaaccgtgccgacggtgtcagcatcggtgaggtcccacgcgctgagctgacgcagcgcttcgagcaagctcatcacccggcttggataccccctcgtgtcatggctgccacgtcgagcacgcggtcgacctcctcctcccccaagacgccctcctcgagcaccaggctcctcaggtcccgcccctccttgaccgcacgcttgacgatggccgcagcgcgctcgtagccgatggcggggttgagggccgtggcgatcgccggtgtcgagagcgcgtacgtccggcaccgctcgacgtcggcctcgatgccgtcgacgcaccgcgtcgcgagcaggcgggacgccgccgcgagcaacgtgacgctctcgagtgccgcctgcgcgatgacgggctgcatcacgttgagctcgaagatcgacccggcggcgcccgcgaagccgatcgtggcgtcgttgcccaccacgcgcgcgaccacctgggtcaccgactccgggatgaccggattgaccttgcctggcatgatcgatgagccaggctggagatcgggcaggcgaatctccgcgagaccacacctgggaccagaacccatccaacgcaggtcgttcgcgatgcgatacagcgccacacccagcgcacgcagactgcccgacaccgccaccacgccgtcacgagctccgtggacctcaaagtggttcgccgcctcgcgcacgtcgagccccacccgagcgccgatgcgtgcgagcaccgctgcggcgaagccctgcggtgcgttcaacccggtgccgacggccgtgccgccgagtggcacctcgcgaagctcgtccaccgcggccgcgatacgggtgcgtgcccgtgcgatctgggctgcgtatcccgagaactcctggccgagcatgatcggtgtcgcatccatgaggtgcgtccggccggccttgaccacggtggcaaagtcctcgctccgacggacgagcgacgcttccaaggtcgcgagcgcagggtcgagcgcgtcgcgaacctcgagcgcgaccgcgaggtgcatggccgtcgggaaggtgtcgttcgacgattgcgaggcgttgacgtggtcgttcgggccgacggtccgaccgaggcggagcgtggccagatgcgcgatgacctcgttcatgttcatgttggtcgaggtccccgatccggtctggtagacgtcgacggggaagtgctcgtcgtggaggccccgggcgacctcgtcggcgacggcggcgatcgcctcggccatctcgggatcgaggacgccccggtcgcgattctcgagcgcggccgcccacttgatcaacgccagcgcgtggatcacctgtggcgccatgcgctggcccgacaccgggaagttcccgatggcgcgctgcgtctgggccccccaggccgcatctgctggaacctccacctcgcccatggtgtcgtgctcgatccgcacccgttcgctcatcgcctgctccttggtcatcgccgcgtggactaccctggcaccgatgcgagctgtcgtgatcgccgacggtgccgtcaccgtcgcaaccgtagccgacccgaccgttggacgccacgaggcccttgtcgaggtcacctccgcagggatcaacgccgccgacctcctgcaggcgagaggcctgtacccgccaccacccggggtcgatccgacccggctcggcctcgagttcgctggggtcgtcgctgcggtcggggacggaaccaccgaggtacgccccggcgatcgcgtcatgggcatcaccggcggcggcgcacaggcggagtacgtcgtcgtcgacgcagccacgctcgtgcccgtccctgacgagctcgatctcgagcgcgcaggaggctttcccgaggccgccttcaccgccctcgacgcgctgctcatccaagggcagctcggcctcggggaccgcgtgctcgtgaccggcgcactcggtggcgtcgggaccatcgggctccagatcgcccgtctcgccggtgcccgcgtcacggcgctcgtacgcgatgagcgacgtgcatccgaggcctatgccctgggcgcacaccgagcactcaccctcgacgagctgccaggttcggggccctacgacgtggtgctcgagctcctcggagcagccagcctcacgcacgccatctccgagctcgcggtcggtggccgcgtcgtggtcatcggcgtcggtcagggctcacgcgtcgagatcgacctgcgcacggtaatggggtcacgagcagccctccgtggatcgacgctgcgcgcgcgcccgacccacgagaaggcagcgctggcccgagaggtcgcccaccgactcctgccggcgcttgccgaaggttcgctccagatcccggtcgccgcgacgtggccgctccacgacgccgccgccgcctacgaggcgttcgcgcgcccgggcaagctcggcaagctcgtgcttgccatcggcgacgtctgacgggttgcgctccaagcgcccgatcctcgcatctcgatccgcaggagctcaccagcgacgatggacgcagagcccaacgacgccgagagctcccaggcatgcagctccacgttccccgtcgggtcgagttcctcggcgaggccgtcgagtgtctgcccgggcgcgatgcgaacgacgcgcacgatcgttccgatgtgggggcgggcgacggcgcgtagcgcgccacagcacaccgcgaccacgacgagggcgagcgtggccgcgacccgcacccgttccccgcgcccgagacgacctcggccgggcggcctcctccgagcgaggcgctggttccgggcggagccccggctcgtcggctccgccgaacgcgccggcggtggcgtagcgggcgtagcgacgatcgcgagcgcagtcgaggcgggaggcgtacgaacgggcgcggtcacacccgtggcctaacccgagggtcggacacggcacgcaaatgtgacggctatttgcctatgcggatacatcttggcgatatactggcgacatgccgaggatcgaagcaccaaccgtccgcgaacatcacgatcagcgtcgtgagcgtctcctcgacgcggcacgggcgtgcctcgtcgacccggcgattcgctcggtcggcttcgaacacgtcggaccgcgcgcagggatccgacgcaacagcgtctacctctacttcccctccgagacccacctgtatcttgcccttgccgagagcgacgtccccgccctcgccaagcagttggccgaggcagcggcggcagccacgcacgacaagctcgccgccatcgtcgacgtcgtcctggcgaacgcgccccgggaggagttcgagatcttgcgccgcctggcgagtcgcaccgcgtcccagcgtcccgatctcgtcgcaactcgccttggcgagctgcgacgtgagctcgccgaaccactcgtctcggtgctcgccgacgagggtgtggactccgccgacctcgtcggattgctcgcccttggcaccctcgaggcggcactcgacgcgatcgctcagggcgaagatcgcgacgcggtgcgcgaggcagtcctcgccaccgtgcggagcccgcgcactcccagccgctgagcagcaggccacccggcacggcccgccggccgccgagtcacggttctgcctgccgaaggtcggcgtgcgcccgccgccatgcgctctgtgctgctcatcgcgaccggagttcgctccatgaggcaagtaggccgagcaccagcgcatcgaacctggccaactcctcgagtgaggcgcgctcgccgaggctatgaccctcgccctctgccacctggagttcgcacgcaaggctctcgccgacgcgctcgacgaacgcacgagattgctccaccggcaccacacggtccgcgctgccgtgcgtgatgaggaccgggatgcgccgccgcggtcggcggtgcgcgaggtgcggcgcgtcctggccgaccagccagtcgacgtcgccgagcgcggacgggtcgagcagtgggttggtcaacaccaacgcatcgagcagtgtcgggtcctcgaggatgagctgcaggagcgtccagcctgccgacgacgcgccgatgccgacgcgaggacccgcgaccacgccctcgaatccccgcacgacctcggcaagggcctctgactcgaccgtcccgaaccgaccgacgatacgctcgcgtgccgatcgcccgtagccgtacgaacccgggtagtcgaccgcgacgaccaccaagccgtgtcggagtgcgcgacgccacttgtcggggaccgggaacgcgacctgttcgacgggaccgccatggacgaccagcgcgacaccacgaggtaccgggggccagatcgccacgccgcgtgcggccagccccaaggccccaagtggctcgatgcgagaaccgtccaccccgtccgagcccgcctgccggagcgtctcggacccacggcggacccgctccgaccacggcccccgctcgatgcccacgacgtcaccgtcgatggccgagatcgaggtccacgagcccgacgccacgcgacggaggcgctcgtccaggacgacgagcgcgggcgcctccacggaggcgatcactccgagcaccgcctccgagtcggggatgtagccccgacgaccaggcccaagagggtactcacccacgtcgtagtcgagacccgcgatctggggcacccgccccgcgagtaccgggacgtgcgcaccggcgcgatcgtcacgaacccacagaccgcccggtccgaaccgcggctccaccacactcgcaccgtcaccgccgaaattccccgcgatggcgccggtcgggtcgagaagcatcaccgaccccgtgagccacggctcgcgctcccccgcccgggccaacgcgatcgaaccgtcgtcgtcgacggccacatcccagaggtccgagaccccaaggcggccgaggtccaccacgttcaccagccgagcctggtcgtcgaagacgacgacgcgagcgtcgctcaccaccgcaaccatggctccggcgggagaaccggcgatccaacgcacgccgggcacggtggcgacgtgctcgatgcctcgtcccggcacgactcgcacgacggaaccgtcgacgcacaacacccacaagcacgagctgcccatcgcgaggaccccgccgttgccgggacgcgcccacgctggcgtgacgtcggcgcagccgagtgcagtcacggtgctcgccaccacgaccccgcgagcactgcgctcgatccacgcgacgcccagcggacctgccaccacgtcggcgacgcgctggacgacgtcgctcaccgaggcggctcttcgtagaggccgaacacctcgccgagcgccatcatcacctcgccgacgctcgctctcgcgcgagcggcatcgatgagagcgggcatgaggttgcgctctggatcgcgcgcctcgtcgacgaggcgtcggatcgcagtccgctgggcctcctcgtcacgctgacgccgcaccctcctgagtcgttcgatctgacgcgcttcgacctcgggcccgatcacgagcgtcgggatctcgtcctcctcgttgccggcggtgaaggcgttcacaccgacgatcacccgctctccggcgctgatgcgcttctcgagctcgtaggcagagtctgcgatgcggccctggtagtaaccgtcgtcgatcccgacgaaggccccctcgagcatggaccccccaccgaggcgctcgatctcggcgaagatcgccgaggctcgtgcttcgagctcgtcggtgagcgcctcgacgaggtaggagccgcccaaaggatcgacgacgttcgccacacccgtctcgtaggcgatcacctgttgcgtgcgcagcgcgatgcgagccgcacggtcggtgggcagcgagagcacctcgtccatggagttggtgtgcaggctctgcgtgccgcccagcacgcctgcgagcgcctcgagcgcagtccggaccacgttgatctctggctgctgggcggtcagcgacacgccggcggtctgcgtgtggaagcgcaactgccacgaacgtggatcgcgcgccccgtagcgctccctcaaccaacgggcccagaggcgccgtgcggcgcggtacttcgcgatctcttcaaagaaatcgatgtgggcattgaagaagaatgacagctgcggcgcgaacgcatcgacgtcgaggccggctgcctggccgagctcgacgtaggcgaagccgttggccagcgtgaaggcgagttcctcggccgcggtcgagccggcctcgcggatgtgataacccgagacggagatgggatgccacttcggcatctcggccgcggtgaacgcgatggtgtcacgcaccagtcgagccgatggacgaggcgggaagtagtactccttctgcgcctgatactccttcagaatgtcgttctggagcgtgcccgcaaggcgctctcgtgcgacgccacgctcctccgccaccgcgatgaaactggcgaggatgaacgccgctggcgcgttgatggtcatcgacgtggtgaccgcaccgaggtcgatcccgctaaacaggtcccgcatgtcctcgagcgtgtcgatggcgaccccgcacttgcccacctcgcccaccgaccgagggtcatcggagtcgcgtcccatgagcgtcggcaagtcgaacgcgaccgagagcccggtgcccccgttggcgagcagctcgtggaagcgctggttggtctcgatggccgtcgagaagcccgcgaacatgcgcatcgtccagcgcttcgttcggtagcccgaggcgtagacgcctcgagtgtacggatactgaccaggcagctcctcgtcgggatcgaccatggctcccgcgtcgtccgggtcgagcgcgccgtggcgcccgtagaggggagcgaggggcacccccgagagcgtctcgaaggcctcctcgcgcgttccggctcgacgatacgcctccgaccaagccgacagatcacccatgggccgattctaccgaacgtcgctgacgcctccaaggcccgtcacccatgcgatcccccgacgcgggtggtacaggctgctaacgttggcgcgtgaccatcgacgaccgaaccccggaccgcaacctcgctctcgacctcgtccgcgtcacggaggcagctgcgctggctgcgagcgcctggatcgggcgcggacagaaggagtccgctgacggcgccgcggtcaacgcgatgcgctcgatcctcgcgaccgtgcccatgaccgggacggtcatcatcggcgagggcgagaaggaccacgcccccatgctctacaacggcgaggtgatcggcgacggtaccggcccagtggccgacgttgcggtcgacccgatcgaggggaccacgccaaccgcgatggggcgctggggtgcgatgagcgtgatcgcggtcgcgacgcgtggctcgatgttcttccccgggccgatcgtctacatggacaagctggcctccggacccgagggcatcggcgtcgtcgcactcgacgcaacgccacgcgacaacatccgcgagctggcgcgtgccaagggcgtcgctcccaaagacatcacggttgccatcctcgatcgaccccgccatgcggacctcatcgaggaggtccgtagcgccggagcccgcgtgcggctgatcggcgacggcgacgtctcggccgcggtcctcaccgcgatcgacgagagcgatgtcgatctcctcatgggcgtcggcggctccccggaggcggtgctggccgcggctgcgatgcgctgtctcggcggacagctgcaggccaggctgtggccccgcgacacggacgagcgcgaccgggccctcgcccagggctacgacctcgagcacgtcttcgcgaccgaggagctcgtcgacagcgacaacgtcttctttgccgggaccggcatcaccgacgccgagctcctgcgcggagttcgcatcgtgggcggacgcgtccatacgcactcgatcgtcatgcgctcgcgttcgggcaccatccgcaccgtacgcgcccagcatcaactcacgaagctgagggcgatccagctgctgtcctgagcgagcccgagggcccgtgcgagcggagccccaacggcgacggcgccacgttgctcgagcaacgccgttcctgcggggccaacgagtgcggccggggcgagcgaggcgccaagggcgtcgcgtagcgcggagccgacaccgaaccctcgcagatcggggtcgaagacacgcgcatcgacgagcacccaggccgcatcgctcgctcgtcgcgctgagacgacgccgatgacctcatcgtcgacgaaggcgagggcactgcgctggtgcagcgtcggcgccgcggtctgagtcagccaggctccatcgctgacgacgacacgtaaccgcaggtgcgaccgtacgacgatccagctctcgcccacgcgcgcctcgagcacggagcgccaccatcgcctcggatcgcgcatccgcacgagcaggaccgcgaccgccctcggctcgagcggtgctcggaagtcggtcccgaggtcagcgaggtgttcgagcgactcgagcgcacccccctctcgaatggtcacgtggggcacgaacgggcgatcgtccggccacccgagctctgcggcgagcccggcgatccagccgtcagggtcggccacggccagatgcgcggtcgggcgccggttggcgaagacgccgatccccgagaactccgtcactggtggatccagccgcgcgacgacctcggcgacctgccggaggagtgcagcaacgccggcagcgtcacgctcatgcggcggcagcaacgtgatgtgcggcacgatgcgatcgagcgcgcgcgagccgacgacacgcctcacggcatcgatgccctcctcctgggcatgcgacagcaccagcgcgacggcgacccgaacgcggctcacaccgacagccgagactcccgcagctcgaggcccgcccgatagggggccacgaagcgctcgtccacgtcgctcgcgagctctgcgacgacacgccgccgcgactccagcgacgcctgatcgatgtcgcccacgaactccgcggcacgcgcgagcacgacggcacggttgccaccgacgcgcaccagaccgccgtcgatgaccagttcctcctgggtgccgtcggcgagccagagcttggccacacagacctcgacctcaccgacgaaacgcccgtggttggcgaggaaggcgatgtcgccggtcgggacacgcatgacgagttcttcgacggctccctcgaacacgacctcctcgggagttgcgatcacggcatcgaaggtcgcgcgcatctctacccgagctccttggccttggcccagacgtcctcgatgctgccggcgttcaagaacgcctgctccggaacctgatcgaggtccccgcgaacgatcgcctcgaaggactcgatcgtctccgcgatcggcacgtacttccccttgaggccggtgaacacctcggccacgaagaacggctgcgacaggaaccgctggatgcgccgcgcccgggcaacgatgaccttgtcctcctcggagagctcgtcgagcccgaggatggcgatgatgtcctgcagatccttgtagcgctgcaggatctgctggacgctccgagccacctggtagtgccgctcgccgacgatggtcggatcgaggatgttcgacgtcgacgccagcggatccacggcgggatagataccgagtgaggcgatctgacgcgacagctcggtcgtcgcatcgaggaacgtgaacgtcgtgaacggcgccggatcggtgtagtcgtcggccgggacgtagacggcctgcagcgaggtgatggagcggcgcctcgtcgaggtgatccgctcttggagctcacccatctcgtcggcgagcgtgggctggtaaccaaccgccgacggcaagcgcccgagcagggccgacacctcggacccagcctggacgaagcggaagatgttgtcgatgaacagcaggacgtcttgatccttgacgtcgcggaagtactccgccatggtcagcgcagcgagccccacgcgcagacgtacgcccggcggctcgtccatctgcccgtagacgagtgcagccttcgagatgacgcccgactcttgcatctcgaggagcaggtcggtgccctcacgtgtgcgctcccccacgccagcgaacaccgacacgccgccgtgctgctgcgccacacggttgatcatctccatgatgagcaccgtcttgcccacgccggcaccgccgaagagtccgaccttgccaccttggacgtagggctcgagcaggtcgatgaccttgatgcccgtctcgaacatctgggccttcggctccaggtcctcgagcggcggtgccgaccggtgaatctcccacaggtcgtcagcaccctccaacgacggggcgtccaggggttgaccgagcacgttgaacacgtggccgagcaccgcatccccgacgggcacgctcagcccgcgccccagcgcacgcaccggcacgccacggcgcaggccatcggtgggtcgcagacagatgcagcgcacccgtccctcccccagctggcgcgccacctcggcggtgatggtgacggtctcgccgtcgacctcggcgtccatctcgagagcggcgttgatctccggcaaggcgtcgggagggaactccacgtcgaccactggtcccgcgatcgagaccactcggccaaggacatgctcggcgttggtcatagcagctcactttccttcttcagcgcccccgccgtcgcgagagcctcggctccacccacgatctcggcgatctccgtggtgatcgcatcctgccgtgctcggttcatcgctcgtgtcagcgtccgtaccaactcgttggcgttgtcggtggcggtcttcatcgcccgctgccgggcagcgtgctcggcggcggacgcttccagcaagagtccgaagccctccgccacgatgaggtcacgcaggctcacctcggtgagcaccgccagatcggggtcggtctcgacctcagagcgcgactccgtcccgtccaacagatcgtctcgacgcatcggagcgaggtgcgtgacctcggtgcgctgggacccgagcgagtagaagcggttcgaaatgacgtcgatcccaccgatgacaccctcttcgagctgcgcgatcagcggagtgaagagtcggagcgcctgctggtaggtcggctggtgggtgacgtgatcgatctggtgatcgacaccgacaccgcgaaaatgcgcccaggaaccgaacttgcgcccgactcccaccacgacacccacgtcgccaccgcgacgccgccgctcgaaggctcggatcacgttggcgttgtaggctccgcacaggccgcgatcggcggtgaccacgacgacggccacgggaccggaggcctccagcagaggactgcgcaacgctggctgcgccgcgaccagcgttcgtgtggcgtcgctgagttcccgatagtacgtacgcgcctgggcgatgcgccccaccgccttgacgatgcgagaggcggcgatgagctccatcgccttcatgatcttcttggtcgagttcacactgcggatctgtgcccgcagtgctcgctccttgccgcccgccacgcgctaggccccctgatggagtgccttgaaggccttgatcgccatgtcaagccgctcgcggtcgccaaggcgcttcgactcgctgatctcctggagcacctcggggtgctgagcccgcaggtaggcgaggaacgccgcgacgaaggggccgacctcgctggtcggaacgtcatcgacggcaccgctggtgccgacgtaaatggagacgacctggtcctcgagcgacactggctgaccttgaggctgcttgaggatctcggtcaagcgatacccgcgatcgagctgggcctgggcgaccttgtcgagctcggagccgaaggtcgcgaacgcctccaactcgcggaactgcgcgagttccaggcgaagcgagccagcgacctccttcatggccttggtctgcgccgacccgccgacgcgcgagaccgaggcgcccacatcgatcgccgggcgcacgccagagtagaacaggtcggcgtcgaggaagatctggccatcggtgatcgagatcacgttcgtcggaatgtaggccgagatgtcgcccgccttcgtctcgatgatcgggagcgccgtgagcgagccaccaccgagttcgggcgacagccgagccgcgcgctcgagcaaccgggagtggagatagaagatgtcacccgggtaggcctcacgccctggcgggcggcgcagcagcagtgagagctgccgataggcatcggcctgcttggagaggtcgtcgtagacgatgagggcatcgtctcccgactccatccagtgctgaccgatggcacaacccgcatacggggcgaggtacttgaacggcgctggctccgacgctggcgcggagaccacgaccgtgtaggccaacgcaccggctgctcgcagcgtctcgacgacgctcgcaacgctggtgcccttctggccgacggccacgtagatgcacttcacgccctggccacgctgattgatgatggcgtcgagcgcaatggaggtcttgcccgtcttgcgatcgccgatgatcagctcgcgctggccgcgcccgatcggcacgagcgtgtcgatggccttgatgccggtctgcaggggctggttcaccggctgacgcttggtgatgcccggggcctgtacctcgagacgacggctaagactcgcggcgatcggcccgagaccgtcgagcgggcgccccagcggatcgatgaccctgccgagcagctcgtcacccaccggcacggacaggatctctcctgtcgagcgcacgatctgaccctctcggatcccctcctggtcgccgaggatcacggcaccgatggcctcttcgtccaggttcagggcaaggccgaccgtgccgtcctcgaagcggagcatctcgttcaccgcgaccgacggcaagcccgagaccagcgcgatgccgtcgaagagctgcagcacgcgcccgatctcctcgccgccctggtgcggcgcgaactcctccatgcgtcgccggatgaccccagcgacctcttcctcggagatttcgaagtgctccatcaccatttcactcccctacgcgctgacgagacgacgagcgtcgtcgagctgacgtcgaacgctttgatcccagagacgatcgccaacgatcgccacgatgccgccgatgaccgactcgtccaccacccactcgacctccacgcgctggccgacgagccgctcgaggtgcgtacggacggcgtccgcctcatcgtcacgcagcgaacgagccgtgcgaaccgttgcgacccgcaacgagagctgtcgggcggcgagttcgagcagccgatcgacgacccggccgatcggtcgcacggaactcgtcgcgacggccgcacgaaggatccaggtcgtccggacgctcacgcgcggcccaaacagatccccgatgatggcgaggcgtgcttcgcgcgttccctcgaaacccgacagcacgcgctggagtgcccgatcccgttcgagcacctgtgccacaccgcgaagttcgtggagcaccggctcgagctcgtcgcgcgctccgaggtcctcgaagatggcccgcgcatagccgatgacgcgcccgatggtggcaaagtcgccggggccctcgaggaccatgtcggaggcgaccagctcagggagttcctcgagcgaatgcaccacctcgccgacgacctcccacgcgacgacagcgtcgaagagccgcagagcgagcgagctgacgcgctccccgacgaggtcgtggagcactccttgacgacgatcgacgtcggcggctcgatcgtcgagggcgacagcgagctggacgaagcgctcgcacagctcggcgacgccgcgagcgtcgcgttcgagctccgaggccgttccggcctcgcgagcgagatcacgcagggcgagggcgtagcccttcacgagctcacgcatcagtcagcgggctccgcctctcgcaagaaggcctcgatgagcggatcgaacgatgactgctcgagctctcgtgcgacgatcttgccagcgagctcgaccgcgaggtcagcgacctcggaacgcagcgagcgcagcaactggacacgctctgccgccagttgcgcctccacctgcgcacggatcgcctccgcctcggcacgggcccgctcgctcgcctcctgcctgagcgcctccgcggtccggcgagcgtcgtcgaggatgcgacgcgcgtcctcgcgcgccccctggagctctcgttcgcgctcggcccgcagggcctcggcctcgcgtcgcgcagcatcggctgcctccagatcggcacgaatgcgatccgaacgctgcgccatcatccgcgcgaccggcgggtaggccaccttggccaacaccaccaacaagatgacgaacgagatcaccgaccagacgatctcccccgtgctcgggaggatcgggttcggcgactgagtgacaaccgcctcgagcatgcgatcagccggtgtacttgaggagcacgaagacgacgaagccgatgagggcaagcgcctcagcgagcgcgaaaccgatgaacgcgagcgagcggacggctccagcggtctcgggctgacgcgcgatcgcagagaccgcctgcccgaagatgatgccgataccgatgcccggtcccaacgctgccaaaccataggccaagcccgaaccgagttcggcaagacccttgcgcaggttgacgctcgacgctgccgcgatcaccgtggcaacaacgttgtgcattgatcctctctctctccgctgtggtacccccgggttctccacccgagatctcgatcccccgaccgtgacgcacaggcctcggaacccgacgcgccgggggcatgctagtgcccagccacccccatggcctcgccgatgtagaccgccgtcaagatcgtgaagatgaaggcctgcaagaacccgacgaagatctcgtagcccgtcaccacgaccagcatcgcagctggcagcggcagcgcaacgagggcgatcgacttcacgaagagcgcctcggagatcaccgcgaacgtgatgagcagcaggtgacccgcgagcatgttgccgaagagccgcaccgcgagggcgaacggacgcacgagaaaggtcgacaagaactcgatcgggacgagcaggatgagcaggacccccggaacgcctctcggcacgagcgcgctgcggaagtagccagcgaacccctgtcgcttgatcccgaccgcgaggaaggtgacatacgagatcacggcgagcgggatggtgacgctggtgcgagccgtggccggcatctggatgaaggggacgacctcgaacaggttgttgaagaggatgaagaagaacatcccgacgagccagggcagccagctcaagccctcagggcccatcacgtccaacacgatggtcgagcgcacgaaatcgacgcccgcctcgacgacgttctggacgccccgtggcacgagttgggcgcggcggccggcaagcccgaagagcacgagcgtgatcgccgccgatgccagcgtcagcaccgcgatcttgttgaacatgaacgcagtgccggaaaaggcgatcggacgccagttcagcacctcagcgatcgggggaaagctaatggcggcgagcatcaccgaagcaccctccacggacgcagtccgtcgtcaccgatccgcccggacacacgccgcgcttcgaggacgaccgcaacgagatagccggcgatcaccaccgtcgcaaagacaccgaggcgcatccagtgagcatgcaccagggggacggtgatcgcggtcagcagaccgagcccaaggatgagcgaggcaaacgccgccaccatcaagcccccgatgccaaacctcgcgccctcgcgaaacgccacgaccatgatcgcgaaggtcagcgcgacgccggcgagcgcgaacgcggcggtctcgaggccagcgataccatcggcgatgccgccacctgcgagggcaaccggcgcaaccaaggcgagacgggtgagaaacccgagggcgagacgcgtctcgggactggtggtactcatgccctcggacgccccccgaactcgggagcatcgagcgtacgggcggcctcacgcacctcgtcgggtacctcgagcgatgcctcgagcacgcgcccacgaccaggccgctcgggcgcacgagacggtgcggactcgacgacagcggccaccgaccgctcgagtccctcacgcgctcggtagatcaacgagagcaacgagccgacgaccccgaggccgccgatcacgaagccaaggatcacggagtgagacgcgcgcccggcccagaagccgagcaggatcacgatgacgagcgtgccgaaggcctccacgaagtgggccacagcctcactcgcccccgagatcatcgggtgcgcacccgcgcctcgtttcaccgcgtcctctccccacgactggcccactcggccgcgctcatgctagcaggcaacctcggagcggccgccgtcaggaaccctcccgggtacccgagtgacgccgtagatccgggtgcaacaaggtgaacagcagcaccgccgccgccacgaccacgatcgggagctcggccgtcaaggacggaacgaacgacggcaccaacgcaaaggctgacagcacggcggtccaggtccacaagatcgccaccgcccgtcggggcccatgccccatctcgcgcagccgatggtgcaggtgcaagttgtcgggcgtggcgacgctctggtggtgccgtgctcgacggagcaccgcgagcaccatgtcgaccatcggcacgccgaggatcacgaacgggatgacgaggggcgcgaagaagaagaacgtttggtccgagacgttggcggtacgacccccgacgacggacgtcgcggctgcgagcagcaacccgagcagcatggcgcctgcgtcgcccatgaagatccgcgctgggttgaagttccagggcagaaatccgatggccacgccagcggttacgaaggcgacgaccggaccgatcgacgactccggcagctggcccaacgcctggaggtgcaagctgtagatcccaaaggcgatcgacgcgatcgcgacgatgcccgcagcgaggccgtcgagaccgtcgatcaggttgatcgcgttcgtcatggcgaccacccagatggcggtgagcaacggcagcatggacggcgcgagcacgacgatacccgcaaaggggaccttgaaccagaacatcgtgacgccgaagtaccacaggatgctcgcagcgagcacctgggtcgcgaccttggccggcgccgacaggtcgaccacgtcatcgatcgctccgagcacacagatgacggtcgcggcgagcgcgacccccagcggctctgacgagtcgaagaacaccgcgcggaaaccaccgatcatgctcgcggcgccgaaggcgacgagcacgccgaccagcatggcgagaccgccgagggttggcgtcgcacgttcgtggacgtggcggccaccgggttggtcgatcgcgccgactcggagcgcgagcacccgcacgagcggcacggccaaggcggtcacgaccgcgccgatcgcgccgaccagcagatagcgcatcaggacgcgaggccaggcggcacgaaggccgcacagagctcgcgaacctgctggcgaacctcccgaaccacttcgtcggtgcgggcgcgcagcacggtcgcgatcagcgaccccacgcgcttcatctcctcctcacccataccggtcgtggtgagggccgccgtcccgagacgcagccccgaggtgacgaacggggaacgcggatcgaacggaatctgattgcgattgagcgtgatgcccgcggcatccagcaggtcctgggcggtcttgccgtcgagttctggatcgaagtcgcgaagatcgacgaggatcaagtgcacgtcggtgccgccagagacgagacggaaaccctcggcctcgagcgaggccgcgagcgtctgggcgttcgccacgacccgacggccgtagtcgcggaacgacggtgaggcggcctcgcgaaaggcaacggccttggctgcgatggcgtgctcgagcggtccaccctgcagtcctgggaagaccgccttgtcgatggccttggcgacgtcctcatgaccgacgatcgcagcacccctcggtcctcgcagggtcttgtgtgtcgtgaaggtcacgacgtcggcaccgcgctcccccgacgcgagccacaacggattggggtacaccccagccgcgatgagaccggcgacgtgggctgcgtcgaagagcacgcgcgctcccacctcgtccgcgatggctcggatcggggtgacgtcgatgacgcgtgggtacgcggtcgcccccacgacgatgaggcgcggatggtgcgcccgtgcgaggtcggcgagctggtcgagatcgagccactcgcgattcggatcctcctggcggacgccatagccgacgaaacggtagagctggcccgagaagttcacgggcgagccgtgggtcaggtgtccaccttggtcgagccgcatcgccaacaccggatcacccggcgccaagagggcgaggtaggcggccgcattcgcgttcgctccagcgtgcggctgcacgttggcccacggcgcgcgaaagagcgctcgcgcgcgctcgatcgcaagggactccacctcgtcgacgacggcgttacccccgtagtagcggcgaccggggtagccctcggcgtacttgttggtcaacaccgaaccggtcgcctcgagcaccgcagcggaggtgaagttctccgacgcgatcagctggagcgtcgaacgctgccgctcctgctcgcgcacgaggagcgcggcgagttcagggtcctctttgctcagcacgcccatggctcctcccttctcgcctcattgtaggcgtctcgcccgtggagcctcagcgaacctcgaccggctcgccgagcacggcttcgacgtccgatggcgcgaccgcaccctggcggagcacccggacctgcggacccgtcaggtccacgatcgtggacgcgacccggcccgagggacctggagcccacaggacgccagcgagccgaccagcgaccggactgccgtgggcgacgaggtcggcgagcgccgtgtcgacgtccgatggcgtcgccacaccgtgccagttcgccgaggaggcagcgagcggccgaccggtggcgagttcggccagccactcgacgtcggggacccgcagtgcaacgctccggcccgagggattgaccacgtccgcgagcgttggggcgtccaccacggccgagatcggtcccggccagagcgcgccgagggcccggagcctcgaccggcgacgtggctcggcgtaggcgagcgcctcgtcgatcgatccgacgagcaccggcggcggcgtcgtggtcgagcgacccttcaacaccgcgatgcgctcgagcgcgcgtcgactcgtcgcggatccgaccaaccccgggaccgtgtcggtcggcatgaggaggaccgaacctccatcgagaatcgtggccgcgcgtcgaaacgcctcgactccttcgagcgagggctcagccggctgatcgccgaggagttcacgaagccgcacgagtcgctccaggccaccgcgcgacgagcacccggggccggccggcaagatcgcgttccacggtcacatcaccgtagccctgcgcgctcgcctcggccaccaaccgctccccttgtgtctcaccgatctccatgaagagccaccctcccggccgcaaggcgacccgcgcaccaccgatgactgccatcggaccctcgagacccgacgggcccggtacgagtgccacccgaggttcgaacactcgcaccgcagggtcgagacgctcccactcggacgctgcgacgtaggggggattggcgaccacgacgtcgagcgactcaggttctgccccctcgaaccaggagcgacgcacgagcgtgacgagcgcacctgtcgctcgaacgttctcccgcgcgagcgcaagcgcacggggatcgacgtcgctccccgtcacctcgaggcgcggaccttcgagggcaagggagatcgcgatggcacccgagcccgtaccgacgtcgagcacgcgcatcccggtgcgcacggccgcgaggacgtgctcgaccagctgctcggtctcgtagcgcggaatcagcgcacgatggtcgacccggagctcatgacctcggaacgaccacgtgccgagcacgtactgcaggggctcgccggccgcgaggcgggcctcgagacggcgcgcgatgactgcggcgctcgcaccggacgaggcggcgcgtcgcgccaccgcctcgtcgaaccagcgtcgctcagcaggtcgcatctccgcgctcacgcatcgcgcaacgcggcgagctgctcctcgcgctcgtggacgaggagcgcatccgacagctcgtcgaggtcgccctggaggatctggtcgagccgatagagcgtcaggccgatgcgatggtcggtgacgcggttctccttgaagttgtacgtgcggatcttctccgaccgaccccccgagcggatctgcgccttgcgcgtggcggtgagctcggcttgacgcttgtcttgctcgagcttgagcagacgcgcgcgcagcacctggagcgccttggcgcggttctggatctggctcttctcgtcctgcatggcgacgacgatccccgtcggcaggtgcgtgatacgaaccgcagagtccgtggtgttcacggactggccacccggcccggtcgatcgatagacgtcgatgcgcaggtccgacgggtcgatcgacacctcgatctcgtccgcctcgggcagagcggtgacggtggccgaggaggtgtggacacggccctgggtctcggtcaccggcacccgttggacacgatgcggacccgcctcatgcttgagccgcttccaggcgtcatcccctctgaccagcagggtgacgtcgtcgtagcccccgagatccgacacgcttcgcgacaggacctcgaccttccacgaccgtcgatcggcccaacgctcgtacatatcggcgaggtccttggcgaagaggttcgcctcctcgcctccttcggctcccctgatctcgaggatcaccgcgcgaccgtcgttggggtccgacggcaggagcaacagctcgagtgcctcgcgagctcgcgcgagcgcggcatcgatctcatcgagctcggccttgagctcctcacgttcggcggggctcgcgccccgatagagctccctcgccgcgtcgcgatcgccttcgagcgcctgcacccgtcggagggctccgacgatggcctcgagctctttgtgacggcgagcgacctcccgggcgcgtcgctggtcctggaagatcgcaggatccgccagttcctcgagcacccgagcgtactcgtgctcgaaacgctcgtaccgatcctcgctcatggcgtctcctcgataagttcacacggtccaaaggcctcggcgatacgagccccgaggggcgcgctccccgcgacgacgagccgaacgacgctcgaccagtcaccggccagggcacgcgcctcgatggggagccacggatcgaccgctcggccgaacccgacgacggtgccgtccggcgcccacgcccacgctcggcccgccgcctcacgaacgcgatcgggctcgaagggccgcagcggctcctgctcgagccacgtggctcgagagcggcgcgcaatcgcgcgcggcacgctctcgaccccggggcttcgaccatggtggccatcacggagtcgccgggcgagcaggcgcgcctccgccagcagaccctcctcgtccaatccgagctcccgacgcatcgcccagtcgcgcggatcgacaccgacaacacgctcgccgtcggctcgcccaccgatcgtgacaccagccgattcgacgaggaccgcatccggccacgacgtcacgccgaccggcacgacgtcggccacggctcgatacaaggcacggagccacgcatcgcgctcccagtcggcgtcggtcgtgacaggcggtgcccagggctcgacagggacggggcgtcccccaacgagctgctcgagcaccgcgtgcgtccccttgagggccgcagcgacgcgatcgagacgctccgttggcccgagcgtcacgatacggacacgctcaaggtggcgatactcgacccaggccgcaaccgcgccggccgcgcccgtcgtcgtcaccacgacgatctcaccgtctcgacgacgcgcagcgccgtctgcgaacgcgccacgatcggggagctcgacgacgacgccgtcgggagccagcgcgttcgcgacgacaaacgcgagctcagcgtgcctgctggccgcgccgtgctcggtcaccgtagcggcgctggaagcgctcgacgcgaccaccggtgtcgacgagcttctgtcgaccggtgtagaacgggtgacactggttgcacagctcgatgtgcagttccgacttggtcgatcgggtctggaacgtgttgccgcatgagcagtgcacggtcgcgaccacgtactggggatggatcccttccttcacgatgcctccttcacactgatggtggactccgagagcgctgccgaggatgcctgggctgcgctagatgccagggctacgcgcgatctcggcgagaaactccgcattcgagcgcgtcgagcggatcttgtcgatcaagagctcgagacccgcagccggtgtgccctcctggctgatcgcaccgaggactcggcgcagcttccagacctgcgccaactcgtcgcgagtgaagaggagctcctcgtgtcgcgtcgacgaggcgttcacgtcgatcgctgggaacaagcggcgctccgcgaggcgccggtccaggcgcagctccatgttgccggttcccttgaactcctcgaagatgacctcgtccatcttcgagccggtctccacgagcgcggtcgccaggatcgtgagcgagccgccttcttcgacgttacgggcggcaccaaagaacttcttcggaggatagagcgcacccgagtcgacgccaccggacatgatgcgcccgctcgcgggctgggcgaggttgtaggcacgagcgagacgcgtgatgccatcgaggatgatcacgacatcgtgcccgagttcaacgagccgcttcgctcgctcgatcacgagttcggcgacctgggtgtgctcctccgcgggccggtcgaaggtagacgcgatcacctctcccttgaccgagcgtcggatgtcggtcacttcctccggtcgctcgtccacgagcaacacgaagaggacgacctcagggttgttgcgctcgatcgcgtgcgcgatctgcttcatcacggtcgtcttcccggccttcggcggcgagacgatgagtccgcgctgacccttgccgatcggcgcaacgagatccatgatgcgtgtggtgagctcgagcggatcctcggcgttctcgagcaccagccgctcgtccgggaagagcggcgtgagatcctcgaagcgagggcgacggcgagcatcctcgaccgtcatgtcgaagacgcgctcgacgcgcacgagcgccgggaacttctcgttctgggagctcgcccgcgcctgaccgacgatctggtcgcccttgcgcagcccgaacttgcgaacgagcgaggccgggacgtaggtgtcccgcgatgacgtcagacggccattcgctcgcaagaagccataaccctcgtcgcgaagatcgagcacaccgacggcctcgatgagctcttggacctgcggtccttccgcctcggccggccggtcaccgcgatccttgttgcgccgacgacgcgagcgacgactactgccctcgtcgccacgacgagcaacctcaccgcgcacctgctccgatgcttcaggagccccgtcgctctctgcgtgtgcctccgtccgcgctgcggccggactggcctcgccgcgtcctggcgagccatcgctccgttgcacactcgcatccacggcgatcggaggcagcagccgcgcgaggtcgaccgcaaggcgatcggcctccgcgagggtcggctctcgggtcccctcggtcgcgctctcggcttggggccgacgctcgcgtcgccgagtcgacgactgaccccgctctcgcggtccgctcccgacgacgctcagcgcgtcacgagcctgggcatcgtccgcgggcagcggcggaagcaccgcggcggctgcgtcctcgttcgcgaagaggctgcgatccccctcgtcgctcgcggatcggcgtgccatcgacgacgcctcgatcgcctggatgatctccgctttgcgcgatcgggacgaaaccttgacaccgagctcacgcgcgatcgccagcagcgactctcgatcgcggcgtgccagatcaccgagcacgtcggtggaactcaccatggggtagatcccttcttggtcaggaggaacaggcgcagcactggcgcggtcacgccagtccagcagctcgagcaatcgcgtcaagacctgcagacgacggcacgggtccctccacagtgcgcagcgcggtgtccgggtccttcaagccatgccctgtcaggatgcacactaccgtgtctgaccgcgctaggtccagtcggaggaggccagcaaccgaagccgctgaggcgggctcgcagaacaccgactcctctcttgcgagcagtatataggcctcgagaatggcgtcgtccgagaccgcgagcaccgtcccacccgagtccgacgtggcgttcagggcaccttgccacgaagccggacgcccgatccggatcgcgctcgcgatcgtctcgggatgctcgacgacctctccgcgcacgatcggagcagcgccctcggcctggacccccaccatcctgggcagacgcgtcgtcgcacccgcggcatgcgcttcgcggtagccacgccacgacgccgtgatgttgccggcgttgccaacgggcatcacctggaccgtcggtgcatccccgagctggtcgacgatctcgaacgcaaccgtcttttgaccctcgagtcgatccgggttcacggagttgacgagcgcgaccccatcggcctcggccagctgccgcacggccaccagggcatcgtcgaacgacccctcgatcgcgacgacgcgcgcaccatagagcaacgcctgtgccagcttgccccgtgcgatgcctgccgacggcacgacgaccacgctcgccaggcccgccgctcgcgcatacgccgcagctgcggccgaggtattgcccgtggacgcgcagatgaccgccctcgctccgcgagccttcgcgttggtcaccgcgagcgccatcccgcgatccttgaacgaaccggtcggattcaagccctcgagcttcaagaacacgcgtgcgccgacccgctcggacagatgcggtgcgtagcgcaacagcgtccccccttcgccgagcgagaccagctcagccccgtcctcgatcggcaacgcgctccgatacgcctcgaggatgcctggccaccgcagccgtctcacaacgccatcgtcgtgtgccatcgctcgcttcctcacagcacccggtatcgttgccgacgtccgaccacgtcgccgagcgtcaccaactggcgatcgatcgcctccatctgctccagcgtcgcctcgtgcgtcacgagcatgaggtgggcgtggccctccccggctccgagctgctccacctgcgcgatcgacaccccttcctcgccaaacacctcagccacccgcgcaaggacgccagcagcgtcgcgcacgagcagcgagatcgcgaatctgccggtgatcgacccagccgacagcattgtcggctcctctcgagccggtgccgtactgcggcgccccgcccggcggttctgcgcagcctcgaggatgtccgcgagcacggcggccgcagtcggcagcccacccgctcccgggccgatgaagaccagctcaccgaccgcctgaccttcgacgaagatggcgttggcggcgtctcgaacgcccgcaaggggatgctccctcggcacgagcgcaggaaagacctcgacgctcagcgcctcgccatcggcctcgtcgagtcgccgcgccgtggcgaggagcttgatctcagacccgctcgcgtgcgcgaagcgtacgtcggcggcggtgacgccgacgatgccctcggtccgcacgtgatccgcgcgcacgctgcgctcgaacgcgagggatgcgagaatggcggccttcgcggcggcgtcgcgaccgtcgagatctcgactcgggtcggcctcggcatagccgagtcgctccgcctcggccaccgcctccgcgagttctgcgcccgtctcgctcatgcgcgtgagcacgaagttggaggtcccgttgacgatgccttgcaaggaccagagacgctccccgaacagcgacgtgcgcaggactcggatcagtggcaccccacctgcgacggcggcctcgaacagcagatcgacaccgctcgcctcggcgagtcgctcgagcctcccgaggtggtcggcgagaacgtccttgttcgccgtcaccaccgccttacccgccagcaacgcgcgctccagcgccaacagcgccaccttcggctggcccatcagctcgacgacgatgtcgacgctcggatcggtgatggcagcatcgaggtcatcggtgacgagtcccatgggcacccaggcgtcacgtggtcgctggatgtcacgcacgacgatggaggtgagctcgatcggttcaccgaggcgccgctcgagcagcgcagcgtcgcgatcgagcaaccggacgaggctcgagccaacgacgccacacccgagcagcgcgactctcacgagcccacctccagacggaacagatcatcgagctgctcgcgacggacgatctcgcgggcgacgccgtcacgaaccatgaccacgctcggacgcggcaaccggttgtagttcgaccccatcgagtagccgtacgcccccgtgaccggagtcacgatgagctcgccagcagcgaggtcttccggcaacagggcgttggccaccagcacgtctccggactcacagtgcttaccgaccacgcgcatcgccgtcgtgtgcggcgcctcgagtcggccggcggcgacggcctcgtagccagacccgtagagcaccggtcgagggttgtccgacatgcccccgtcgacggccacgtaggtcctcacccccgggatccgcttgaccacgccgacacggtacagcgtgatcgcggcgggagccaccagcgcgcggcccggctcgacgaaggtgcgctccggatccatgccggccagcgttgtcgcctcggcgatggagcgcccccactcctcgagcgtcggtgcccgttcgtcacggacgtagggcacgccaatgccgccaccgaggctgacctcgtcgaccccccaggcttcgcgcaccgcccccatacgcccggcgagctcgccgaagggatcgaggtcgaagatctgtgacccgatatgggcgtggatccccacgaccgtgaggccgtgcgcacgcgcccacgtgagtgctcgctccgcagagccatcgtcgagctgaagcccgaacttggagtcgacctgccccgtgcggacgaaggcgtgggtgtgggcctcgatccccggcacgacgcggagccagagtcgccgacggccgagaccaagacgcgcgatgcgctcgagctcctcgtgggcgtcgacaacgattctgccgaccccaacctcgtcggcgagcaggagctcatcgacgcccttgttattgccatggagtacgatacgctccgcaggcacgccgcctcgacgagccgcctcgagctccccggccgaggcagcgtcccaccagagcccggtgtcggcgacgatgcgggccatcgccaccgcagagaacgccttcgacgcataggtcacctgcagcgcacccagccccgaccgcagctcgtcgatgcgtgctcgtacctcgtcctcgtcgtagacgaacagcggcgtgccgaagcgatcggccagctcgtgcacgctgatgccctggatcgtcagctcgccgctcgcgccgatgcccgccccacgaggccacaggcgcactgggagcgcaccgaggcgctcacccacgcctacatctcctcgaccgcgcggaccccgatcaaggcgagcgtccgcgccagcacctgaccggtgaggtccgcaagtgcaaacctggccccgcgtaccagtgggtcgggctcgaccaggatcgggcagtcgtggtagaagccgtggaacgccgaggccgcctccagcagccaggcgacgacgcgatgcggcgcacgttcgacgatcgcggtctcgagcacacggttgaggcgcaagagcacacgagccagctcgagctcgcgagggtggccgagggcagtgagcgatgcggcggggtcgagagcgagacccatggctgccgcctgtcgacggagcgccgcgaccctcgcatgggcgtactggatgtagtacaccgggttctcgctcgactcggcccgagccttgacgagatcgacctgcgaggcacggtcgatcgacgacgacagcgcgagcaagcgggtcgcatccgccccgagttccttcacgagccatgagagcgcgatcgccgttcccgcacgcttcgagaacttcacggcagcaccgttgtcgaggagcgacaccatctgcccgagccgaatctcgagacgccggtcgtcgatcccgagggcgcgcatcgctgcatgcaggctcgccacctgcccgtggtggtcggcgccgaacacatcgatcgcgaggtcgaatccccgcacgaccagtttgtcgtagtggtaggcgatgtcgcccgcgaggtaggtgtagtcaccgttcgccttgcgcagcacgcgatcacgcgtatcgccgaagcgttcggccgcaaaccagagtgcaccgtcggcctcgtaggtcgcgtcgagagcactcaggcgtgcgacgacctcctcgacgagtccgccaccttcgatcgctgcctgggagtaccacgaatcgaagtggatgttgagctcttcgagggtggctcggatcatggcgaggatctcgggcacagcccagctgcccgccgcgaccacgtcgtcggggccgtcgtagcggcccgagagctcgtggacgtagtcgccgcggtagccctcttcggggatgggctcccctcggcgtgccgcgaggatcgaggcaccgagcgagcggatctggccgccagtgtcgttcacgtagtactcacgcgaaacctcgaaccctccgtgggccaacaagcgtgcaagggcgtcgccgtagatgctgagccaaccgttgccgatgtggagaggaccggtcggattcgccgagacgaactcgacgagcgcccgtgcaccgtgaccgacgtcgacagcgagcgcggccgcaagatcggccgccatcgcctgcacgtcgccgagcagggccgctgggctgagatggatgttcacgaaaccagggccagcgacctcgagacgctcgacacggccagcgacacgcggttcgagacgcgcaacgagtgcctcggcgagcacacgaggtgcgaccccgaccgtgcgcgccagctcgagcgcgataggcgtcgccaagtcgccgtgcgcgcgctcgcgcggctcgacgagtgggccgacctcgaccgcatcagcgatgccgcgagcgcgaagctcctcgtgcaccgccgtcaccagaacctcgtggagccaacccgcggtggtcacctacgtcctttacgctgccaggggcgcttgcccggggatactgccgagccagcctaccggcccgcggcatcggaaccacgaggtcgcccgacgagtacactcgaagcgtcgcagcgtgtggcccccgtagctcaggggatagagcaccggcctccggagccgggtgcgcaggttcgaatcctgccgggggcaccagagcgtcgcgcgtcgacgagcctggtgcctgagcctggcgacttgagcacccgtcgacgacgcgtggttccgacgagggcacgtcccagtgggctcgcatccggtgggctcggtccccgatcgagcgaggccggtactccgttgctaccgagccagcttcgcgaggatcgcctcacgtgcggcctcgcgatcgtccaaccggtagaccgtctggcccacccggaaggtctgctcgtggccgcgccccacgatgagcacgacgtcggactcctcggcgatctcgatcgcgtggccgatcgctccacgccgatcgagttccacgatgatctgcttgtggtccacgtcgagcgtgcctgcgagcagctgcgccacgatctcacctgggtcttcgtcgccaggattgtcggccgtcaagatggcgacgtcggcggtcgctgcggcccgtcccagctcgggacgcttcaggcggtcacgtcggccccgagcccccgcaaccagaatcactcgtcccttcggggagagcgctcgtgcggtcgcaatgagcgctcgcagcgaatccggcgtgtgcgcgtagtcgaccacgaccgtgaacggttgtcccgcgtcgatccgctggaagcgccccgcgacctgatgacactcggccagcccccgctcgatcgtgtcgccctcgatcccgagcgcttctgcgaccgccaccgccgctgccgcgttgtaggcgttgtgaatgccgtagatgggcacacgcagacgccagcgacgccggccgccgacgaccacggtgaagatcgtcccgtactcgtcgtagcgcacgtcctcgacgcgatagtccgaaaacggggctggcccgtaggtcaccgcagggatgcgaacctgggtcgcgagccgcacgccccactcggtgtcggtgccgatcaccgcctgcttggttcgctcgggtaggaagagctgggccttggccgcgtagtactgctcgatggtgccgtgatagtcaaggtgctcgggcgagaggttggtgaagaccccgattcgaaagctcgtgccgtcgatacggtgctggtcgattccgtgcgacgacacctccatcacgacggagtcgactccgtcgtcgaccatctgccggagcaagcgatgcagctcgggcgcctcgggcgtggtgaacatcgacggacggttggagtccccgaagcgcgcctcgatggtgccgatgagtccagttcggcggccggcaaggctcaagatggagtcgatgaagtacgaggtcgtcgtcttgccattggtgccggtgatgccgacgagatcgagccgctccgatggacggccgaagaaccccgcgacgagcccgccgatcgcgtgccgcaccgacggaaccacgagttgcgggatgtcgagtgccacctcgtgctgcacgagcagcgcgacggcgccacgcgcgatcgcatcgctgacgaagtcatgaccatcgaaacgcgatccccgcgtcgcacagaacatcgctccaggcgagaccgaccgtgaatccagcgtgatgtcggcgatcgccaccgaggggtcgcccaccagacgagcgcttggcacgagtccatgcagatcacgcagcgtcagcacaacggcccttgcctcttcctctctgggttcttcagctaggctagcgctccccatggagcgatcaacggccccctctcccacctcgcacccagcgatcaccgtgagcgtcgtcatcgccgcctacaacgccgcggccacgatcaccgacgcgctcgagagcgtgcaccgccagcagtatcccccgatcgagatcatcgtcgtcgacgatggctcgaccgacgacaccatcgcggtcgtcgagcgcagcggccttacgagcgccatcatccgtcaagccaatcaaggcccgtcgcgtgctcgcaacgccggggtccgcgcagcccacggagactggatcgcgttcctcgacgccgacgacgtgtggcatccagccaagctcgccgagcaggtcgcggtcgtcgagcgccacggcgacgcagcgatcgtcgccaccgattgggcgcgggccctcgaccagctcggggtgcctgccgcgagccacctggagtggttcggctaccgcgacctcgtcgtcttgaatcgctttcagacctccaccgtcctcatgcgacgcgctgtgctcgatgcgatcggaggattcgacgcctcgctcgacggcgtcgaagattgggactgctggttacgcggtgcactccacggcccggtggcactccttcacgccccgctcgtcctctaccgcgacagtccgggtggcgtctcgaaggatctccgacgcctgcgcgcaggagcgatcgccgtcatggagcgcgagcgccagcgcggggtgctccatcccgacgacgcacaggaccttctcgcatggcacctcgaacggctcttcgtcgccgaggtcctggttcgcgattggcccggtgcgctcgacgcgctgaaggacgtcctgctcgctccgccccacgctcaccttcgcgctgcgaggggcctcctcggaccgttcctcctcgaacgactcaaccggcggcgcggtcgcgccgcggcgtgatgacgtggtgccacaaccagagtccgagcgccaccaccacgatcgccgccagcacagccgtactggtcaggcttgccgaggtgaggaccgagctgtagttccttccagccacgtaaccgagacccgtgtagagcgctgcccacccgacgccacctaccacgttggccggcagaaagcgacgacgatagggcatctcggccatgcccgcgatgcccggcaccagcacacgaaggacggtcgtgaagcgaccgacgacgacgccgagtgctcccctgcgttggacgaatccaaccgctcggtcacgttgtcgcttcgagagcaggcgctccgggaccttggcaaggagcggctcgccgaaacggcgccccacccagaacccgaccgagtcaccgacgatggcccccagcgcagccagtgatcctgactcccacaccgggaaccggtgctccgcagcgagcaccccgccgagcaccaccgacgtctcgccagggaagatgaacccgagaaagatcgacgactcgagagctggaaagccaaagaccaggaccaagaccagccatgtcggaaccgacagcaaaagccgaatgaataccgccacgccacgcgctccccgagtaggctagatcgggagactaaggagtccgatggtactcgcagacgtgctcggtccgttcgacctgatcgtcgtgttgatcgtagcgctcctcatcttcggcggttcgaagctcccgaaggtcgcacgctcactcggaacagcgacccaagagttcaagcgcggcgcccaggaaggtccgaagcgcacgacgtcggagcccccttcgccagagagtccctccagcgacgacgcaagctcctagcgcggcacgccccaccgcgctgtcgcaccaccatcggtgatgcgtaatcgcctgtgacaggtgtgggtgatgcgaatcggtgctgcgtgacgtcacctcgcacccgtgagcgcgaaggctcgtcggcaccaagacgaggaaccaaagaccggctcagtgccacctgccccggggacggctgcgacgctcggcccgactatcggtacgaccgtgcgagcgctcacgcacgagtctcttcatcgcgcgctccgggcatcgcggctcccgcgcgaagctcccgtcgacacgattcactccggcaccacatgctggcggcgctgcgcgtacgcacggacggagagcgtccggcccgagcacccagctcaccctggttcgatggctcgtgcggacgcacaggcatctgctcgctcgcccaggagtgtccacacggccgagagactctctagggtggcgttctaggaggtggcgatgcgagcagcgttctaccgtcgctttgggtcactcgacgacctcgaggtcggtgagctcgacgaacccaagctcgggcccgactgggtccgcgttcgcgttgaggccgcggccgtcaatcccgtcgattggaagattctcctcggtcgcctagccccgatgatctatgccacgtttccagtcgtacccggttgggatgtcgcgggcacggtcgaggaggtcggacctgccgtcacgcgctttgcacccggcgacccggtcttcggctatgcccgcctcgacttcgtgcacgtcggcacgttcgccgagatcacctgcgtccccgagcgagtcctagcacgccgcgacggcatcgacgcggccaccgcagccgcgatccccctggccggcctcacggcctaccaggccctgaccgaacgactcacagtcgcagcaggcgaacgtctcctggtggcagccggagccggaggcgtgggaagcttcgcaatccagatcgcgcggatcctcggtgctgacgtcctcgcgacggggtcggccgcgagcgccacggcgatcagcgacctcggtgccgagccgatcgatcgcaccgtcgcgctcgcggaggctctcggtgggcggcggatcgacaaggcactcgatctcgtcggtgcagactggtcccgcgaggcgcttgcgatcctcgccgatccttcgcgtctcgcctcggtcgccgacccgagcgtgcgggccctgggagggcactacgtcttcgttcgaccagaccccgacggcctcgacacgctcgccggatgggttcgagagggacgtctcactgttccgatcgccgaacgattcgagctccgcgacgtgcgccaggccttcgagctctccatggggggccacacccgaggcaagatcgtgatcgacgtcgacgcatgaccgtcctgctcgacccgtccgacgtgaccgctcggctgacgcctgccattgccatcgaaggggtgcgcgacgcgctccgggccgcagctcggggcgaacttgccgcccctgcgcgcacagtcgttggcgtgggagacggcgcactcgtcttcacgatcggagcagcgccgtacggctatggctttcgggtctacgatcggttcggctcgacctcggtcgacgaccagctcgtcgcgctctggtcgcgagacggccgactcacggcggttgcccacgggcccgagctcggccgccggcgcaccggagcgatcggcgcgatcgccatcgacgcgttgcgtccaccgggcccgctcaccgtcggcatcgtgggtgcgggacagcaagcgtggcaccagatctgggcccttcgcgcgttgcgccagatccacgaagtgcgtatctttcgccgcaacgcggccgcgcgagccgaatggctcgagcgcttccgccgcctcgtcgaccacgtcgccgaagccgagacagcagaagacgcggcggtcgaggtcgacgtggtgatcttggcgactccctcgacccagccagtggtggatccgagcgcggtgcccaaggacgccctcgtcagctccctggggcccaaggacatcggagcctcggagctgcccgcgctcctcgtcgatcgtgcacgcatgatcgtcacggacgcaccagcccaactcggcccatcctcggttgcgaccgatcgcgcgctcacgccactctggtcgctcatcgaggatcctccgcgcaggcgcgaaggatccgtcttcctttcggcggggctcggagggaccgaggtcgccgtcctcgcgcgcgctctcgacgctcgcgccggctgacttttcggccacccaacccgcccacggcgcacctccgtgcgaccgggagggagggagcgacgacagaacaacgacccttggcgcgccgccccactccggccattacgggctcggtaccttctcgcgacctcagcgcgaccgcgccgagccaaccgcacccggagccctaccatgccctcgatcgatggtcggccacctcccgcgaccctgctccgagacgagggagcggcggggctcgtgtgccccgccgctccaagccacactgcccgccgcgctactcgcgcgtacgggccatcccggcgttctccggctccgaccaggaggcgcgcttcgactcttgggtcgccccgtacgctgcaccgagcacgaagccgatcccgatcatcaccaaccagactccgtacacgaagcccagcgcgaccaaccagacgccagcgcccagtacgaacgggaagatcgtgtgctcggggaactgtccgatcacgccggagatgtcagctggctccacgacggacacgtcctcggggcgcggcttcatccgcctggaccaccagccgatgtagagacctggcaacagcccaagtccggccgaggccagcagcagcacggaaccggtcgactcgtggctccagaagaagtacacgagcaagatgacgacgaagaacgaacctaccccgaggtagacccgcgactcattccgcactctcgtcacctcccgtcacgaccggcactgcatcagagtgctccgggtggttcatgtcccacaccgggcgcgtcgagcgcaccggcggcagcgaatggaagttgtgcgctggcggcggcgacgaggtcgcccactcgagcgtatgaccatcccacgggttgtcaccggccggtaccgggtgacgccacgaccagtagaggttgacgatcagcatcgccatgccgataccgaggacgtacgcacccaccgtcgacacacggttcaagaatgtgaagttgggggagtacacgcccacccaccgcggcatcccgcgaaggccaagcaggtattgaggcatgtaggtgatccagaagccgatgaagctgatccagaagtgcgccttgccgatcccctcgtgcaagagccgcccggtgaacttgggataccagtagtagaaccccgccaacatcgcgaacaccgtcgtcccgatgagcacctggtggaagtgtgcgaccacgaagtaggtgtcgtgcgtgtagaagtcgatcggaggcgacgccaacatgacgccggtgatgccccccatgacgaacgccgcgatgaatcccaccgcaaagagcatcgaggtgttgaacttcacctgcccaccccacatcgtcgcgatccacgtgaagaccttgatgccggtggggaccgcgatcagcagcgagagtgccgagaagaacggcaacaggaccgtgcccgtggtgaacatgtggtgagcccacaccccggtcgacagacccgcgatcgcaagggtagcgaagaccatccccttgtagccgaagatcggcttgcgcgagaacaccgggaccacctctgagatcatgccgaagaacggcagggcgaggatgtagacctcggggtgcccgaagaaccagaacaggttctgccacatgacgggcacaccaccgccggacacggtgaagaagtgcgccccgaagtgtcgatccgcgtacagcatcacgagcgccgccgtcaagacagggaaggcgatcaggatcaggatccccgtgatgagcatcgaccagacaaagagcggcatgcgaaacatggtcatgccaggcgcacgcagatagaagatggtggtcaccaggttcaccgcgctgaagatgcccgagaagcccaccatcgcaacggatgcgatccacaggtcagccccgggtcccggcgagtaggtcgccgtcgacagtggggtgtagccggtccaaccaaaggcggccgcaccactcgccgtcaagaacccgaacagcatggtggtgcccccgaacaggtagaaccagtacgagaggctgttcaaccgcgggaaggccatgtccggagcgccgatcatgatcggcaccaggtagttggcgaacccagcgaacgcgatcgggcccgcaaacagatagagcatgatcgacccatggatggtgaccagagcgttgtacgtctggagcgacacgacatggccgttcgggttgaacagctgcgtgcgcatgagttcagccatcaatcccgcgatgaagaagaacaccagcgcggtgtacatgtagttcttgccgatcaccttgtgatcgacggaggtgacccaccggtagaacccccccggctcccgatgttccccctgctccaccggctgctctgctccgaggagcagctccggctcgtgcagcgtcgtcatgcgctggccctcccttgctgctgatgaatccaggtcatgaactggctcgcggacacgaccttcacgtagaagagcatgtcagcgtggtacaagccgcacaggtgcgagcaacggcccacgaaactcgcatcgtgctgcggggtgaaatcgaagtagttgacgacaccagggagcgcgtaccgcgagaagtcgaagttcggaaggtcgaacccgtgcacgacgtcgttcgacaccagccggaacgtcgacgtctcgccgacgggcagcaccaacgtcgggtatcccgtcggcccctgggtgatctcggtgacgtggtagctcggatagacgaacttccagccccactggaacgccgtcacatcgacgcgcagcgccggtttcttcgcgacagcatcgaccttgttctccactcgaaccgtgaagaagaacagcaccgcgacgatcaggatcggcaccgcggtgtagaagatctcgagcggcgtgttgccgtggacctgcttcggaatcgcgtcgccccggcggcgaaaccggatgatcgcgtagatgagcaaggcaaacgtgatgccgcccacgaagatcgaagcgacgaagaacccctgccagaggtggaacgtcgcgttcccttgaactgtgttccccgtgtaggccccaaacgtcggtagcttgcaggccgcaagcaccgtcccagcagcagccacgaccgcaggtccgcggagtcgtcgacgccaccgtcgacgattggtgatgctccgcctcgacatctcagtcacgtggaacctccagaatccccggtcgcccatgaccattgccgttaccgctgcccgccgattcggactcgtcgtcctcgtgtgcatgtccgttcgactgcggctgcgtcgccgccatcgcctgctcctcagggagcgtctcgaacgcttcttcatgaccgttgtgcacctggagctcgacgaaggcgaacgcaccatcgtcggtacgacggatctcgaccggaaccttcggctcaccaatgtgctccttgtgcccgacctcgcgcgtcagcaggtacgtcgcggtaccggcgagcaccggcatcgcgatcaagagcacgcgcatcgtccacagcaccaagttgagcgaggtatcgaagaagttcgcgagcacgtcggtcgcactggcgaagaagagcacgatgtagaacatcagcacgcccacaccgatggaggtccgcaccgggtgctcacgcggacgatcgcagatgttgtgctcctcgttgtctcgcgtgaaccgacgctcaatggccggccaggcgtacaagagcccaaaggtgatgccaggcaagagcaccgccgggaagaacacgttcgggatcatgtgtccgccataggttgggccgaagaccacctcccagctcggcatcagccgcagcgcgccgtccaaccagcccatgtaccagtctggctgcaccgcatagctcaccttgtaggggatgtaagggccatacagccagatcgggttgatctgcaccagaccaccgagcgccgcgagcaccgccgccgtgatgaagaagaaaccaccggcctgcagtgcgtacgctggccagaacgcgatgccgaccacgttgcgattggttcggccccgccctgggtactgcgtgtgcttctggtgccacatgatcgcaaggtgcgctccgatcaagcccgcgatcgcagccggaaggatcagcacgtggatgatgaagaagcgcgggatgatcgcggttcccggatagttcccaccgaagacgaagaaggcgagatagctcccgaccaccgggatcgagagcaggatcgagaacgcgatgcggatgcccgtgccggagatcaggtcatcgggcagcgagtagccgatgaacccgttgatgatcgacagcacgagcagggtcaatccgatggtccagttgatctcgcgtggcttgcggtaggccccggtgaagaagatgcgcaacaggtgcacgacgatggccgcgatgaagacatcagccgcccagtggtggatctggcgcatgacgaggcccgcgcggacgttgaacgagatgttcagcgtcgacgcgtaggcctctgacatccgctggccgcgcagcggagcgtacgagccgtggtagatcacctgctgggtggacgggacgtagaacagggtgaggaacacgcccgtgaagatcaggactacgaacgagtagagggcgatctcccccagcatgaacgaccagtgatccggaaagatcttgttcagcgagttgcggacgaaccgtgccgagccaaagcggtcgtcgatctcgtccgccgcttgcagcgctcgttcctccaacgtactcatgcgccacgctcccagaacccaggaccgacgggctcgtcgaacccggcctgcgcccgaaggacaccctcgctgtcgatgtagagcggcagctgtgggaggggtcgcggcgcgggcccgaagacgttggtagccccggtcaagacgtcgaacaagctctggtggcacggacagaggagctgctgggtgagttcctggtagagacccaccgggcaccctgcgtgcgtgcacaccttcgagaacgcgagatacccctgtggcccccacgtctcacggcccggccgcgtgacgaggtcggttgtcgctggacgaaccagcacaacctgatcgatcgcgttcatcggggagttctcccaaccctcggggaacaccgtcagcatcccgccgacctcgaggtcgttcaccgtgacgacacgaccactggccgtcacaagccgtgaacctgccttccagtcggtgaggaacagggacttcccggggacggggccgagagagcgaaggaacgggaagaggttgatcaacccgaaggctccaaccgacgcaccgagcagcctcaacaagaacgagcgtcgctgcacctggttgagtcctcggctcagcgatgcatgcatcgcctcgcgctcgacgtcgtccgagcgaagctcgtgacgctcctgcacgtagggaccctggggcacgaggtacttgccccacgcgacgataccaacgccgatgccaccgagcgccacgaacagcaacgcgccttcgacctgtggctgtccaccgagccagtaggtcacgcccaagccgatagtggcgagcaccgacaagctgaacgagatggcgatcagccgctcgacgaacggccgacgctctggcgtctcctctgtcgaggaggttggaccagtcctcgagacggtcatcgaggagccctcccgccgatccaatagccagcgaccatcaaccctcccaaaccgaacacgatcgcaacgagtccctccgtgaccggcccgacatgaccaagacccgcgccgccgcgatcattcggcgcgtggaggtactcgacgtagcgaaccacgtcggcgacctcctggttcgacagcgtgccggggccgaaccgtggcatgttgccagggccggttcgaatcgcctcggcaacttgcgtcggggtggccggatagagcgacggggcgaacacgttgttcgcgagggcatcgcccacacccgtgatcgtgtgacaggcggcacaatcctccgagaagaggaactcacctcgggatatgttggccgccttcagattgacgctcggaatgccaggaccccccggcgccaacgacacgatgtacgaggcgatcgcctcggcctgctggttggtgaggcggggcggcttctcgatcgcctgcgtcgtcggatcggcgagcggcatgcggccggtcgtgatccagaagtccaccgtggcggctccgaggccctgcaagttcggcgcacgcgtcgacccttgcgcgtccacaccgtggcacgtctcacagtcctcagcgaagagcgcttgcccctcgggaatcagacgcttcggagggttcacgtacacgatcggtgaaccacccgacgagccgccggagttcggtgcctgcgccagtgccgtcgacggggccgccaccatggccacggcagcgagcgtgccaaggccggcgacaccagcgatcgccgacagcacgcgcggtcgtcgcagcgaacccttgctcaaccaacccaccgagttcactcccttcctcggacgcacctagtgcaccaggaacaggcacgcaaagagcgcgacccacaccacatcgacgaagtgccagtagtacgacagcgcctggaacccagggagatgtcgacgtccccccttgacgcctcgcaggcgcagcagcaagaacaacatggcgacgaggcccacgatcacgtgcagtccgtggatccccgacatcacgtagaacagcgacccgtaggcattggtctgcggaccgaaggtcaaggtggcccactccaccgcctggttcgcgatgaaggacccacccatgacgaaggtgagcgccacccaccacatcgccgcacggggccgatcgtgctccgcctcgaacaaggccttctgcatggtgacgctcgacagcagcaagatcgtggtgaagatcgccgactgcaccgtgtcgaggtgcgtgcccgcgggtggccacggcgagccgacgtgtgctcggatcgtgaagtaggcggcgaagaggccactgaagaacatcagctcggatccgagccacaccatcgtgcccacaccgagcaacgacggtttcgagaacctgatcggctcccgccgtggcgcgccagctagcgtcgcctcgaccatgaacgcaccctccagcccactcaagcctcacccatctgcgagtgcctcgtggagccaggagggagccgacgctgctgcacacagcacgacgtgctgcgtcgctcgcgtcaacgcgacgtagatcgaccgctctcccgtcggtcccttcgcaagggccgccgcatcgagcacgactaccgcgtcgaactccatcccccgaatcccaggcacatccgtcactctgatcgtatcgaggtcgccgagtcgagacaaaatcgagccgataccccccactgtgttctcggcgacggaggggtcgaggacgagtgcgacggagtgcacctcgttcgcgagcgtccgcacgcgagcgagcgcgaactcgaccacgttctcgccaagatcgtcgatcagctccacggccccaggggtccgacggagcacgacctcggcaccttggtcatcgccgaggatgcgctcacggaggcgagcgaccgctcgtccgatacgcgcaggcgagcgatagttcacgcgcagctgctcgatcgacacatccttcaggcgcagctgctcgatgacggcgctccacggctggaccccccacggggccagcgactgcgcccggtctccgacgagtgtgatcgatgagcccgacagccgccggcgtatggctcgagcggccatcgggctcacatcttgggcctcgtcgaccacgacgtgtccgaagacccgcccctcgtgggtgccgagcaggctgtcgagctcgtcgagcagcggcacgtcctcgacctcccacacgtgccgagagggatcctcccccggctcgagcgcaaggagagcagcctcgtcggcactcaagacgccacgcgtggccgatgccagcagagctggacgcgcgcgcatgtcatagagcacctcctcggcgctcagacggggccacagccgtgccatcacccgctggaaggcctcgagatggcggatctcctggcgcacttcgcgcacgatgtcctcgtccgagtcatccgggaagcggggaggccaatctgccccaggaccgaacagcgccacgactcggtcgtcaccaccccacgcctccctgatcagcggcccgccttggaggaccgcgtgtgcgagcgcgtcgaggagcgcatcttcgaccgagcgacgccgctggttgtggcccccgcgcacggatcgagtcgcagcgatcgcgcgacgtgagagctcgggcgtcacggtcagcacacgagatccgaacgggatctcgatacgatggcggagcggacgctcacgatcgcgaaccgccctggccagaaccttcaccatgcgcgggcttcctcgcagtgcgcgcgattcgggcgtcgagtccgtatcgccaacaagcgtccccggtcgcagtgatgccaatgaccgcagctcgaccccactctcgccgagcgaaggcaagacgtcgcgcacgtagagcacgaacccaggggtcggtccgaccacgagcagcccctggtgttcgagccgccaccgataggtgtagagcaggtacgccgctcgatgcagcgcgacggcggtcttgccggtgcctggcgagccttccaccaagagcgcgtggccaagaggtcgtcgaatgagttcgtcctggtcggcttggatcgtagcgacgatgtcgaccatctgagctccgcgcggtcgctcgagcgctgcgtagagcgcggtcggtccggcagtcacatcctcgctgccacgccccgacaacacctcgagctcgagccgacgcagctcgccgtgttccaccgcgaggtgccaccgacgctccacgcccatcggcacctgtgccgtcgctcggtagaacggttcggcgaccggagcgcgccagtcgacgacgagtggatcgccgtgctcgtccgacagggagacccgtccaatgtggaaccgctcctcgtcgtcgcggtcgagtcgtccgaagaccaaggcgtggtcaccaagttcgagggcctcgagtcgacgcagcgcattctccacgaagacgtctcgctcgagccgagcctggtgcgtaccaccacgctcctgggcgagcgcctcttcgagcgagcgctcgacccctccccgaaccgcgccaagccgccgataggccagctcgacgaagcgccgctcctcttcgaacgcctcgtcgaccacgcggccccaccctcctagactcgggagcacttcagtctatggcctcacccgtgcactcacctgagccagcgctcctcgcggcgcttgcccgtcggcccggtcaccacgttcccgtttggttcatgcgccaggctggtcgctccctccccgagtaccgcgcagtgcgcggcgtggagtccatcctcacggtcctcgaggatcccgaactggccgcgacgatcaccctgcagcccgtcgagcgctaccacgtcgatgcggccattctgtacagcgacatcatggcaccgctcgccgcagcaggggtcggggtggacatcgtgccgggcctaggtccgacgttcgacccgccgatccgtgcacgcagcgaccttgcacgtctcgaccggttccaccccgaagcgctcgaggccatggcgtcaacggtccggctcgtcaccgccgcctcccccgtgccgctgatcgggttcgccggcggacccttcaccgtggcgagctacctcatcgaaggtcgcccctcgcgtgactacagcgccacaaagcggctgatgctcgccgatgccggcctgttcgccgccctcctcgagcgcctgaccgacatcgctgcggccagtatcgccgtccaagtcgaggcgggcgcaagtgcggtccagatcttcgactcctgggccggagccctgtccggaccagcctttcgggaccacgtcgcccgccacctccggcgcctcgcagccgtcatcggcgagctcggcgttccgtccatctacttctcggtcggcacggcgcacctcgaggccgacatctgcgaactcggcttcgacgccgtcgggatcgactggcgcgttgacctcgaagggttcgcgactcgccacgggagccggctcgcactccaggggaacctcgaccccgcatatgtcttggcccccgtcgatgtcgtcctcgccgaggcacgagcggtcctcaccgcctcggctcccgcgcctggctatgtcttcaatctcggccatggcgtcctgcccgaatccgatcccgacgttctcgcccgcgtcgtcgacctcgtgcacgacgagggcacccggctgcggacgaacgcgctggaggcgacttcgtgaacgtcatcgtcgtcgggggaggcatcagcggacttgcggctgcatgggaggcggcgcgccacggtgcatccgtcatgctcctcgagtcctccgaccggctcgggggcaagctcctgacctcacacgtcggcggctcgctcgtcgaactcggccctgattcgctcctcactcgcacaccgagtgccctcgaactcgtcgactcgctcggactcgacctcgtggctcccacagccagccgagctctgctctggtcgcgaggtgcgcgccgccccatccctccaggcctcgtgctcggcgcaccaccgaacctcgaacgtgcgctcagctcggatctcgtcggtcccatcactcgccttcgcgccgcgtggggtgtgatcgcgcgatcccggcgtggccacgagaccgacgacctcggtcgactcgcagcgtggcgttgggggcgaacctggagcgaacgacacatcgagccactcgtcgggggaatcaacgccaacaccatcgtgggcctgagcgcccgggtgagcgcacccagcatcctctcgatgccgcccagcggcccaccagcaccagccccctcccgaccgacgcgccctgcgttcgtcgccccttctggaggcctctccaccctcgtggacgccgtagcgcaggtcctcgtggacctcggcgtcgatgtgcgctcctccacctcggtcaccgaactcgctccggcccctcacggcaccgccgtcaccacctccgacggcagctcgttcagcgctgatgccgtcgtcctcgctgtaccggccttccgtgcggccgagatccttgcggcctcagcgcccgaagccagcctcctgcttcgcgggattcgctacgcatccgtcagcgtcctggccctctcgatcgcgccgacgctcgcgccgtcgctcaagggcgtcgcgggggtgctcgtcgaccgacgcgagggtctcatgaccaccgccgtctcgctggcgtccgagaagtggccgcactgggcaggggacgacgcgttgctccgcgtgtcggcgggcaacctccacgacgtgcgcccgctcgatcgggacgacgatcgcctgcgcgacgatctcgtcgccgaggccgagggcatcctcgaggcgaccctcgagatccgcgatgcccgactcgcgagatggacgaacgccttccctcacttcgcgccgtggcatctcgatctcgtggagcgaatcgatcgcgaactgcgcgacgcactgggctcgaccgtggcgctcgccggcgcgtggcgtcgcgggagcggcatcccgacgtgcatcgcgagcggacgcgacgctgctcgagcgacgatcagccgagacaactgaccgcgccgtcaggcctccgaccgctcggccaccccggccgcatcaaaggtcgccatctccgcgaggatgcgcgccgcggaccgcaccagcgggatcgccagcgccgcacccgagccctcaccgagacgcaaatccagatcgagcaggggacgcagaccgagatgctcgagtgccgccgttgcgccgggttcgaccgatcgatgcccggcgatcacaaagtcagccgccacgggatcaatccctgccgcgaccagcgtgccagcgagcgagatcaccccatcgaccaccaccgggatccgcacatccatcgcgccgagcactacgccagcgatgactgcgatctcgccaccgccgagctccgccaagacgctcatgggatccgtgggcgggccggatcgtgcgagggaccgctcgatgacctcgatcttgcgagccagttgcgcatcgtcgatgccggttccacgacccgtgaccgcagcgggtggcctgcccgtcagcgccgcgatcaccgcagcgctcggcgtcgtgttgccgatgcccatgtcgccggtggcaaccaggtcgatgccgtaggcgtgcaggctcgacaccagcgcgcggccagcctcgaccagtgcgcgagcgtcatcgagatcgagtgcggcttcttgggcgatgttgcccgtcacgcgccgtcgtgcgacgtcgaggagagctgggtggcgctccagctccgtcgcaacaccagcatccaccaccaccaccgacgcgccgacctcgcgcgccagcacgctgatggcagcgcctccagcgaggaagttcgcgaccatctgcgccgtgacgtccctcggccagggggtcacgccctcgtcgacgacgccatgatcgcacgccgcgacgacgatagcaggacggcgcggcaccggcggggggtcgaccccagcgatgccggcaagctgggcgccgaggtcttcgagcacgccgagtgagcctgccggcttggtcagacgaaggtgatgcgccctcgccgcagcctcagcgcgttcgtcgcgccccttggctgcggatcgcgtggcgtccaccccacgatcggtcggcgcgcgcatcaagcgacagggtccgggacccggggagtcccaaacatgaaccggctgaagatcacgtacttgccgacccacacgacgccgaaggcgacgagtgatgcgaggttgatgagcacggcatcggtcaggtgaccaacgtgggccgccgaggcgcgagcctgcgtccacgcgacggtctcgatcgaaacccacagcccgatgaaggccagtgcccagaacgggatgacctccttcaggaggtgtgagcgtcccgacttgccccaagcccagcgacggttgaggtagtacgaagggatggccgcaacggccgtcgcgaccacgttggaggtcacggcggaaaacacgcgcatcacaccaaagagcaagaacaggatcgcctgagtaatcagcacggaaatgaccgaggtcacggcgtacttgaccgacgccggaccaaaccgagcggtgatcgcgtcattgaggtggagtacgagggagcgcacgcggctagcctaccatcgagtagcccgtcgtcggcgacgcgtgatcgtacatcgatcgcatcgaagggatcgttcatgagcgaggctttggaagcggtccttgacctgctcgatctcgagccgatcgaggtcaatatctttcgtggacagagcccgaaggaggaccgacagcgcgtcttcggcggtcaggttgctgcacaggcactcgtcgcggctggtcgcacagtcgagcgtgatcgaagggtccattccctccacgcctatttcattcggcccggagatccgaacacaccgatcctctacgaggtcgagcgcattcgcgatggtgggagcttctcgacacgccgagccatcgccatccagcacggtcgtgccatcttcgccctttccgcgtcgttccaggtccccgaagagggcctcgagcaccagctctcgatgccagaggtacctgatcccagcgccgtcgggacgctggagcagcagctcgagccgtggtcctcgcaggtacgggaatggctcgaccggccgcggcccttcgacattcgcttcgtcacgttgccgccactcgcccgagccgaggggtcccgcgagccagtccaacggatctggctccgtgccgacgggaacgtccccgacgaccccttgctgcacgcgtgcctgttcgcctacgcctccgacatgacgctgctcgataccgccctcatcccgcacgggttgacctggttcgacggcaccatcttcggtgcctcgctcgaccacgcgatgtggtttcatcgcgagggccgcgccgaccagtggttcctctacgacaccgtgagccctacctcccagcagggccgaggattggccgaaggcgccatgtacgaccaagccggccggcggctccttaccgtcatacaagaggggctgatccgtcgggtgcgctgaagcggtctgccgcgcgcacccgacgccgatgtcagcgctgctcgaccggaacgtagtcgcgcttcggagcgccgatgtagcgctggcgagggcgcacgatcttggcgtcttgatcgagcagttcgttccagtgtgcaagccaccccgacatacgagggatcgcaaacagcaccgggaacatctccacggggaaacccatggcttggtagatcaggcccgagtagaagtccacgttcggatagagcttgcgcgagatgaagtactcatcggagagcgcgacctcctcgagcttcagggcgatatcgaggagtgggttcttccccgtgacctcgaacacgtcgtaggcgacttccttgatgatgcgcgcgcgaggatcgtaattcttgtacacccgatgcccgaagccctggaggatgccatggccacgcttgatggattcgacgaacgcgggcacattgtcgatcgagccgatctccgtcagcatgcgtacgacggcctcgttggcgccgccatgccgcggaccatagagcgccgcgcaggccgctgccgcggatgagtaggggtcagagtgcgctgagcccgtgacgcgcatcgccgtggtcgagcagttctgctcgtggtcggcgtggaggatgaacagcacgtcgatcgctcgaatgagacgcggatctgcctcgtagcgaggctcggcgatcttccacatcatcgacaggaagttcgccgggaacgacagcgagttgtccggatagacgaacggcatcccttgcgagaatcgataggcagccgcagcgagggttggcatcttggcgatcagacgaatgatctgtcgatgtctggcatcgggatcgaagatgtccttggcgtccaggtagaacgtcgagagcgcggcgaccgccgagaccaagatgcccatggggtgggcgtcgtagtggaatccctcgaggaagcgcttgcgaacgttctcgtggatgaaggtgtggtgcgtgatctcgtcgacccacgtctcgagctcgctcgcggtcggcaattcgccgtggagcagcaggtacgccacctccagataggtcgagcgttcggcgagctgctcgatcggatagccccgatagcgcagaatccccgcctcgccatcgaggtacgtgatcgcgctctcggccatcgcggtcgataccagtgcgggatcgaggaaccagatgcccggcagcgccttgctccaatcggccgccgaaaccgtaccgtccacgatggggatctcgacggacacgccggtgcggttgtccgtgatggtgatcgactcaggcattgcgacccaccttcctactcagtcgaaactgaagggtcggacgccaccgattcggtgacactccgaccccccaaccgataacggtacacagcggtgtcgcgctccacaaacccgaccgaccgatagagcgcatgcgcagccacccgcgtgggccgcgacgtcaggtccacggtggtcgccccggcctcctcggccagtgcgagcgctctggtcacgagcgcgcgtcctaccccgtggccacgtcctcgctcgtcgaccacgacgtcctcgatgatcgcccgcagtccggtcgggatcggtaccagcacgagcgtggtcataccgacgacgtcctcgccagcccacgcaaggaggagacgcgtcgcctctgaggacacgacccgttcgagatcggcctcggtcaacggtgcagccgtggtcgacagctgtcgaacgaggtggttgaccacggcgagcatgccgggctcgacggtggtggcctcgcgaaccacgacggccgatggcgacgcgatcatcgccgccagcctaggagcgccgacgcgatccctcgaaccgcgaggatgaggacgactagcatgggagtcaatggtggagttcgcctggcaccgccgcgttcgtcagcgccgcaggccagcggcgctcatcttggcgttgtccggttggaccgacgctggcgaagctgcgtccaccgcagcgtccacactcgaacgactcgcggggctcgtcccctacgctcacgtcgaccccgacgagctctacgacttcactgcggtgcgtccgctcgtcgagatcgacgagcgtggggtgcacggcatccaatgggggaccctcgtcctccggggcccggctcgccaacgcggtcccgcgatcttctccctggccggaccggagccgcaactgcgatggaaggcgctcgccagccagattgccgaggttgcacaaggactcgcgatccagcacgtggtcacgcttggagcgttgctcgcgggcactccacacacgcgcccagttgcgctcgtgggattctcgactcgtccggaacttgcacgcaagctcgatctgctgccctcgcactacgaaggtccgaccggattcttgagtgttgcccagggcgtgctgcaaagttcgggggtcgacgtgacctcgatctgggcggaagtccctcactacctggcacagtttccggcctatccggcggccctcgcgctggcgcaagccaccaccaccgcgctcgacctggatctcgatcccacgccggagctcgacctcctcatcgcgcggacggcggccgaaatcgaccagtacgtcagcgacgatccagaactcgtctcctacgtcggatcgcttgagcactcctacgagatcgatcaacgaacgcgccgatcggccgagcggatctcctgggaggcacaacagtacctccgtcgtttcaacgcggagtgacgccgtcgacgcgtccgggccgaggcggatcgaagtaggcggcccacgcgcgggtcagcggttcgtctcgatgaaaggcgcgctcgagccacgggagccgcatcagcgcagccacgttctcggggagctcctcacgttcgaaccaccgcaccgcacgcacctcgagcggatgcgcccgaagcgtcccgccgaccggacgacacaagaagatggtcgaatacatcgcgaccctggtgaagccacgccgcaggccgtcgatctgaccgaggatcgcctcgggcacgacctcgatgccggtctcctcgaagacctccttcacgacgacttcggccgcggagtagccgacgtcggcccaacccgtcggatagagccacacacccgagtcggctcgctggatgagcagcatgcggttcgagtcgtcgacgacgaccgccccgaccgcacacttgggcgtgacgtagccggcgacaccctcggcgactcccctgatgagcgcaccgacggtctcgtcctcgggctccccgataggggcttccgcgttgcggagtctcaccacgactcgcaagatctcctcgtagcgctcgcgctcgtacccagaactcgtgaacgcgagtcccgtccgcgcaatgctctcgatctcgaggagcgccacctcgagatcgcgtcgctcaagctccatgagggcacccctctgtccgcgcacggtcactcgtcacatcccatgctacgctcgagccgtggccgcgcaggtgacctgcaagcactacctcgtcaaaacgctcccgagcggagaccgcctcgagcgatgccgagtcgacgccgcgcgcacactgcccttcgactgccctgacggctgcctcttctacgagccgcgtgctcgtatctcgcggctcgggtgggtcgatccgcgaagcggagactagagccacccgctcgatcaccgacgatctccatcaccgacgatccggcagctcgaccgcggctgcgttcgccgtgccccgggcaccgcgcaggacgaaccggcagccccacgcgccagccgcgaggtcgctcagctcagacgtgcgtccttcgacacgacacccagcgactcggccttcgctcgaccccactgcacctgaatcgcggcgaggtctggcgaaatgtcgaccgcgctgcgcggcaggaggccgcggcgctcgagtcgctcgacgttcggtcgctcgacgtgggctcgcaccgactcgagcacgagacgacgcaccaagccgatgggcggctcggcctgctcctcgacgggtgcgccgagcagggcggtcagctcgttcgccacgtgctcctcgagtgcatccagccacgtcaactcacactcgccctcacgcgcgagctcgttgccgaggcgcaccatgaaggccgggagtgcgtcgagcaacgcctcgagataggcagcgctcgcgcgagcaaacggaagagcatcagccttgtggtccatcgcgatcagctctcgaccacgtcgccgaccagctcgacgtcgacaccgacaccgcggagccactcgatcgcctgctccaaattgtcggggttcccttcgagctcacagacgatccagccactgtcgtcttccacgttcgcccgtcgaatgttcgcgatgacaccgtgatccctcgccaacgtggcgatcacgggttcgttgatcagctcgccctcgtaccagagcttcgccttgaaccgagccatcccgcctcctccgaacctaccggacccaccgagtgctgacgcccacgaaggtcggcgagatcgagcgtagtgtacgtgaagccaaggcgcgagccgagctcggtgagctcctcggcgtgcgccaacaccgccgctgcgagcgctcgtggcacctggatccgcgccgtatcgccatggtggcgcacacgtacatcgacgataccgaggcggtgcaacgcggcttcgaaacgctccacctggctcagacgacgaggcgtcaccggcgtccctgtcgggatgcgcgacgcgaggcaggcggcagccggcttgtccgcgagccagtcgacaccgagctccctcgcaaggctacgaatggatgccttgttgacgccgagctccaagaacggcgcgcgcaccccagcctcctcggcagcgagcatgcctgggcgccagtcgccgagatcgtccacgtgcgcacccgtcaccatgacggcacggcgctcctcggctaccggcccagccgctcggaacaggtgggtcttacagacgtagcaccgcatccggtcgttgcgaacgtaggcggggtcctcgccctcgtgtgtcgcgacctcgacatgacagatgccgttctccaagaccagccgggcgatggcgtcgcgctcgtcggcggcgagcgaggccgaccggccggtgacggcaacggcttgatcgccaatcgcgcgggtgccggccaccgcgagcactccggagtccacgcctcccgagagcagaaccacgacccgttcctgccgctcgaaccacgccgtcagcgcgcgcagctcagtagaggttcgcaccccgacgagcctaggccgcggacacctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtaaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgtgacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatttcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagctcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagggccgagcgaggacctccgctggatcggcgagaaacccgacgtagaagcgaccaaactcgccgtagtaggccgacgcctcgtcgtagcgcaatgtgtagacgacgtccttgatgtcgtccggtcgtttcgcgaacaacgtcacaccccactcccagtcggtgagtccggtggcacccgtcaccagttggatgactcgtcccgagaacttgcgccccgacgccccgtgtccatacatgagccgctcgcgctctgcatacggcagcgcgtaccaattgaaggcgtcgccccgacgcttcgccatggggtagaagcaccagttcggaaagccctctggcggcaacaccgggtagaggcgcggacgcttgcggtcctccggcaagtgctgtgagtactcggagacctccgtgatggagacgaaggaatcgacgagcgtgagccccgctcgcgacaggccggcctgcaggtcacgcaagaccgcaaagtcctggtggagggccatgacggcgacctgcgcatggtgaccgagcagactggccgtcatcacctgtgcccccgcagtctcgcactgcttgagttcgcgcagtgcctcctcggcggcgtaaccgggacctggattggcgaacagatgcagcacgccgaggccggttcgcacctgcgagccgccgacctcgtccgaacccatcacctcagtgctgtcactcatgattggtctccatcatgctcactcgtgagcgcgcgatggcgcatcgcagcctcgcgtcgatcagcgatcgtgccagcgccgagggcgctccctgccggtagcgggaccgtcatgggttgcgactcctggagccgatgcgcccgagccacagcgtcgtggtacgcctcgatctgcgcacgcatggacgggtctgcgtagaccgttccatcgatgagcaacccctgacggcgctccatgatcgcgaggatgtcgtcaccggtgatcgtcttctgagtctcgagagcatgagcgacggcgaggatgtcgtagcggtgctcctcgacgatctgggccacgcgctcgtagagggcctcgagtcgccgctcgacacgatcgccgatgccccctttgcgagggtcgtccgcaggcccgactctccggcgctgcggcccgtagccgccgatgccgaggtcgcgaaccgcatccagctggagaatggtgtcgcccataccccacgacgtgtccatcagggccgcgagcctcgaggcgctgaagagatcgcccgagacgcccgaggtgttgtcgccgccgaagaaggcgcgctcgccagcgagcgatgccagacccaccatgatgtccgcttcgaactcagagcgccaccgggtgaatcgctcctccttgggcaagtaggacacgagtccgaggaagttcgaacccttctcgatggtggcgatgtcgatcaccgaattacgccgcacgacaaccgccgttaccgcatggcacgcctcgtggacggcgacggcgtgccgctcgcgctcgacgtactcgacgtcttcgggcagaccgaaggtcttgatctgcttcgcacggatcatgtccggccactcgatgacctcgcggccctctcggatcgcgataatcagcgcctcgttcaccatgtccttgatggcggctcccgacaagtacggagtcatggtggcgagccggtcgatgtcctcgtccgagagagcgtggtggaccttggccaagtagccctggaacgtcctgatgcgaccctccttggacggatagcccaccttgtagatgcggtcgatccgaccggggcggagcagcgcctcgtcgagcacgtctggaaggttggttgcgaggatggtgagaatccggtacttcggcggttcctttggcttgagcccgagcgcgcgccgaacgaccctgttccagaacccacgtggcttctgcaagcccgacagctccgtcagaagggcttggagcgtcccgtccatgccgccaaaccccggcactacgtagcgccagaccgatcggccttgcgcgcgaggctccggcgcactcgcacgagcacgacgaagttcctcctcgaagagcacctgctgggtcgccggatcgaagtaggtgccaccatggcacgtgggcgcatcaccgaggatcggcgaacccgcgaagcggaatctgccatcggcaccagcgatggcgcctcgcgaaccaagcgagtccgcctcgtcgaagaaggcgacgaccccgccatagcgcaccgcgagcttgcgcagacgacggaagatcgacttgaccttcaaaataccgaccccgatgaacatgttcgcgaaggcaccgggctcgacgaagacgaacggcacttgggtctcgccggcgaccgcctcggcgatcagggtcttgccggtgccaggcgggccccacagcaagataccggtcgggacgtagccacccttctcctcgatgcgctcgggatcggtcaggaagatcaggttctccttgatccggtcgagtaccgcgtcttggccccagacgtcgctaaagcgcgtcttgacgtcgccagggaagtagacctcgtagccgcccttggagagataccaaaagatcgcgacgaaggagccaaccccgatgagcagatagaccccgatctcgatgatcgtcgggagcgagttcatcaccatgcccggcacgacgaacagcgcgaacaggggcgagacgtggtagtgggctgccagcacgaccgacaccagcgcaaggagaacgatgatcttcgcagctcgcgcgatgcgatagcgcgtccaatcgtcgcggccgtggccgaggcgctggatcggtcggacgacggcttcttcccacgcctggttccaggacgacgagcgctccaacgccagcacgttcacctggcgcaccacctcgaggaccacgagtacggtgagccaccaatcgctctgaagggtgctcgcaagcgcgacgcccaccggttcgagcggattcgcgttcgtctttgtcgccgtcacccaggcgatgagcaccgcgaggacgacgaggaacttcaagcggtcccacagcgactgcggaggtcggcagcccggccgcgcagcatgccgcctggccccggtggactcggtcatggtgttgcctccactccaaaggaacgaatgattgagtcgatcacacctgcattgcgtgcaaagcacgcgacgtcacatcccaccccgaggacataggcccacgtcgtcgagggattcacctcggcgatctgctcgagttcgatcggcgagctcgtaccgacgcgctcttccacggtcatctcagaaccccggaacccgcccttgcgcacgaacgtctggtaggccttgaccgagaagtggtcgatcgacgacgacggattgaagggatcctgctggaggatcagcgtgcgcaaggtcgccaacgagaacgaatcctgctcggcggaggtcaacgcctgcgccttcacgattccgaatgggaacccctcgctgaagccgttcgagaccgcagacaggccagcgacgtgcttgccaacgatgatgttgccccagagactctgctcgacctgtcgaagcgtcgtcgaactcgcacgaggatcggccgaccggaagacctgctggaccgtaaagcgctgccaacccgaaggaatcgcgtagtagaccgactcgcctgcagcgtcgccgtgactgacgtacgagagcccgctcgccgagcagctcgcagcgagggcacccaacgtgatcgtggccagggttctgcgcccccatcctcgcgaacgagcgaacgaccacactccaccacgccttcctgagcgaatggatccccccgctcggggaccgagccctcttccatgctaccgccttagcttgtggacaactcaggcgcaccttcacgcgaggtgagagcgcagaagccagcccagctctgccacgtccgaggtttcccgctcggctcctgcgaccacgccggtctcgagcagcacaggccccacaacgcatcaaaggggagcaggcaagcctgctcccctttgactgtgcgtcgcctgccgcatgcgacccggcgacgccgtcgtcccttagaagtcctccatcccggcgccagggttgaccgccggcttgggctccggcttgtcgaccacgaccgcctcggtggtcaggaagagcgccgcaatggacgccgcgttctgcagcgccgaacgggtgaccttcacggcgtcgatgacaccggccgccaccagatcctcgtaggtcccggtcgcagcgttcaagccctcgttggggttggtgagtgccttgactcgctcgaccacgaccccaccttcgaggccggcgttggtcgcgatctgccgcaacggctcctccaccgccttggcgacgatcctcgcaccggtcgcctcgtcaccctcgagcttctctgccttgtcgagcaccgcacgctgggcacgcagcaacgccacgccaccgccgggcacgacaccctcttcgatcgctgccttggtggtcgagacggcgtcctcgatgcggtgcttcttctccttgagctccacctcggtcgcggcgccgaccttgatgatcgcgacgccgccggacagcttggcaagacgctcctgcagcttctcgcggtcgtagtcggagtccgtcgcctcgatctcgttacggatctgctggatccgacccttgatgtcggcgtcgctccccgcgccctcgatgatcgtcgtctcgtccttcgtgacctcgacgcggcgcgcgcgacccaacaggtcgagcgtcgtgttctcgagcttgagcccgacctcctcggagatgacctggccaccggtgaggatcgcgatgtcctgcagcatggccttgcggcgctcaccaaagccaggagccttgaccgcgaccgaccggaaggtgcctcggatcttgttcacgaccagcgtcgcgagcgcctcgccctcgacatcctctgcgatgatgaggagcggcttgcccgcttgcatcaccttctcgagcaccggcaacagctcacgcaccgacgagatcttcgagctgaccagcagaatgtacgggtcgtcgaggatcgcggtcatggcctcggtgtcggtggcgaagtacggcgagatgtagcccttgtcgaagcgcatgccctcgacaaggtcgatctccatcccgaaggtctgggactcctccaccgtgatcacgccgtccttgccgacgcgctcgatcgcctcggagatcatggctccgacctcaggatcggcagcggagatcgcggcgacctgcgcgacctgctcgcgcgtctcggtctccttcgcgatggacttgagcgcgaggactgcgtcggcaacggcctcctcgatgccacgcttgagtgacatcgggttggcacctgccgcaacgttcttcaggccctcgcgaaccatcgcccacgcgagcacagtggccgtggtcgtaccgtcaccagcgacgtcgtcggtcttcttggcgacctccttcacgaggtcggcaccgagcttctcgaacggctcctcgagctcgatctccttcgcgatggagacgccgtcattggtgatcgtgggtgcgccccacttcttgtcgaggacgacgttacggcccttcggtccaagggtcacccgcacggcgtccgcaagcttgttcatgccctgctcgagcttgcgccgagcatcctcgtcgaacgcgatgagcttggccatcgttgcctccctggtctctcgcgagcagcgttttcaccacgtctgtgacggctctctcggccgcccagcatgcgtggttagcactcagctatgccgagtgctaatgatagcacctcgccgctgcttagccgccggcgaccgcaggaacgaccgacaccacatccccgtcgccgacggtggtcgcaagaccatccagaaagcgaatgtcctcgtcgcgaacgaacacgttcacgaagcgccgcggctcaccctcggcgtcgaggatacgctcggcaagctcggggtgctcactcgccaccacagcgagcacctcaccaaccgtctgcgcctcgccgaccgtgagttcgcccgcgccgcccgcaaggctgcgaagctgcgctggaatgcgcacccgtaccgtcactccaacccccatttccctctcgctcccgaccgctagcgcgcctgggctccgagtaacgaccaaaacgcatcgatcgatggacggatcacggtgccggtatcgacggtctgctcgatggcttcgaccgtcttcaggccattgccgctcaggtacgcgaccaccgtctcgtccggtcgaacgatcccctgcgaggccagcttggcgagcgtcgcgaccgtcactccacccgcggtctcgacgaagatgccctccgtgcgcgccacgagcgcgatcgcttcgaggatctcgtcgtcagagaccgcgccgatcgcgccgccggtcgctcgtgcgacatcgaccgcgtaactgccgtcagccgggttgccgatcgcgagcgacttggccaccgtcgatggcctgaccgggcgcaccaacgagcgacccgcctcgaacgcctgcgcaaccggtgagcacccctgcgcctgggcaccggatacccgcacgctcggcggctctggcatgagtccagcgagggccagctcctcgaaacctcgatggatgcgcgtgagctggcttcctgaggccaccggcacgacgacgtgatcggggtagcgccaacccagctgttcaacgacctcgaaaccgagggtcttcgagccctctgagtagaacggccgcaggttgacgttggcaaagccccaatcaccgcgctcggagacgatctctgcgcacagacgattgacgtcgtcgtaggtcccgtcgatcgcgacgatgttcgctccgtacaccgcggtggccaacaccttgacgcgctcgagattcgcgggaatgaagacgtaggcctccatccctgcccgagcagcgtgagccgcaaccgagttggcgaggttgccggtggaggcacacgatgcgacgcgcatgccgaactcacgagccttggagagcgcgacggccaccactcgatccttgaaggatccggtgggattcaccgtgtcgttcttgaggtagagctcccccagaccgagctccgcggccagcctcggggcgggcacgagcggggtgaagccagcaccgaggtcaatacgggcctcgtcgcgctcgatgggaagcagctcgccatagcgccacaaggtcggtggccccgactggatccgctcgcgcgtgacacgtgccgcgatctgctcgtagtcgtaggcgacttcgaggggaccaaaacagaactcacacacgtgggttgggctgatcggataggtccgcccacactcacggcacaccaggttgacaaccgctgacgacatcgtccctcccgccgccatcgctcgggcattggcacctggttcgacgtatcgaactggttgccgcggtatcacagggcccgtccctacaccgctctcgatgattcggcgtcactcatgctagcgactcggtcggcgctctgcgctgctcgcacgcgtgccaatggacgcacacgacctagcgtgaggtcatggctccagcgcgccagtacctcttcgtgacgaatcgagggccgttcgcgatctcgccgtccgggtcgctccacgaggcgggcggtggcctcgctgccggcctgcgaggactgctcgcaacgggtcaagcgcgatccgtcttcgccgtcgacgacggaccagaacgcgagcactggagcgccgtcggcgacgatcgcctcatcccagctgctgtcccggaggaagtgcaccgtagcgcctacgacaccatcgcgaacgagctcctctggtactgcgctcatcagctgttcgacctcgcgttcgagccgatcgacgacgctcactcgcgaagggcgtggtcgcactacgaaacgttcaacgagctcatggccgaagcagcgcacgccgttgccaatgttgacgacgtcatcgtcgtcaacgactaccacctctatctcgtgcctcgggcgctccgagcacgcggctggcaaggcacgctggtcttcttcctacacatccccgtgccgaccgagcaggagtacgcggtcctgccggcagtggttcgtcgggccctcctcgatggcatcgccgaagctgacctcatcgccgtccacgcaccgacgtgggccgagcggctgcgagcactcttcgatgcgagcggactcgtggcgccgccgatcgtggtcgcccccctccccgtcgacgtcgttggattgctcgagcgtgccgcacgtcccgatgtcgccgaagcgggcgagcgcctcgacgcaaccggcggcgcactccccacgatcacgcgcgtcgaccgcatcgagccgtcgaagaacctgctgcgtggcgtcgccgcgatcgaccggatgctggagctccgccccgacctcgcgggccggttccgagccctccacctcgcctacccctcgcgcggcaacctggacaagtaccatcgcctccgttcgtcgctcgtcgacatgatcgacgccgtcaacgaccgctggcggcgttcagggtgggtgccgatcgaggcgcacctcagcgacgacccggcacgatccatcgctgcctaccagcgcttcagggtgctgctcgtcaacccggtgcgcgacggactcaacctcgtcgcacccgaagcgagtctgctcgcccccccagacgcccacatcgtgctctcgcgtagcgcgggtatcgcagagcacatcggagaccatgtgacgctcgtcgacccgttcgacgtcgacgagaccgctcgtgccctcatcgatgcgctcgagcggcccggtgatctcgaaccggtgcgccgctgggttcacagcaattcctgggatcgctggcttgccacgatcaccccgaccgccacggagacgcgatgacaggctggagggacgtcgtcacggctctcgtcagagcgcaccgcccgctggttgcgctcgacttcgatgggaccctcgcctcgatcacggcggatccctcgcgcgccagcatcgctccggatctcctcgacgatctgagcgggctcgcgcgcacgctgcgcatcgcgatcgtgtccggaagacctcgctccttcctcaccgatcagcttggcgaccttgccgtgcggatcgagatcgcctccaactacgggcgcgacgagacggccacgcccgcagatcgcgacctcctcgaccgggtggcgagaggccttgcggacctcgcggccgatggcgcgctcattgaacgcaagccgacgtcggtggccctgcacgttcgggagcatcccgaactcgccgctcgagccgcggtgacggtccagaggttggccgccgcctaccaccttgatcttcaagaagctcgccaggcatacgagctgctcttgccttcatcggcgacgaagggcacggcagtctcgtccctgatcaccgacgacaccgacttcgtgctctacgccggtgacgacgtcggcgacatcgccgccgtcgaagccgtgcgcggtcacggcgggccgtcgtggtgcctcgcgatcgactctggtgagctccctcctgcgctcgcggcgatcagcgacgaggtcatcgatcagcccgaactgcaccgccgtctccactccctccgcgaactcctcgcctcgcgtcacgccgatcatgacggtcctgtcgacgattttgctcaacgaagtcgcgaggccgaccgatagccaccgcagtgatgacccgaggagggccatgatggtctcggttggcacggaggtaggcgccgctccgtcgcgtcgtgccgacatcttgcgcgcaacgtgggagctcctcgccacgaccggagccagccacctcaccatccgccgcgtcgcccagggagcggccgtcgaccccgccctcatctaccactacttcgggtcgaagcgcggcctgctcggagcggctcgcgacatgccagagggcctgagcgacatcctcaaggcccagcgagggccactcgaacggcttcggatcctgcaaaccccaccgtgggcgacgtgggtcagcgccctcgtcgcctcggtcatcgatgatcgagaggacgcgctgcgatcgctgcacgaactcatcgcgagcgtcgacaccaacggcgccctgccgcgccttgcgctcctcggcttcttcgccgatcgcttcttgctgcacgtgtggtcagctggacccgatccggccgcgccgttcgatcatgagctgctgcgctagcgcgcgcgggtcatccgcatcctgaaggtcggcctcgagcggcgatgggacggtgacgagacgagccccgggccacagtgcgctgagacgtgtcgcacttcgatcgacgctggcgacccagccaccagcgagatcccatgctggaccatcggcccgtcgcacgacgaaggggccctccagcgccacgcgccacatccagctcagcgcatcgacggacgcccgaaagagatcaacgggcaccacgacgacgaggtcctgcggtcgcaggtcgagctcctcaagggcggccacgatggcgcgatgcggaccgaacccggcatcagcgacagccgcggctcctgacaccccaggaccgacctcgacgacgcggtacgacgcacgttcgagtgcgtcgcgcaaccactcggcctggatcgcccctccctcgcgggggagacgagccttgtcggtacccatacgccgcgatcggccacccgtgagcaggagcgcgacgcgcaggcgtcgagccggagccgactcctcatgccaccccaccatcctggtaggctaggtccatggacgcagcgacgccgttgatcgatcccttcgggcgggagatcaccgacctccgcgtctccatcaccgaccgctgcaacttccggtgcacctactgcatgccggaagagggtatgcactggctggaccgaggcgaactcctgagtttcgaggagatcactcgcatcgcgcgcgtcatggcgacagccttccggctccagtcggtgcgcatcaccggtggcgagccgacggtacgagcgcaggtaccgtcgctcatcgaacagctcgcgcaggttcgtcgccccgacggcaccggtctcgagctctccatgacgacgaacggcgcgacgttcgcactgctcgcggacgacctcgtctcggccggtctggcgcgcgtgaacatctcgctcgacaccttgcgtcccgagcgcttcgcacagatcacgcgccggacccgcctcgaacgggtcatcgagggcatcgacgcagcaatccgcgtcggtctgtcaccggtgaagctcaacaccgtcgtgatgcgcggcgtcaacgaggacgaactccctgacctggtgcacttcgcggtcgatcgtggcatcgaagtacgcttcatcgagttcatgccgctcgacggggacgggcactggtcgccccgcgacgtcgtctccgaggccgagatgctggagctgctcgccgcgcacttctcgttccaccccctcgcacggtcatcggctccggcgaccacctacgaactcgatgatggatctgggcgcttcggggtcatcccgacggtgacgcacccgttctgcgacgcctgtgaccgcgtgcgcctcagcgccgacggccgcttgcgcacgtgtctgttcgcgctggacgagcacgacctgcgcccgctactgcgcggtggcgcaggcgacgatgcgctcgccgagcgcatcgtcgccatcgtcggcacgaagtgggcaggccatcagatcggtaccgtcaggttccgccggccatcgaagtcgatgagccaaatcggcggttgaatcggatcgctccgtggcgaatatgccacccggcgagtcattcctggcctagagtgtggccatggccgacggcaagctgacccacttggacccgctggggcgggcccgcatggtcgatgtgactccgaaggagcccacgcaccggagagcgctcgctcgctgcaaggtcttcatgaagcccgagaccacggcgctcgtcgccaacaacgccgtgaccaagggtgacgtgctcggcgccgcgcggatcgctggcatccaagcagcgaagcgcaccccggacctcatcccgctgtgccatccactcctcgtcggctccgtgtacatcaacttcacgctcggcgacacctacgtcgaggtcgaagcccaggtcgagaccgtcgaccgcaccggggtcgagatggaggcactcacggcggcgtccgtcgcagcgctgaccatttacgacatgtgcaagtcgtacgaccgcaccatggtggtcggtgacctcgcgctctgggagaaggtcggcggtcgctcaggccactggcgtcgggaggaggccgtcgagctgtgaccatgcgggtgctcgagggaatcttggccatcggctggatcgccatcctcagcgcaccgatcgtcgctcggcgcaacgaccctgacggatttgtctcgctgcgacggtaccgcaaggctcgggtggcactcgcgcgtcgcttcgatggtacggtggcggttgaactcccgattccttcctctccacggggctcgtcccaacagctggtcagacgtcgtcgggtctatctgctgctgggagccgccctcctcgctgggctcatcgcactgcccgtcgatccgctcggagggtttctcacgagcctcgtcgccgcgaccatgttcgttggctacgtacggttgatccgccggcagcggacaccgagtagttcgattcgccagatggtgattcagcccgaaccgagccgctagcatgctcgttcatcggcgaccacgccgatgaaccctcgggggtgtagctcagctggtagagcgctacgttcgcaacgtagaagtcggcggttcgagtccgctcacctccaccgacggtcagcctcacctgctggatctggtgggtccgatcacggtttgcatgacagcacgcgatgggttcaccagcgcgcgggcacgtgctcaacagacccgaccgcgccgagctgttggcacacatcgacgggcgcagcggccgttcgacggcatcgtctcttcgcgctcggctggtgcgtgtgcccacctccgcgagcggcgtctcgcaacgatcggttgaaccgagtgtgcagcgagccggcccgcttcgagcccctgggagtcctcgggatcgggagtgccgggcatacccgcagttcggcacgggctcgccgtggcgtggtcctcaaggaggtagcgatctccttcgtcggccgccccctcgagacatcgatgggggcagggggagcagtctcacccaacattgacatggaggggaactccgagcacagcgggttgcgccgctcgaggctgcctggcgcaacaatccggagcgcttcgtacgcaagccgccggagccgcctgccctaccgaggcacgtcttgatcaatccgccagaggaagtggcagcgccgacacagtgaagtgccgaccaggggtgtccgtcaaggctttgacaggttccggagggcgtacgatgcacgagcccacacgatccccgtgatgccgatcccccgtctgcgaggaatcaacgcatcgtgcgccgataggtaggccacctcggtggagattccccgtcagcgagaacacaacgctgccaccgcattcaggtgagcgctaccggtatggctcagtgctccgatgtgctcgggagccttgacagaacatcgtcgtcggatcgaccaaggagctgtgccagcgctccgagccgctcggggaccaggcggtagtacacccacatcccgcgccgctggcggctgacgatcccggcatcgagcagaaccttcagatggtggctcacggttggctgcgccaggccaagaggagccaccaggtcacacacgcaggcttcacccagaggcgcaccctggagtaggctgatcaattggagccgagcaggatcagccacagccctgagcagggtggcgagtctctgggccgctgcccgatcaagcgtcgggcgcgtcagggttggagtgcagacatcggccgccgtcgactgaccggcatcaggacggaccagcggccgtacggcgttcctcacagccctcatcctacaaccgccctctcggcaccgaagggatccgtcgaccgtggcctggatatattgatgaccatcaatacattacggtgcaaccacgcaggtcgaagaccgaccgccccgttgggcggcgtcaccaacgtgcagcagcactggacgtcaccgacgagcagcagccatcggcacgcgcatcgacctcgaaccgtgccagcgacgaggaccctcggacccaggcacgctcctctgataacccctcggtgtcccttccctccacggcggttggactctcagggagtcacgaactcccgaaggccgcgccgtagtgccactgcgcggaacacccgagcgcgccgacagtccccatcgcggagcgcttcccagtcgtgcagccgaaggcgtatggagctcgcgtgctgagcctccacggacccgccctcatcgtcacggccatcgcgatcttcgtcgcgaccctggccctcgtgatcacgcaacccaagggactgtcgatcggctggtcagcgaccggaggcgcgctgctcgctctcgcgctcggcgtcgtccacctcaccaacgtcgtcacggtttggggaatcgtctggaacgccaccgcgaccttcgtcgcgttgatcgtgatttctatggtgctcgacagagtggggttctttcggtgggccgcactccacgtcctgcgcgcagcccacggcagtgccgtccgtgccttcttctacgtgctcatccttggcgcggtggtcgcagccctctttgcgaacgacggcgcagcgttgatcttgactccgatcgtgtacgagcaagtgcgtgcactcgggttcgggcctcgtcaggcgctcccgttcgtgatggcggcaggcttcatcgccgacacaacgagcctcccgctcatcgtgtcgaacttggtcaacatcgtgagtgccaactacttccacatcggctttgctacctacgccaagacgatggccccagtcgacctcgtggccttcgtcgcgagcaccgcggtcctctacctcttctatcggcggatgctgcctggtcgttacgatccgaacgcgcttgccgctccccacagcgccatcgcggaccacggcctgtttcgggccagctgggtggtgctcggggtcctgctcggcggctacttcctctcggagccgctccacttcgtggtgtcgatccccgccggtcttgcggcgatcttcctcctgctcctcgcctcccgctctgccgcactctcctcggccgccgtgctccgcgaagccccgtggaggatcgtggtgttctcgatcggcatgtacctggtcgtcttcgggctgcgcaacgctggtctgaccactttcctctccgacgccctcagcgcaaccgctcgcgccggactcgtgccagcggcccttgcgagtggcttcggtgctgccgcgttgtctgcggtgatgaacaacttgccgaccgtcctcatcggtgcgctgtcgatcaacggagcacatctcgcaggactcgctcggacggcgtcggtgttcggcaacgtggtcggatcagacctcggcccgaagttcaccccgatcggctccctcgcgacgttgctctggctccacgtcctcgagaccaagggcatcaagatcagctggggccgctacttccgccaaggcatcgtgctcaccgttccggtccttgccatcacgctggcggccctggcagggtgggtcgccattgcgcactgaaacagcgtcagcccgcgatcgatcaaggagccttcgagagcaaggagcaaccatggacccacgacgtcgtctcgaccagccgcagccgacgagtgacccccgaccgatccggtgccgatacccggccgcctttcacggaggagacctcgggccagccgagaggcgcatcggtcatctcggacccggtgccgctcgatgggcgcagaggtcagcatgatgcgccttctgtgcatcggagggagcgacggcgggatctctgccgcgttgcgcgctcgagagctcgacgcctcggccgagatcaccgtcgtgctcgcagacgactacccgaacttcagcatctgtggcatcccgtaccacgtctcgggcgacgtcgccgactggcacgacctggcccaccggacgcgctcagacctcgaagcgctcggtatcaccctgctcacgggacacaccgcccgccgcatcgacgtcgctgggcacacggtcgtcgcaaccgatgccgacggacgcgagatcagcctcggctacgaccgcctcgtcctcgccactggcgcgacgcccctccgcccaccgatcggcggactcgaccagctcggccacggggacggtgtccacgccgtccacgccatggaagaccttcacgcggtcatggcgagtctcgccacccgcgcaccgtcgcgagcggtcatcgtgggggccggctacatcggcctcgagatggccgaggcgctcacaacccgcggcatcgccgtgagcgtgctcgaagcgctcccccacgtcctaccgacgctcgacggacccctgggcgacgtcgtcgccgaggaactcgctacccacggcgtggcggtctacacctccacaacggcgaaggccatcacgacggaaggccgtcggctccgcgtccacgccacgtgggcacccgaggctgagcccagagcgctcgaactcgacgccgaactggtcctcgtcgtcaccggggtcgcccccgacaccgcactcgctcgcgcggccggcctcgagctcaccccgaggggcgcgatccgagtcgaccgaaccatgcgaaccaacgccccagacgtccttgcggccggggactgtgtcgtcacgtaccatgccctcctcggcgagacgtatctcccgctcggcacaacagcccacaagcaggggcgtatcgcgggcgagaacgcccttggcggcgatcgccacttcgccggcagtctcggcacccaggtcgtgaaggtcttcgacctcgtcgcagctcgtacgggcatccgcgacggcgaggccgagcgcgccggttttcgaccgcgcaccgtcgcgtcctctgccgacgatcacaaggcctactatccgggcgccacctccgtccgggttcgcatgacaggcgatctcctgagcgggcgcctcctcggtgtccagatggtcggggcactgaccagcgctgtccacaagcggatcgacaccgcagcagccgcgctcttcgccggcctcagcgtcgatgaactcggcgacctcgacctctcctacaccccgccgctcggcagtccgtgggacgtcctccaggtagccagccagcgctggatcagtgaagcacggcccgtcgacgacgcacactgaggcgtggacggcgcgactcacacaacgagcaggggccgtcgcggcgaactcgcgacggccaggctaaggggtctggcgagcgcgagactgccccatgtcgggtgagctcggggctgattccgccgaccgcgcacctaccagttcacgacccgacatgaagcgcgacacttcgactcgtgcgctagcgcaccccatcccgtcatcgcaccccgccgcgggcactctggtccccaccaggggccaccgaagcacacgagccctccccgggaccaccccgagccccatgggatcggcgcgcagactcctggctcccgactgcgctcgtgagcgtgcggctgcgacctgcacgtcgagcggcgctgtggtagcctgatgcttgccacgggagcccagtcgggctgagagggcggaagagccgccgaccgttggaacctgatccggctcgtaccggcggagggaggcagtatgaacaccattcctgtcgcgtcattgcggcgccgtcacgtcgacgaagcgccaaccgatcacgtcgtacaagctgcacacccgcagcagcgccgcgtggttcgtgaggctccgccactgccccatgacctctctggcgacgacgataccgtcctcgtccccttcttggaggtggcgaccgccgagggtcccgtcatcctgccgacgagcctgcccggtgccccactcggatcagacggcctaccacaggtccgggcacaggtcctccgccatcgctatggcgccaccgtgacccgtacgctgcctggggggccgctgcccaacggtgctcccgcccgtcccacgtacgccgccaaccagatcctgacgcagcggaccctcgcgcgccgcggatttggctcgtgggagctgcgcttcgtggcagcccgagagcaggtcacgctcgagcgcgtgctcgacgacgtcgcgagcgggcgggcggtcgtgccggcaaatcccaaccatccggaactcgaaccgacgatcatcggccggaactaccggaccaaggtgaacgtcaacctcggggcgtcgagcgtacgcgccgacatcgacgaagaactcgccaaggtcgcggtggcgctccagggtggcgccgacaccatcatggacctctccaccgggaccaagctcgcctgggtgcgcgagtggatcctgcgcaacagctcggttccggtgggcaccgtgccgatctacgaagcgctcgatcgcgtcggtggtcggcccgagcggctgagctggtcgctgttcgccgaggtgctcgaggagcaggcgctccagggggtcgactacgtcacggtgcacgccggcctgctccgcgactacgtgccgctcgcggcacgccggaccaccggtatcgtctcgcgcggcggctccctcatggccgcatggagtcagcatcaccaacgcgagaacttcttgttcgagcacttcgatgagctgcttgctatcgccggtcgctacgacctcacgctctcgctcggcgacggcctgcggcccggctccaccgcagatgccaacgacgaagctcagctggccgagctccgcacgctcggcgacctcgcacgacgagctggagaggtcggcgtccaggccatgatcgaagggccaggccacgtcccactccacaagatcgcggagaacgcactgctcgagcaagaactctgcgacgatgcgccgttctacaccctcggacccctcgcgatcgatgttgcggcggggtgggatcacgtctcatcggcgatcggagctgccgtgatcggagcgcacggggcagccatgctgtgctacgtcacgcccaaggagcacctcggcctcccgaacccggaggacgtgcgtgcggggctcatcgcctatcgcatcgccgcgcacgcagccgatctcgccaaggggatcaacggcgcacaggcgtgggacgatgccatgagccgagcccgctacgagtttcgctggaacgaccagtttgccctcgccatcgatcccgcaggagcgcaggcacaccacgacgaaagcctgccagcgcgcgcagccaaggatgccgagttctgctccatgtgtgggccgaacttctgcgcgatggcacactcgcatcgcgcgcttcacgacgcctgacggcaaccgagacagcgctgccgatcgacactcgttcgcgtcgcgatccgatcggcgcaccgcacagcacactcggcgacagtcggccatgcgtcgctgtggtcgatctcagccgagagcactcgcatctcgagccggacctgggtcgacgatggcgtcggaacgaccgacaatgcctcggcgacccggtaggggcatcgaccgagctgggcaccggaacctcggaccagcacgccaccgagacgaccagacgctcggtagcccggctcgggcgcgcctgtgctggtgcgtgagcgggcccgctcgcgacgtcatcgtcgggtgcgcaccagcatgcctgaagtctgcttctcccatcttgctacggtggagccgtgccaaggccacagaggacgtcgagctcccggtcgtcggaggggctcaccacgaatccagaagtgacgtgtcgcccatctcgcagctggtcgcgggggcaccacccctacgctggtctcacagccgtactggccaccaagcacgacaagctcccgctcatcgctcctccactggaagcagcgatcggtttgcaagtcgaagccgtccccgtcgacaccgacgtcctcggcacgttcactggcgatatccctcgccctggacctgcgctcgacaccgccatcgccaaggcgcgccttgggatgagagcagctggccgttccctcggccttgcgtctgagggcagcatcggccccgacccagccctcccgttcgtccatgccgatcgagagatcgtcgtcctcgtggacgacgagcacgggatcgtcgtgtgggagagccatgcgagctgggatatcgtcgccgcctcgacgaccgtccgccccgacgatgacctcgaaccgtttctgcgcgaggcgcacttcccggagcaccaggtcatcgtccgtccgaaccacggagtgctgcatccgatctacaagggcattgcctccctcgaccacctgacttcggccattgcagagtgtgctcgtgctgcgacagacggtttggcccgcgtcgagactgacctgcgggccaacgcgtgtccctcgcgtcggagcgcgatcgcagctgctgctcaacgccttgccgatcggatcgctgctcgctgtccgggctgcggcgcacctgggtgggggcgtgtcgacgtactcgtcggcatcccgtgcgcgtggtgtggcaccgaggtccccacaccacgcgccgagatcgacggctgcgtggcctgcgattgccgccagatgcgtcctctcgtcgcagccgagcatcgagccgacccgagcgaatgtcctgtgtgcaatccgtagtgaagaacgagagacggtagcggtcgtcacacagcgagcacggcggagcgcgtgaacgttggccacctcgcgcaccgacgcctgtccccttgaggacaggatcccagcgtcctcgagacgttcgacaatgctgatcaacgaggcccatggctgcttcgttctccctcaccagagggaacaccgctcgccgcgcgcgtgctcgtagatcgcgcttcgcctccggtcggtcaccaccagtcagcgagctcggtacgacataccgcagacaattgtcgacgccgttcgagaactgaacgatgtcaccggtgaacagtgaacagccgaccatggagggtgatcgctgtggaagactgggcactcgtcaggcggctggtagctgagggcgtccccaaggctcgcatcgccgagcgactggagttctcgcgcacgacggtcgtaaggctggccgcccggagcgagccgccgagctatcggcgagccccgaccgacagatcccttacgagcgtcgaggcccgggcgacggccccgctcttcgcagacgagcgtgacctcagccagttccgaacggatgcagcctcactggtcctcgaccagcgccgcgccatcgctgactgaggtgccccagaagttatagacacccaggttacttcatgcgagccccctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatgccgtgtcgggcacagaaggccacaactcgatggtcgctgaactgactccctcggtcggtgtgccagatgaccccctgcgcgttggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccgccgatgccgcccctggccatcgctgccgccaccgtgttgtggctcgtcaccacgccagcggctcagagtgccgccgtgatccgtcgtgcgccgtaggtgccagaggatgcctggtggaccgcgaccactcggtcctcgaggtcgcgtctcgcacatgcccgacgcgacggtgctacctgggtgcgtcgccatcggtcgtagccagcccgggagacctcgaggaagcgtgccatccgcttgatcttgaagcgagcgtactccgcctccatcagcgcgaatctctcttgcgtggtggcttcgcggcgaagtacgcggctgcttttcccaggaactcgttgtccttgcgcagctcctcgagctccctgcgcaacctgatgagctccgtgcgctcctgcgccgtgaggggcgggctgccagtggcgtttgctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggtgtaggcagcggccttcttttgacccgggatcagcggtgcgaactgacccacccgtggcacaactataggtggtagtggtgaggatcgtggtgctcggcgtcacctcccttcgccatggcctcggccgcctggggcaacagtccaccggggagccgctgcttggtccggtccttcaggcggtagctctcgcctcggatgttcaggaccgtggcgtggtgcagcaagcggtccaatatggccgtcgcgagcacctggtcccccaccagggtgccccactcgccaaagcccttgttcgaggtgcagatgatgctcccggtctcgtagcgagctgagatcacctcgaagaagattcccccggcctccgtcgaaagcgcccggtaaccgatctcgtcgatgacgagcactttgggggcgaggtacttgcgcagacgcctcgggctgcccatgccctcgaggtcggccaccatgcgggccatggtggtgaagtagacggagtgcccggcctcgagagccgacagggcgagccccaccgcgaggtgggtcttgcccaccccaggaggtccaaggaacaccacgttggtggcgttcgccacgaaggcgcacgaggcgagctcgttgacgagggcgcgatccaccccggcggcaaagtcgaagtcgaagtcgccaaggcccttgcgatggggcaggcccgagagcttgagcctcgtctcgtagctgcggtggcgacgctcgtcgcgttcggcaccgaggagggagatgaggaagtccacataggaggcctcgcgttgggtggcggcctcgatggcggccccgacgagctcggcgctgcggggaaggccgagctcgccaaggagtgcttcggcgacctcaagcatggctcagcgcctcgtaggcatccagcgagcgcacctcgaccgtggtgtcgacgagctggcgggctcgggggccacggagtgcgccagcgagctcggcgcgtgggatgccctggtactgctggggcaggtagaccaccgtgcgggtcttgaacccaagcgagtgggtggcgatcacccttcctgtctcgtcggtgatctcgagggtgcgccctctgggcagcacccacaccgtgcgcgtgacgtaggcgattggtactccgtagctgacgccgccgaaggagacgaagccatcgaggctcacccgacgagggcggcgcacgaaggcatcgagctcggcgcgtggcggcaggggacgtagggcctcgcgctcggcacggtcgaagacctccatgggcgtagcaccgaggctcggatgcagcctgtggtcgcgctcgaggctccagcgatgggcctgctcgttgaggtcggcgaggtcacggaagcggcgggctggccagaagtgctccttcgcgtagcggatggagcgctccaccttgcccttggtctcgggccgtcggacccgacacagcgagatcgagatcccgaggtagcgggcgagatcgagcagctgggggtggtactcgtagccgcttgcggcgtccccgccgagcacgacggtcttcatgtggtcggtgagcaccacgttcgtgagtcccccgaagtggcagaaggcctcgagcagcgcaccgatgaagccgtagctgtcggcgctcggggcgaaggtgacgaaggtgcgccgcgagtagccaagcgtcgccacgagccccgggatgcgtcgctcctcgcccctggcgtccacgtaggagaagatgccccagtccacctggagctggtggccaggcggggtctcgtagcggcggatggggacgggtttcggaggtgcggtgtggcggatggtgcgcacgtagtcgcgcacgatggtgaccttgccggtgtagccgagctcggcgatccgttccacgatggccggggccgaggtgagcccgtctgccaccagccggtcgatctcggccttgtaggggtccagcttggaaccccgtcgggggcgggtggccttccccgaggtgccggcgccgtcgcgcaggtagcgccggaccgtgttccgggagtggcccgtgcgccgcgcgatctcgcggtagccgtagccctcagcctgcagttcgaatagcctcatcaaagacctgcccttcagcatcgggttgcccccttcttctggacccttgagggcaacctaccctggagggtgggtcatttttgttccgctgctcgtgggtcagttctagcccgctgcctacatctggggcggctcagatgggaacgtgaccttcgtgggtttgctattcgtggcaagcgtcagacagccagcgctgtacttgcgttcaagcaccaaccggtcacatagcacctcatatcgcttggcatacgacgcacccgcgaagatcggatcaactggaaagtacggttccacgttgcgaacgggcgcatggactttcgcacagtcctccagcagaaagaagtacccgaggaaaggcgcgggatgcttaccgaatcgaccttcccggtatgccgtccaaatgtcctcggcgttgccgatggcttcttccgttcggttgttgaagttgttaccgaagctcggaccgacctgtgacttgaattccacagccacaaggagctggccgtcaacgaccaccagcaagtcccacttcctttccggtcggtaatagccgggcagctcgagcgccgtgcggaccctgacatggtcaggctcgagcccagcatcgacgagtacgtccgtgagcagcacttcgagcgcacccatctgcgctcctcccgtgaccgcaccccgggtgcctgcgcttccccccatttgcttgacagtctgaatgtaggccacggccacctcttcgcgggcccagatgagctcgtactcgacgggcggtaggtacccgaggctcgagtgcaggcggacggtgttgtagcgctgaatccagctagcgatggcagagcgggcctcgtcgaggttcgcgaagcggtagcgagccaccagctcgcgctcgcaagctcccgcagaaggcctcggccacggcgttgtcgtcgcgaggtcgcgaccctgcccaccgactggcgaagcccgagcgtcgcgcagagctggcgaaccttccgggagaggtactggttggcgcgatcgctgtggacgatcgccccagcgaggctgccccgagtcccgagtgctccgcagatcgcctcgaccatcaggtcatcgggcatgcgacgctggagcgaccagcccacgatgcgccttgagcgcgccctccttggccaccgtgcggatgcgcatgatcacactgcgatcgacctgccactggtccgcggcctcgatcaccgtcacctcctggcgcaccagctggaggaagatctcgtacttctgcagagtggtcaggaaccgcttcgcacggcgtccagcccggtcagttccacgggtctcctcggtcatcggaacatggtcttccactcgtcgtggagacccgcggatgctgcttgattcgtgggccgatccctatcgcgaagtcaggcgcaaaccaaggccgtgtggctccgtgtgatcctgggaagcaccgaatcccacacaacggagagagggcggcagataccgtcgtgccgtcatgacggcatagtggtaacatgaagccatggcaaagaaaaagacgaccgtctacctcgactccgatgtactcacggcgacgaaggctgcagcgctcacctccaagcggtcggagagcgcggtcatcgaggatgcgctgcggtcatatcttcggagcggccacggcgatgcggcacgagatgagctgcgggaactcctgaagcgtgtggccttggcaagcgaccttgacgaggatgcagcgctcgcgcaggcagtagacgaggtccgagcggttcgtcaggagcgtcattcgcgatcggtgcgtggtgggtgagctgcgtcgtgttgtcttcgacacaaatgtgttcgtggcggcggtcacctcacgagacggcgtgtgcgcccggctcctccttgctgcgacaagtgggcggtatcgcctcatcgtctctccgatgctgctcgacgagctttctgcggtgctcgtgcggccgaagttccggcgatacctgagcgtcgaggacgcgcgtcggttcgtggaggtgatccgggagctggcagacgtcgtggacgatcccccggaggaggatgatcccatcaccggtgatcccgacgacgacttcctcgtcctcctggcggaggtggcgggtgccgacgtgctggtgtctggagacccggacctcaccacggtgcagcgtccgggacttgtcgtgaggacgccccgggcgttcctggaggacctggagcagccgatctgacggcggacatccccggcagggctcagtgagccccaccgggaacgagcccgggcgctatgccgccggggctgctggagcgctcttccgggagagcgcttggagtcggttggcgacgatctcgacagtgcgtcgagtgctggcgtcggtggcgtgccactggcgtgagttaagcctgccagccacgtacacgagccgacccttcgtcaggtatcgggtcgcaaactcggccgcctgaccccagagcacgacgtcgaagaagcccgaatgataccctgcctgcacggcgatccgtacggtcgtgacgtgcttcccggaaggagtctcccgaagatcaggggatgagatgaggcggccgatgagggtcacctggttcacggactctccccggctctggcgggatgccgccattgcggcggtcatcgtggtggttgtgttactgcgcattgctgcacctcttgttgtgtggatcgatgccacggtgacaagcgggcagactgccgagcggaattggccattaagccggtacggcttctcgctcttgggccttgcagcggacaggcaggggtctgctatcggggatgctcgcgtcccgtatggcgttcgtagacgatccagaagggtccagaaactccctgccaccgccttgacctgccaggatggagtcggcgaggctgctcagcgtagtgccctcctgtagacctcggatggaggtggagggcaccagcccctgcacgtacgcagctgactccgtcagcggcgagttctcggagcgtcaagggcagcgctcgatcgctgccaggcgctctgttgccgttgagcgcggctacgagcatccgagcactataggcaccgccgaagcaggtgactcgctggcaccttgtctgcaggaggagcatcctccttgggcgtgacaacttccgctggggcggtgatgccgtccacccccaaaggagatgcggaagaagcacaagatgatcgacacgagattgatcagggcactgcgtacgcatgccctgtgcatgcacacgcagggatccctacgagggcgacatcggcaagcccgccgctgcgcaaccgcagctcaccggcgacgtcgcgctgcgcacaccctgcatcggcatgcgtacgtagcgctgagcaggtcccgagaaatccacccgagaaactcgcccctcggacgagcgccggaatgacaaaccgctggccagacacctgcacccctgcacgaggtgcgtgcttgaccagcggtcatagtggcgggggcaggatttgaacctgcgaccttcgggttatgagcccgacgagctacctggctgctccaccccgcggcgtggagaacagtgtagcggcgctccctctaccccgccgccttgccggtcacgctcgcggccttgagctccgacaggatctgaccgatctgctcgatgtcgctctggtaggccccgaggttgccggacttcaaggcggcttgcgcctcactgtagagctgatcggccttggcgagcagcccggcggctgaactcggaacggtagccgtcgtcgacgtgcgcgacgaaccctgcacgcccgacggcacgacgccgaagatgtcgcgcaggacacccgcgaacgtcggctccatcgcaacctgcgtcccgtacacgccgatcacttccttgatctcaggcagcggattcgcctggctcgagacgtacatcgggcgaacccacaggaggttctgaccgagcggtagcgccgtgaggcccccgagcgacacgttcgagccgtgctggtcgagcagcgtgatctcctgagacacattggtcgcagacacgatgcgcgacgcaaccaatgcggggccgtcgatctggcccgaactcggagtcgtcaacgccacgagctgcgtcggatcggacgccgacgcctcgccaaagagcaggccggtcaggttctgctgcccgccgctctgcgagaacggcacgaatgcctccatcagtgccagctgcggcgaggaggtgccgggcacctttgccatctcgtagatcgggctcatcaggttttggctcgtgccgccgaagctgaacgagcttcccgacgagatcgagccgttctgcggctgtgccgacagcgaccacgcgttgccacccgagtagaacgtcgacggattcgtcacgtggtagatgccgtacatcgccgactgcacggcgaggagatcactcgggtagcggaggtgactcgcgatcgcggctggcatcgccgagaccggctggaagacatggggaaacgccgcctcgtaggcctggatgatcggatccgaggggtcggtgacatagaagtgcatggcaccggtgtaggcgttcacgaccaccttcaccgagttgcgaacgtagttgaacgacgtgttggcaagcggtgcgctcgacgacagcgcctgcgtgttggcctgctccgaataggggaagttcgctgtggtggtgtagccgttgatgacccagtcgatgtggccgtcgacgatcaccggatagggattcgacccgtagtgcaacaccggcatggccatctcgacgcgctggaggagatcgcgctcgaacatgatgcgcgagtgggtggtcagcaggctcgacaccaggatgttgatgtcgccgaagcgcatcgcaaatgccgcacgcacgagcagcgacgagagtcggacaccgcccgagccggcgtagtgggtctccgacgacgccccatcggggagctggtagtcgatctccgcttggcggctgtcagcgatcacgtagcccgagagaccttggccgtagtagacctgcggctgcgtgagcgtcggagcaccgcccgacgaggtcggcggaagatcacggatcaagaagatggggttgcccgcggccgagatctcgttcgccggtgccagcgcgacaccgtaaccatgcgtgaactgcagatgctggttgacccaggactgggctggaaggttcgctgcgttcagctctcgaacgccgatgatgaccggtgtgggcttgccgttgatcgtgtcgttctcgatcgagagcgaggggaactggtagtacgagcgaatggcctggagcttgccgaaggtctgctggggcgtcgaggttccccagagccgcgccgcgccaagggagtccaggttcgcctgctccaccgacgaactcgtattcgcggtcgcagaatagggctctgagggaacatcggcgatgtcgtaggcgtagcgcgtcgcagcgatgttgcgcgcgatgtagggaagctccttctgaccctgggcgggatccaccacgaacttctggatgatggccggatagatcgctcccagcacgatcgagatgaacgcccacaggcccagcccgatgaccggcaacacccaaccctgacggaagatgttgatgacgaacaggacgcaggccaccgcggagatgaagatcagcagattgatcgcggggagctgggcgtggacgtcggtgtagctcgctccctcgacgaagcccctggtcgagaagtccaactggtaacgctggaagtagtaaccaatggccttgatgagggccatcactgcgagcaggaccgacaggtgggccttcatcgagggtgcgacccgctgctctcggcgctggggctggatcgatccggtcaggtacccgacgaccgcggtgagcacgaacgtgaaggccgcagcaaggaagaaccacgagatcaggaactcgatgaacgggagtcgaaagacgtagaacccaacgttgacgtgaaattcggggtctcgcatcgggaaggactcgctgtggccgaagagcagccagttcttccattcggcaggtgcttgggaggcgacgatgagcgtcgtcaccacggcgagcacgacgggcagcacccaccgacgacggttggcgaaggcgcgatagcgctgcaccagttcgtcgtcgtggtcggccggttggcgcaggccctggcgttgcgcgacgaccatgctggtgagcgcccctgcgaggtagatcgccgcgaacacgacccacagctcgaccttggcgagcaggaccccgctccacacctcgccgaggtgatagttcgagaaccagaggtaatccgtgaagaagacggcgagacccttgagcgacagcagcaacacgatcgcgatgacgaccacgccgacgaggatgagctgcgcccgtgatggtccgcgacgctcccgggtcatgtcctgggggacgcgcataccatcacgagcctaggcgaagaccggcacaacgaggcaccggcacccgggatgcgctggcggtctctcatgacctgttgggaaagcctcgtcagcagcgacgacctcggcgagtgcgttgtcctcgcagtcggggcaggcacgacgcgtcgggtcgaggagccagcggtaccctcgcggcgcaccgacgctccgcacgcccgcgaagaaggcatcggtggcggcgtcgtgcgcaacctcatcgagtcgaccggctcgaagctcgcggtggattgcaccgacccgctgcgcgagctcctccggctcgccaccatcctccatcgtgcgcacgagcatcgcgagcacttcgtcgtcgagacgagcgacgagccgtgcaagtgcgtcagcgacgacgccatctgtgccctggtggtgcggcgcgacgatgccgccgagaccctcggcgaactcgaccccagccgccacgttccgttggatatggagttcgcagctcgcgcgcaacacggacgggtcggcccgcagctcgacgagacgagcggtgacctcctcgggatcgcgctggcgcaagtcggcaagcacctcgttgatgaggtcccccacgacgcgcttgacccggcgcgcaagatcgaccccgcgcggctctgcgagctcgagatagcgccggtacaacgatggtggacacgtattggcatcgtcacgatcgggctcgacgtcgccaactcgccccgcatcgccatcgtcggcctcagcgccgaggaccgcggactcgccacggtcgtggttcgtgtcgccaccacgctcgtcgacctcgtcaagttcgagcgtgtcgtcaccgtcatcgcgcacggccaagggctcgcgctgggcccgatcaggggacacgacctcgccggcgccagccaccgcctcgctgggagtgacgacatctgcagtgatggcgaccgcaccaccagcgtccgcgaggctcgagaacaagtgctcgaggcgctcgagacgctctcgtgcaaccgccgaccgatggctgggggagtcgtcgaccggcttacgtgcaccctcgccgagagcctcgctcgagggctccgagtccggtgacgttgcgtccgatggcgtcgcacctgggagatccgtgtccagaagtgcctcgtcgtgcggtgcaccgtcagccagtgcggtgtcccggagctccgtgtccgctgacaccgagacggccggctcctcgtctcgcgacgcctcgacgctctcgggcccctcgtgctcgtcggctcgagccgcacgtggccccccctcgtcccgtgaggcggtcgccaccgcatcgacctcaccggtcgtcgcaacgcgaggagcgagcacgtccgaggcgagtgagccggatggcccctcgacgacccggaccccactcgccggcgcaccctccccagcgagcgccgccgaaggagccggggcaccaacagggtcggcatcggaggcggtgctcgtcgcgtcgtgggcctcgtcggcgatcatccgaatgagcgacgtcacctcggcaagatcgaggtccggtcgcgcgagacgctcggcgacctcgctcaggtcggaggacgaacgctcgcgcgtgtctgcgacgtccgtcgacggatcgatcggcgtggtggtctcggccccgtcgctcggaggactcggaggctccgcgactgcgctactcggtccggcgatctcacgccgttcgacgaccgacggctctgcatcaaccccatgacgccgcgttcgccgctccaccgcgtcgacctggaccagcgcctctgtcgcaaccgttcgcacctgctcgagcagctggcgcagcgaaaggcgagtgaggtcgagattcgcaagttcttcgcgccgctcggccaccttggcctcggcgtcggcgaggagcttacgggcgtgctcgttggcgcgcagcaccagcgatcgcccctcttgcttcgcgctctccacggtggtctgggcagtccgatccgccattcgcgtgagctcactcgcctgagcgcgaacctgctcgaggtaggcctccgcagcctgccgcgcctcgccgagggcggcctcggccgcatgacgtgcctcgtcttcgatgcgctgcgcctcgcgtcgtgcacgctcgaggaggtcggcagcctgggcttctgcccgacgacgcagtgctgcggcggcctcggtcgcgctccgcaagacgtcggcagcttcgcgaccgacgagctgggcagcgcggtcggggtcttggagcgcgccgtcgagctcgttcttgaccttgagtgcctcggctcgcgcctcgtcgcgctcgagttcgcgcttggctccctcgcgacgagactcctccagcgcatcgcgcaggcgggcgacctcgtcgcgaagttctgagagcgtcgaccgaacgcggtcacggtcgaaaccgcgccgcacgaccgggaactcttcgtctggctcatctcccgagcgccacatcgctcctcctaccgagcgctgtgcgccgccgcctccggccggagccggtcgaggagctggagggctccacgcaaggtggcagctgcaagcacgcgcattctccccgccgcgtcggccctcgcctgcacgatttgcgatgttgcgacgatgaccgtctggatgccggcaactctagccgcgaggagacgctggcgaagtccggacacggccacgagtgccccgctcggatcgatcccggcgagcgcggcgatcggctggcgcggggcgcgggcgagcagcgcaggacgaagttcgtcggcgatcgccaggcccaccgccagccctgacgacgccgtgtcggcgtcgggcaggcgcagctcgagatgcaccggcgtgatggcggcggtcgcaggtgaggtcacgagtccgagttccccggcgaccgagggcaccgtcaccgacgagacgaaccgcgagagtcctgaggccgtcgaacgcaccaacgacaaggtcacacgcgtgtgggtgacggccgcggcgacggcgctggcgaacgctgctggcgtcggcacgggaacgccgtcgaccccgaccacgagatcgccagcgtgcacgacaccccggagcggagacgtcgggagcacaccacgcaccacctggccctccatcgactcgacccgaacgccgactgctcgacaggccgcgaccagcgcagcgatctccgactgctgcgatgcgctgagcacggctggatcgccagaacgtgcccccacgatctcggggaccaccgattcggcggggtcgaagcttgcgatcagccaaccaagtggcgagagcggtcgcgcggtcgtggtcgcgctcgcgatgtccagcgtggcgggcggccgccccgccacgcgcacgagcggcgcgatcgccacggtcgcacccggcgcaagggccacctcaccgatgcgtccgaacaccccccacccgagcaggaggagcagccatccgacgacccacagcttcgccccggcaacgacggcgtcgctcatcctcctctgacgcacgaggggagcctacgagttccgaggccgaaccaatctgtaatgatgattacactcatgagcagaccgaaggaggctctcatgacaacatggctttctcgcgccgaagccgcgtcagaactcgtggcggcgagcgcactgctgttcgaggcggaggtgatgtcgcgctccggtcacggcaatctctcctgccgcatcggcgacgacacgatcctcatgacctcgtcgggatcgatccgcaacctcgatccttcgacgctggccgtcgtcggactcgacggcaccgttcgcgaaggggcgatcgcgccggagaacgccgagatcatcgagatgcacacacaggtctaccggcttcgccccgagctcggtgcgatcatccacacccattcaccgaacctcacggccttcgcctatgcccatgagccgctgcccattcgctccgagcccatgcttcggttcggccaggcggtcgcggttcccgtagcgccctgggcgcctcgcggatcacacgagtcggtgggcgggatcgtcgaagcactgcggaacgccccagagagtcaggcggtgctcctcgccaatcacgggttgctggctctcggtgccgcaccaacggcggtggctcgcctcatcgtcgccctcgaggaagcggcgacggaggagcgcttcgcggcagccctcggtggcgccaaggactttcccgccgatgcgctcgccaaggtccaagcctcgatggcgagggtacggtgagcacgtccgaccgcttctcgtcgattcgtgacgggtatctgcggttcttcggctcggtccccgcgtcgttcgaggagcgggcgcgggtggcgcgtctcgttggtcgagaggcgaccctggaggccgcagaggccctccgagccgccgcgatctacgacaatccgctcgggccgcgcctgcagcagctcgtccacttcggccagctcctcgtgctcggcgaggagggccctgcggcgctgcacgcccgcaccgcggttcgccacggcgcaacgatggccgatctcgtgggcgtcgtcgagactgcgctcatcacggccggcgtccccgcctatgcgctcgggatgcgcgtgctcgcagcactcgatcatgtcgacgagtccgacacaccctgaactcggcgcgggctggctgctcggagcagtccaccgacacatccgttcgcgctgggcggagcggattcgtgcctacgacgtcacgccaccgcaggctgcggcgcttcgtgccctcgcgagcgccccaggactgtcgctgcgggagctcgcgcgacagatcgaagcagagccgatcaacctgtcgcgcacgctcgaacctctcgaggaacgtggcctcgtgtgtcgcgagccgagacccaacgatcggcgcgctcacgcgctcgtgctcaccccacgaggcctggacctggccgcctcgctgaccgcggccgcggccgagttcgagcacgagctggccacgctcctcgacccaggcttcgaccagacggtggcgtggctccatcgcgccctcgccaccttgcgcacgtccgagccgtcgcagccaggctgacccgcacggcctggcgtacccgaggcgcacacgacacgtctaccatctcgacgacggcacccgacgggaggcacccatggcacgactcgagatcgacgcagggtgcgctcgctgcgctcgggccggcacgcacgcccaacatctcgctggcccgatggacgtcgtcgagcgacccggactcgacgccgtgcgctacgtcgacgatgagggccgagccttcgcaggcttcgacgccatcgtcgccgtgctcgccggtcgctggccacggttcgctcgggtcggcacgatccgctgggtgcgggccaccgggacggtggcctaccgagcggtggcgcacgtccaccgcgtgggagatcgacccgacagctcccagcacgagggctccgagcgcccgccgcgaggctaggtcatccgcgagaaccgacggatcgcgatcggcgccgccacgatgacgaaccccacggcgaccgcgagcgatccgaggagcgaggcgccgaggctcacaccgaccagggcgcgggctcccgagccgacgatctcgaggcgagccgcgtccatgaccagcgagaccggctggtagcgcgcgaacccctggagccaacccggcagggtctggatcgggacgaacgcactcgagacgaacgtgaggggaaagagcacgggaaagctcatgagctgggccgcctccgcactcggagcgtagagacccacgatggcgaacaaccaggacagggcgtagctgaacgccaacacgacgaccaatccgaccacgaggccgacgagatgatgcggacggaatcccacggcaagtccgacgacgacgacgatgacggcggtcgcgaggttgcgtacgaggtcggcggccgtacggcccagcaggaccgcagcacgcgagatcggcagggcgcgaaagcgctccatgatgcccgacgcgaggtcttcggcgagcccgacgctggtggccgctgcgccgaagatgatcgtctggaccaagatccccggcatcaaaaagtcgacgtaggggaccccgagtcgagccgtgatcaccccgagcgacccgccgaagacgtagcgaaacagcaggacgaacatgaccggctggatgaacgagaagaacagcgactgtgggacgcgcaggtagccacggagcacccggcctgcgagtacccatgcgtcggcgatcacgctcccgccacgttcgtgtgcgatcacggcgctgctcatgccgccccctcggtactcagctgcccgttggtgatcgcgagaaacacgtcgtcgagcgttggttcgcgtatcaccatgccctcgatcgcgaccccggcgccgtcgagcgcacgcagcgcgatcatcgctgcctgcgcaccgttctcgacgccgagctcgaccacgcggccatcgacgcgcggatcgggaaacccggccgcccgcagcgcctcgacgaccatgggcggcggctccgcggcgagccgcacctcgaccaccgtcgccccgaggcgagccttcagggaggctggcgttccctcggccacgatgcggccgtggtcgacgatgacgagtcgctccgccagtcgatcggcctcctccaggtactgcgtggtgagcagcacggtggtcccgctcgctgcgagatccgccacgatcgcccagagcgcgaggcgactctccgggtcgaggccggtcgtgggctcgtcgaggaacagcaccggcggctcagcgaccagtgctgcggcaaggtcgagccgacggcgcatgccgcccgagtaggtccgcagggggcggtctgcggcccctgcgagaccgaaggcctcgagcagcgaccccgcacgctccctggctcgacgccgaccgaggtggcagagccgaccgaccatctcgagattctcacgagcgctcaggcgtgggtcgaccgcagcgaactggccagcaagcccgatgcggcgacgaacgacgtccggctcgccaatgagatcggcgcccgcgacgatggcacgtccgccgtcggggacgagcaccgtcgtgaggatgcgtaccagcgtcgtcttgcccgcaccgttgggtccgaggagaccgaacacctcgccgtgggcgacgctcaagctgacgccggcgagcgcgacgagatcgccgaagcgcttcgtgaggtcgtgcgcctcgatggcgagtggttccatcccggtcaacctactcgctgtcgagatctggcgcgtcgctcagtgtgacggcagcagatcgccgatctcggctcgctcggcgatcagctcgtcgcgcgtcacggcgatccgagccgcgagcggttctggcacatcgagtccctccacgacgtgtacccgctcaccgtcggagcggaccgggaaaccgaagaagagcccctcggggatgccgtactcaccggcggacaccacaccgagcgcttcccagtcgtcggctgcgctcggatggatcaccgagcgaaccgagtcgatcacggcgttggctgcgctcgcggcgctcgaggcaccacgcgccttgatgatggccgccccccgctgctggaccgtcgggatgaagtgctcgtcgaaccatgccgcgtcgtcgatcacttcggtggccggcttgcccccgatacgcgcgtgccagtagtcgggcacctgggttgcggagtggttgccccagatcgcgaccgtgcgcacctcgtcgagcgcaacgcctgctcgctgcgcgagttgggtacgagctcggttctgatcgagcctcgtcatcgagaaccaccgctccgcggggatctctcgggcgttctcgcgtgcgatcagcgcgttcgtgttgcacgggttgcccaccacgagcacccggacatcagaggccgcgtgctcggcgagcgctcgaccctgaggacgaaagatcgcaccgttgacgccgaggaggtcgcggcgctccatgccagccttgcgcggcaccgagccgatgagcagggcccagttcacgccgtcgaaaccacgtgcgagatcggtggtgagttccatccgacggagcaacgggaacgcacagtcgtcgagctccatcgcaacgccctcgagagctgccatcgccggctcgatctcgatgagcgacagctcgatgggcgtttcgggcccgaagacgtcgcccgcagccagccggaacagcagcgaataggcgatctgaccagcggcgccggtgacggcgacacgaacgggtgtggtcatggtgctccttccatcatccccccgtcttctcgtccccccgacgaatgcgctccgcgacggcgtggccgaactcgctggtcgagaccttggtcgcgccatcgcgcaaccgtgcgaagtcgtaggtcacgatgccctcggcgatggtccgctcgagcgcatcgacgatggcgtcggcgacgtcattccagcccaggtactcgaacatcagcacgccggacaggatgaccgaacccggattcaccatgtccttgccggcatacttcggggccgtaccatgggtcgcctcgaagatcccgtgaccggtgacgtagttgatgttgccgcccggtgcgatgccgatgcctccgacctgggcggccagcgcgtccgagaggtaatcgccgttcaggttcgtcgtcgcgatgacgtcgtagtcccgaggccgcgtgagcacctgctggaaggcgttgtcggcgatcgcatccttgacgagcagcttgtcgccgggatcaccaccacagtcgtcccagccaacggcgacgtccgcgaactcctcacgcacgagctcgtacccccacgcacggaacgcaccctcggtgaacttctggatgttgcccttgtggacgagcgtcaccgagcggcggtggtgatcgagggcgtagcgaatggcagctcggatgagccgcttggacccatgggccgacacgggcttgatcccgatccctgcatcggcgccgagctcccacccgaagcgctcggcgaggaactcgcgcagcgcacgggcctcctccgaaccagcctggacctcgaggccagcgtagacgtcctcggtgttctcgcgaaagatcaccatgtccacccactccggatggcgcaccggcgacggcacgccctcgaaccagcgcacgggccgcaggcagacgtagagatcgagcagctgacgcagggcgacgttcagcgaacggatgccgccaccgaccggggtcgtgagcgggcccttgatcccgacgagatactcacgaaacaccgacagcgtctcgtccggcagccacgacccggtctcgcggaaggccttctcgccagcgagcacctcgcgccactcgacgcgacgcccatgggccgcgagtgccgcatcgaagaccgtcctcgcggcgggccagatgtccaccccggttccatcgccctcgatgtaggggatgatgacctcatcgccgacgatcagccgaccgtcggctcccatgcgcaccggagttgccacgggctcatcctatcccaccgtctcaaagcgccccagtcaggcctccggatcctgcctcgagccgccacgtgcaagacgatccgcccagcgctccacgtcggcaagctcgtcggcgttcgggaaggcgtcggggtccgccagcgcggcgccgacgagctcggctcgatcctcccgcaccaacagctggccggcgaagcgctgactcgcggcctccaccgccgcgaggtccatgccgaacaggttcgcgagcgccagcgtcgccggctcctgctcgcgccgatccgccaggctctcgatccagcccgcacgcccaaagaggcggggccgtagctcctccagcgccgctcgcgcgacgcccagcacgaagctggcggtcgtcgcgagttcgcgaaggttggcttggcgtgccgggctctcctcggcctcgaagaggccctcgagcccgaagcctccgagctcaccgagtcctgcgatgcccccgcgctcgaggagcctacgacccatcgcctcggcatcagcacgcaggtcgaggaggaacaaccgcagctcgacgtcgagacggtcggcgacgttcggcgaggcgatgagcggtccgcggaccgcatcctcgagcaccacccagaggccgacctccgcggcgggtgccccgagttcggcggcgactcgtccgatcgccgctggcgcgaccgtcgcgccagcgtggagggatcgtggcagtacgagctccgtccccgacagcgacgccatcgcgaagtgcccaaggaccgagccgagctgtgcattgaccatcatcggaccagcttgggctgcgagggtcgcgaacaagcgccccatctcgggatccatcgcgtcggtgaactggggctcggtgacgaccgtgccaccgagagcacgctcgaacaacacgaggtactcgcgcagctcaccgacgagctcggtgtacaggtcgcgtgggtggagggtgcgcacgccgatctcgacctcgcccacgacacgcaccgcgagcgccgactcgggaaggtaacgagacgcgatcggaccgagctcctcgaacggcgcgcgttccgtggcgccgagcgcgtcggctccggagagcgcgagctgggcaaactcgtcgcgcacccgtgacggatccgacccctgggcgctcatggcacgcgcgaggtcccgcagtaggaactcgaacgggttctggggctcctcatcgctcgccatcgctcctcctcgacgtgcctgccgcacccaatgtcgtggcacccacgcagcaccccaccctattcgccccgggaagcggacgaggagtcctacgatggaccaggtgagccacctcgaggctacggtgcgcgtcggccacgacgcccggctggtcacctggtaccgctggagcccgacggcgacgtgggtggtgatcgtcgagcccggcgcgacccatgactacctcgtcccggtgatcgaccagctgggtgcagccacctacgacccgatcggcaacgggcgctcgcgtcaccttccgcccgatgcgatcggccgcatcgggcgcaacctcgccgcggacgaactcgcagcgatcctcgaggcgctcccgggccccaggcgactcgtcagccaccacagtgcgtgcatcgccgcactcgacatcctcgccctcgtgccggagctcctgagtgagatggtgctcgtcgctccacgtctcgggcctccgcccgcacggctcgaccccttcgcgacggagcatgcctcgtcgccgtggcacgacgcgacccgcgcctggatctcggccgacccgcgaccgctcgagcactggcgcaccgaggtggcaccctcggttcgcgacgcgctccgggtcccggcgtcgacgagcaccgtcgcggtgcgcgcgctcgtcgacgccgacgacacggaggcccgtaccctcgccgagaccctcggagttcccacggaggtcttccccggacgcgatctcgcgctcgccgactcgtctcggttggtagccgcccttgctcgctgagtgttcgcgcagaatccggcgctgctcgcaagctgtgcagcctcgggcatctagcctggaagcacacctcggtcgagtcgtcgcgcgacaacccgcgagtcgacgacgaggtgcgtcatccaccgggcaatggggccagaggtgcgaggaggcatggtggtaagcgggtcgtgggagtcgacgacagccaccacgtggcttcgccttgagggcgctcccatcgatgaagccgcggtcgcgacgttctgccggcggccctccgtgggcgcggtggtcaccttcgctggcacggtgcgcgatcagggcgagggcctcagcggtatcatcgccctgcactacgaggtcgccctcgaactcgccgccgcacgcctcgatgcgatcgcagcacgtgccttcagcgacgctcccgagctccaagcgctcgcggtccaccatcgtctcggacgcgtgccgctcggcgagcccgccgtcgtcgtcgccgcagccgccgcccatcgcgacctcgccttcgacgcggcacgcttcgtcatcgacgccgtgaaggtggcggttcccctcgtcaagcaggaactcaccgaggtcggcgcacgatgggccccgagcgccacgcccctcgaagacttccccacacagaaggatgtgacgtcatgatcgagctgctctacatcgccatccccatcgcgctcgtggtcatcgtcgcggtcgtctccagcatgcgcgagcaccgtccccatgacgtgcgctcgagcgtctccacgttcgagcacgcccgtcaggcgctcgagcgccgcaccaccctcgacgcgagggagcgccccctccgtgagcgtggatctcggggtgcacccgagtgagccgtatcgccctcgatctcggtacggcgacgacgcgcctcgcgatcggtgccgagccgccgcacgcgctggagagccttgcggccatcgacgtcgagcgaggcgacgtcatcgccgttggcagcgcagcacgcgccgtggtattgcgtgagggcggtcgcacgtcgctggtgcacgtcgtcgacgctggcgtcccggtcggcccgcaggtgctcgccggcttcctcaagcgcacgctacgcgaggtcggcctccgctccctcgggcacggcgaagtcgtcatgtcgatgagcgaactcgccacgagcgtcgagcgccgcatggctgcgcgcctcatcgaccgcctcggtgcgtccgccgtgacgctcgtaccgccgtcactgagcgtactgcgcgccgtcggcgccgatccagagttcggctcgttcgccatggtggtcggggaagcctacaccgaagcaggcatcgcggcgatgggcagcctttgcgcgagtgctgcgagcaaggacggtgttcgcgatctgcgaagggccatcagagagtacctctggagcaatcacgagctcgccatcagcgacgagaccgcctccgaggtgctcacccaactgtgcgatgtgtctcgccccacccagagcgcccgtgcccgcatctggggacgacgccgaaccgacgcagagagtaccaacgtcatcgtcgatgcgagtgcgctggtcgccgcgatgactccgacgctgcgctcgatcgaacagctcgccaacaccgcgctcgcgcgggcgcatgcccagctcgtcgccgacatcgccgaacggggcctcgtcctcgctgggggcggcagctacgtaccgggcctcgccgcacgtctggcgaacgcgctcaagatccccgtgacggtcgctgacgagccactggacgccgtgcttcggggtctacgcaccagcgcgcgactccctcggcgtcgttcgcccgcgccctcctaaggggcgcacctgacgcacgcacctcggcacgctgccaagtgccctgcttgcaagaccccgtcgcacggtgctgacgccgctgcaccgctctcgcgccgagtccccgcggtccaaggtccggcgcaccgacgagccccgcgtgctcgcgtcggtgagcccatctgcgcaatgctcggcagcgacgagtcgcacgacacgccgacccggtggattcgacccgaagggccgagccgcccagcgacccaccggagccgacggctcgcccggcatgcaccacgtcgccctcgccagaggtgacaggtcgctcggtcggtaagtccacgccgatggcccggcggatcgatcgtacgttctcactctccgtgaagtttcttctctcagtggtcgatactcctcctgtacgcaccgatgacgggtcgcacgggccctggaaccggcgatcaaggaggagctatgcgtcgccacggatgggtagcaacagtcgtcgccagcgccgcgctcgcgctcggcatcgtggccactccggaagtcgcctaccgcacgccagctgcaccccggccgcagacccgagcagcgctcgcagcccccatcgtcggggtggccgccgacccaagcggccaaggctactgggaggtcggcgccgacggcggcatcttcaacttcggcggcgcgcccttcgatggcaacacctacaccttgggactcacgggtctcggtgggtcacgtccgctcgcagctcccatcgtcgggatggccgcaacccccgacggcaagggctattggctggtggcggccgacggcggggtgttcagcttcggagatgctggcttctacggcaacacctacaccttggggctcacgggactcggtgggtctcgtccgctcgctgctcccatcgtcgggatcgtgcccacccccgacggcaagggctattggctggtggccaaggacgggggcgtcttcagcttcggagacgccggcttctacggcaacacctacaccttggggctcaccggtctcggtggctctcgtccgctcgcagccccggtcgtcgggatggccacaacccccgacggcaagggctattggctggtggcggccgacggcggggtgttcagcttcggagatgctggcttctacggcaacacctacaccttggggctcacgggactcggtgggtctcgtccgctcgcagctcccgtcgtcgggatcgacccgagccctaccggtgccggctacaccttggtcgcggccgacggcggggtgttcaccttcggggacgcgagcttcgacggcaccacctactcgatgggctacacgggacttggggggtcacacccgctccctggcgccatcgtgggggcggccgaggcccccggggacaccgggtactggatgaccagcgcgagcggctccatcttcgccttcggatcggcaccgttcgacggggacacctcgactatcggcctgacaccgaccgtccagaacgccctcgccaaccccagcacgaacctggccccaaccttcgacgcggcctgcttcgagcagttcctcgcgagcggaacggttgggtcgaccgcctgtgatcaagacgccatcgccgccatcgatcaagcccacagcgacgagggcctcccgccgctgtcgctcccgtccaacttctacgcgctcacgaacgccgagcagctcttcgtgctcgtgaacgaggaacggatccagcgaggcctcccggcgctctatgggctggcaggcaccttgaacgccgacgcgaccgccggtgcccagtccaacagcgaccccggctttgcgttcacgcagtcgtggccatggcttccggacgcggggagcaactgggcaggcgactatgcgccagcggcgagcatgttcgattggatgtacaacgacggttggggcggatcccaggccgcgacctcgaacatcgactgcacatccgcaacggcacccgggtgctgggggcaccgtgccaacatcttgatcaccgttccccaaggcgccgtcggcgtgatgggagccgcgagcatccccgagagcacactgggtgcgagtggctcccccttcgaatcggacaccatggtggtcggattcgtcccagcagcgtccgtctcgggcctaacctacacctacacctggtccgaggccgtccaagccggagccgatccgcagccgtaggccaagcccagctttcgaactcaaaggcgacggcgactcgctggccgccgtcaatcgcaggacctccagcaagtccggattaccagagacatgacgagtatcattcggataccaggaatggtacatcacgaaccgaatggtacatcacgaaccgaaacgagctgacctagtgcaaacaccgagcccgggcatcgatcccttaggagccctcacggcatcgatatacgactcgcctcggctctacgccttcctcatcggaagcggggtgtcgaccggagccagacagccaagcgcgtgggaaatcctagaccagctaatagcgcagtatgcgtcagcaaccagtaccgatgtgcgcgcgcttggtctaacaccaaccgaatggtggcagcgcactttcgaatctgacgcggaatacagctcagtcctggagcgactcgaacccacaagaggaggccgccagcaacgcctcgagaaactcttcatctcaagctcgccttccgacgcccacaggcacttggccaagctatgttcgattggacacgtgcaggtgatcatgactaccaacttcgatcgcctgatcgaggacgcactaactgagcaggccgtccgattccatgtggtcgatcacaacaatgtcaagggaatgcaaccccttgtgcgcggtgccgtcacagtaattaaactcaatggcgactatgccgatctttacatgaaaaatacgagaatggcactgtctcactacacgcgaccatttacgaccctaataaagcgagttttgcaagaatatgggctcgtggttgttgggtggtcgggtcggtgggatgaagggttgcgaaagctgattgagagcaacagcgcacgcctctaccctatgtactgggtcgcacatcatggtcagctacatgacgaggcacagcggttgcttgatcagcgtggtgcttacaggattgactcacacggagctgacgacttcttcggccggctagccacaggactggagcgtctcagtcaactagcatacacacgtgccaggcctataagagccttacgaggcggccgagtattcaccattagtagtaattggagtccagtttcatcgccaagcacccaaagcggcaagttgtggattcgcactgccgtcacactcatgccagcctcgcagcagggagtcggttatgtcgatgccgccgaaatgtggggatacattgacactccagaaagaagagcgatccggaccgaacttgccgccgcgcgggccgcgtatgacattgccagtcttgttactgtcggccagctaaattctgggcttccggtcgacatgctgaatcaacaaatggaatggcacctttcgaagactgaccagctagatcgagattctgtttacttcgaacttgacgctccgaagagtgactactgtacttgttcggcgcggtgtcgcgtttatcttgggcccgggcgccctgagcaacagggcagcgcaatcatagacatcggcataggcgatctcaaggaccgctccaatcgacagcgaaagcttgctttaggagagctcgcgatcatttggttggaccagctcgacgctgcgattcgaattctaaccgatgcacttagcagtgctacaggtgggatggcaatgattgatacagtggaattccacctagaatatctgggcaagcctgacgaaccgagtatgggtctcgctcaccacgtcgacttctctcttctgggagttggaggtcgcgacgctcgagcagtgtcctctaagtttaggccagctgaacccctaacaggcgcagcaaagctggatatcgtcattgatgcagtaagggatatagcaatgaacactgggtttcacgacccagacattgggattggccgcttaaggagcgaactcgatagcctgcctcgacaagcttaattaccgatcccaaacaaatccataacggctcaatgacggcgcctttatatcgctgctgacgcatgtgaccgacccccgaagccgagtcaaggagccgtaacgtggcgacttcgggctcactggcctcccccctccaggttgagacctgctataggaggaagggatgagccagacaccgagcccaccaccgggcgacggaccagctcgacgacgacggggccgttacccgagccagttccgtagggacgccgcagcgttggtcctcgaccagcaccgaaccatcgctgaggtcgctcgcgaactcggcgtgaacgagcagacccctggtaactcacgtgcgcctagaacgcatccaccgaggtgagcgagagggcctaacaagcgcggagcgcgaggagttgacactgctgagtcggcaggtcacacagctcaccatggaatgcgagccggcgaagcgagcgatgtctcactcggtgaatgagggggacagtgggccgttaccactcagatctcccgctaggagaccaatggcttctccgtggcggcgccagcacgagtcatcggggtctcccccctggttgaaccgccccgggtttcgtgcacacttcgttacgtgtgaacggtctcggactcggccgctaggcggccatagtactcctgctcgacctcaatgggtggaccgcgccccagccggtgcatgagcctgcgcgtgttgtaccagttcaccgaggctctggtctcctcctcaaggtccgtgaggctggtaagaggcccgcgcgcaaagggtgggccaggccgcacgcacacggttgtggagagaccgatcgtggtctcggcgagcgcagtgtcgtaggcgtccccgacggagccgatcgaggccaccatgcctgccaacaggagcgattcaccaacatgcacggccgtcgcggcagagcctgcatccgagtgatggatcgtgctcccggtgagggggtgcccctcgcgtgcttgtcggccctcggccatgcgcagggcacgctcgacgagtcgggtgtcgtggcgacaggagcaggcccaccccacgatggtgccggcgaaggcgtcgatcacgaaggccgtggtggcacgccgcccgtgagccggacgtcggtgaagtccgccacgcacagctcgtcgggtcgctcccgtcggaagtcccggttgacgaggtccggggcgatctcggccttggggtctcgcatgtcgtgcgttgccgtgcacctgtcgcaccccgcaccagccatcagcgcgcgcgagccgttgcagcgtgcagcgggcaaccgggatcccctggcggcgcagagaggcccacaccttggtcgcccctaagagcgactccggcggacggcgacctttagcgtcgggctcatagatgccggcaaggatctcgctgatggcgctctctcagaggcaacggcgcgacggggctcggccaaggtgggcgtcgtaggtcctgggagcgatcgcactgtgcgtgcgctctcgagcgctcggacaatcggagcgaccccgtaggcccgtcggtgctgcgtgatgaagtcgcagatcaccgctggtgcggatcctcgcccgcgcgaagaacgttgtcgctgccttcaagatctcgatccgagcgctcgagttcagcgcgttcgtgcgcttcgagcgctcggatctcggctgtggtcggtggtgatgcccggccgctcgcctgcgttgactcggtactggtagagctacgtgcgcagcgtctctggtgccatggggagccgtccggacactgcctcgatcgctgcccattgactcggatactcgctgcggtgctcgagcacgaggcggatcgcctgttccttcgtctgctggtcccatctgctggccatgatctatccttcccttctctccaatggaagtgtgcatcaaagccggggtgattcaggttgtactacccctggcgacaccgtcgggacgaggcgaggatcccgagcacctggtgctcgcgagcgagccccacgccatctggcacgagagcgacggcacctacgccaagtccccgcatcacccacgagctgcgacacgcggttactgcgtcaaccacaagcgggtggagcgcatgatgcgcgagctcgagatagcagcgtgtctactccgccgcttcgtgcgtaccacgacgcggcaagaggacgcacccctcccagacctcgtctgtcaggacttcgctcctggtgagccagcgcgtcgctctgtgagcgacatcacctacgtccgcaccgacgagggcttctgctacctcgccacggaggtggatctcggatcaggcggatcgtgggctggtcactcgagcgtcgcatgcccgatgggctggtgatccaggcgatccgcggagccctcgggactcggggcagcctgaggtgccccagatttcgtagacacccaggttacttcacgcgagcctcctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatcccgtgtcgggcacagaaggccacaactcgatggtcgctgaactgactccctcggtcggtgtgccagatgaccccctgcgcgtgggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccggcgatgccgcgcctggccatcgctgctgccaccgtgttgtggctcgtcaccacgccagcggctcagagtgccgccgtgatccgtcgtgcgccgtaggtgccagaggatgcctggtggaccgcgaccactcggtcctcgaggtcgcgtctcgcacatgcccgacgcgacggtgctacctgggtgcgtcgccatcggtcgtagccagcccgggagacctcgaggaagcgtgccatccgcttgatcttgaagcgagcgtactccgcctccatcagcgcgaatctctcttgcgtggtggcttcgcggcgaagtacgcggctgcttttcccaggaactcgttgtccttgcgcagctcctcgagctccctgcgcaacctgatgagctcggtgcgctcctgcgccgtgaggggcgggctgccagtggcgtttgctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggggcggctcagcctggctggggcgatcttccacagcgatcgcgagtggcgtcccaccaagtggtgtaatttctgggcggcctgcactccaggagggcgggccaccgggcgatctctggcgtgtcagtcaacagctcgccagaggaggtatccagtggccctgacccgttccgactttacccacttgctctggcgccatcagagcgggcggtgacatcgacgtcatccgggagggggtggagctcgtgctccaggccctcatcgagcgagaggctgcggcggtcattggcgctggccgctacgaacgaggcgagggacgccagacgcaagcgcaacggctaccgcgaccgtctgctcgtcaccaaggccggcgacgtggagctacacatcccgaagctccgccgggggagcttcttcccgagcatcctcgagcgccgccgtctgagtcgatcgtgccctctacgcggtcgtcatggaggcctacgtctgagggagtcagtacccgcaaggtcgacgacctcgtcacggccctcggtgggacggggatctcgaggagcgaggtctcccggatcgtcgcctccctcgacgaggagctggcagggttccgtacccgcaggctggaccatctcgagttcccctacctcttcgccgatgccacctacgtcaagggccgcctcgagcaccaggtggtctcccgtgccgtcgtgaccatcacgggcgtgaatgccactggggaccgcgaggtccttggcgtcgccgtcggggatgggcagactgagagcttctcgcccgagtgcgcgagggagctcagggatcgtggcctcagtggtgtgcgcctcgtcagctccgatgcccatcgggggctcaccaacgccattgccaggtgcttcatcggggcgagctggcagcggtgccgagtgcagcgtgcgcgatgtgctcagccgcattccgaaggggagctgaggagatggtcctggccccagatccgcacgatcttcgctcagccgtccccgggagcggtacgtacccagtacgaccaggtcattgactcccttgccgcgaagctcccagcggttgctgccatgctcgccgaggccaaggaggaggtctgcaccttcacgcacttcccggaggcccactggcgaaaaatctggtcgacgaacccgctcgagcgggtgaaccatgagatcaagcggcgcaccaacgtcgtcggggtcttcccgaacgacgccgctctcctgcgcctcgtcaccgcggtcgtgctcgagcagcacgaggagtgggccgttgccgagcggcactacctgtcacaggagtccatggccgagctcgggactgccacgagcgacgacgacacggcgggcacctccgagacgcctcggccccctggcgctcctccggtgctgccgtcgcccgccgaggaagagcctgcagtggtaggctgaggccagccagggagtgaatttacaccactcggtgggacgtgatccgatcgcgccatccagtacctctcccggaaggtccggagcctacttgcgaccctcggcattcgccagtcagtgggcagagttgcgacctgctacgacaacgccgtggccgaggcctgctttgggagcttgaagcgcgagcttgtggctcgctaccgcttcgcgaacctggccgaggcccgctcggccatcgcgacctggatccagcgctacaacaccgtccgcttgcactcgacgcttgggtacctaccgcccgtggagtacgagctctcctgggcctgcagggaggtggccgtggcccaaattcagcctgtcaagcaaatgaggggaagcccacacaggtgaaggcggactcgtttgttggggactgtcaacatcgaggaattcgagggtgccttggtcaattccaacacccagcacatcgccagcgcagccccggcaacgccctcagaccatgcggcatcatgcaccgtctcgagaccagaccctctcgccgcgacgatcaagcgcgatccgaagcgtcgggcgacgggtcggcaccggatggagtcccactcgtgtcctcgtcatcgacgacgccgagcccaccccgatcgcgaagcaggtccgccgccaccgaccgcacctggcggtctcgatcggtggcggcagcgcggagcgcgcggtcggcacgtgggtcatcgaaggcgcacagcgcaaccaccgcccgccgtcgaaccgccggcttgtcgttgcgagctgcgtcgatgacgacgtcgagaccctcgggcgcaccgatggatccgagcgcggcgatcgccgcttcgcgaaccctgaggtcctcgtggacacgagcgctggtcacgagcactgcgacgtcgtcccgatcgccgacctcgccgaggatccaacaggccgcctcgacgacgagcgggtcagggtctccgagcaggccccgcgcacgctgatgcccgatcgcagagggacccgccccccacagcgccccgacgcggacgtcggcgtcgtcgtgagcgagcagccaggcgagatcctgctcatcaccgcggcgtgccagcgcgatcgccgccgtccgagcactgcgtcctcctgctgccaccagggcgcgcagcgtcgataccggtgcatcgaggacatccaatgggttcgcgctactcacgtatcgaccctagcgtcagccgcaggaccgcacgagcggatcggctatccctcgggcgctacctcaccgagcgccgtcccagatgacgaaagaccagcagggcctgcgtcggatgcctcgatggtgtcgagccaggcgtcacttgcggcaactcgtgcggcctcgtcggggatcggcaccaaccgcgcgagcacgagataggcgacggccgtcgcaacgaggcccacgatccaagaaatgtcgaccccaccgagtgcgcgcgcgacgggtccggtgtagctcacggggccgagttggcccagcaccatgaacggaacctccgacgcaaagccaatggcgtacgcgatcaagccccgagcactccaggcaccgtagatcccagttggggtaaacagatcacgaatggcgtagtgaccacgtcggacgacgaagaagtcgacgaggttcgtcgccgtccacggcacgagcaggtagagcatcagcgtcagcgcggtcgcgacggtgttgacggcgttctgggtgatgaactctgcgatcgcgaaccagaccaccgtgagcacgaccgtcacgccaaggcgccaacgccgactcggcgtgatgctccgcacgctgtcgatggcggtgagcagcgtgagcgagccaccgtaggcgttcatccccatcgtggccacgagtgccgccgcggagaggatcgccgtcaccgatccgagtcccccgacgacaccgttgccggcggcacggagtgccgtgaggccgtcttgggcgttgagatgcacggccaaccaagcacccagcgcaatgagccacaccgcgctcgcggaggcaccgaagaagaccgaggcgatcacccgacgcgtcggcgtggacaccgggagatagcgcgagtagtcggagacgtagggcgcgtaggtgatgttgtaggccgcggacgcggagaactccgccatgaacccgacggtcgtgaagccgaggtgggaactcgccacgtggctgccgtgcacggagccaagcagcaccgcgacggacacgatggccatgaaggggaacgacgcgatgagcagagcccgaaaggcacggtggacccagtcatggcccaagatggcgagggtggcggcgatcagcgtcgagcccacggcgacgacctcggcattccagccgtacgcgctcgagagtccatcggccaagagcacctggtcggtcacgttgaaggcaacgtaggtgaacagtgccgcaaacagcacgacgatcacgccgcgatagccgaactgtgctcgcgactggatcatctgcggcagacccaagcgcgggccctgggagccgtggaacgccatgaagaacgtccccacgacgatgcccaacgtgccagcgaggatcgtccaaccgaccgacaatccgagtcctggcccgatgaagccgatcgggatcgtgaagtactggaagttaccgaggaaccacagcggcgcctgatgccacagcttgccatggcgctcccgagtcggcacccagtcgatggagcgggcctcgatgatgggctgcgctcgcgaggcgtcggaatccatggatcgatcctatcaagggcagcatccacgtgaaggcaaaccgagcatcattcgttatctctcacgcaacgatggcccgcgcgtcacggcggcgcgggccgtcatcgcccgccgatacagcgcaggccgacgacgacgccaggcaggccgtgcatcgagggcgtcggtgagcgcctggtcgacgacgagggtggcgacgccaccaaggggcgctaccgccaccgtgccgagcccgtctcggccgccaggagcgacgacgccggcgatcgtggggcccgccccaccgggctcgacagcagccaccgcgacgacgagatccgactcgatcgcccgtgcgagcgagagtcgaaacggcgcacgcggatcgccgtcgcgaggcgcgagttcgctcgtggtgagcgggcgaagcactggggcaagctccgggtcgacccggacgatactgacgaggaggagccacgcgcccgcctcggctgcccttcgggcgatgcgccaatcgaggagaccctcggccccggcgacggcaaccccacccggaaggacgacgggagcatcgttcggggcagctcgcaggtcgctcgccgtatcgagcactcgtcgctcaccaccgggcatgtgcacgagcgcaacgacacgacagccagccacgcgcgaccacggctcgagccacccaagctcgtcgtcgtgctcgacggtgagcgccgggagcaccagcagctcggcggcgttcggctggccttcgaggatcgcacggaggtcctcgacagcgacggggcgcgcaagacgcatcgccccgacacgacgaccgaccgggatggccgaccatcgagcaccggctcgctccgccagcgccgctcgcgaccactcgccagcgctcgagaggagctcgcgaggcacgcccagcgacggtgcggcacggggccgcctcgcctccacgtcggccaggaccacccctgggccatcgcgtgaggcgacgatcgtcccgtcgggtgcgatgatgcagccacctccgccgaagcgcacgccgcgttcggtgcccacacgattggcgacgaccatcgtcgcaccgacatcacgagcgcgcacccaccacgccagcgcgggcgtgcgctcctcgggccacgccgtcggcacggcaaccactgccggatcgcgcccgagtaccgcgagtggctcgggaagatcgagatcggcgcagatgacgaggccgacgatggcgtcacccacctccatggtgacgcccggctcgtcgcctggtaccgcccacaccgtgtcgtcaacccacagatgtgcctttcggtaggtcgcctcgagaccctgggccgagacgacgacagcgctgttgtacagggagccatccggagcctgctcgacgatccccgcgaccaccgtggtcgcttcgcccgcgagcgcctcgacgatcgcagcaaccgtggggccgtcggcaacctctgcgaccgcgcgcgcctcctcgcgagtgagcagatagccggtcacggagagttccggcgccacgacgagagatgcgccacgagcaacggcggccgcgacgcgcgcttggagtcgctcccttccgtgcgctgggtcgagcgctcctgcagcctcgatgatcgcagcgacacgcacgcggacctcactcaggcgcgagtgcgcgcgtcgacgatggccgcgagcgcgatcgacgccgcgaccgaggcgttcagcgaggcgacggtcgccgccaacgggatcgccgccgtgacgtccaccccgcggcggaccaacggcgcgagtccgcgcccttcggcgccgacgacgagcgcgaggcgctccgtggcgagggtgagcgagaagacgctcgtcgcggcgtcggcgtcgagcccaacgctccacaccccgcgcgctcggagtcgacgaagcgcggccgggatcgacgacaccagagcgaagcgcagccactcgaccccaccggctgcgaccttggtgacggtcggtgtgagcggaacgctccggtagcgcggcaacaccacgccgtcggcgccgaacgcggcggcactgcggagcaccgccccgaggttgtgcggatcctcgagatgatcgaccacgacgagcagcgaaccgtcggcgagaccgtcgaggcccacatcgaccaccgggtcgcagtcggcgaggaccccctggtgcacctcggtgcgcgcgacgcgctcgaaacgttctggcggcaggagctccacggggacgccagcgcgcgccgcggcctcgatgatcgcctccggctcacgcccggcctcgacgatcacgcgcctgacgcgacggcgcccagcccggaagcactcgaggaccgcgcgcctcccctcgactcgttcaccgccgagcccacggccaccacgagggtgcacatcagtcctcggcatcgaccacgccttcgagcagcacgaccgcgagcgcagcgacgccctcgccacgaccgagcgcaccgatgccttccggatgcttggccttgacgagcgctggcgccgcgacgacaccctcgatcgtgcgggccatccgggcgagatacggcgagagcttcggtgtctcgcacacgatggtcgcgtcgacctgcacgacccgaagacctcgaccccgcacgagccgaacacagcccgcgagcagctccaaggagtcggctccgcgaaaggccgggtcggtgtcggcatagaggtcgccgatgccaccgatcccagcggcgccgagcatcgcatctgccaccgcgtgacagagtgcgtccccgtcggagtgtgcccgcaggccaggcccaggcaccgtcaccccgccgagcaccaacggccgtccgggttcgtcggagcgcggatgctggtcgagccccaacccgacgcgcacaccgatgagatctcgcaggtcgcgtcgcgtcgtgaccttgcgcgcagacggggacccgtcgaccacctccacggtccagcccagctgctcggcgacgaccgcgtcgtcggtgccctccagccctgagccgatcaccccagccagcacgccgtagtggaagccctgcggtgtctggatcgcgcggaggtgggctcgctcgagcgtgcgggtcacccgaccgtcgcgcacctccttgatcgtgtccgcaacgggaagggccgggacgacgaccgctgcaccgttcgcaagacgggcgatgaccctctcgaacagcgacaccggtgccaacgggcgtgccgcgtcgtgcaccaggacgaactccggcgcgccctcgagggccgcaaaggcccggcggaccgactcagacctcgtcctcccgccgacaaccgtcgtcgccccttcgacgacccgatcgacctccggcgggagcgccacgatcacctgcgacgacaccgcgcgcgcggcctcgaccgcatgctcgaccagcgatcgattgccgagcgcctcgaactgcttcgggccaccgaaacgactcccttgccccgccgcgacgacgagggtggcgaccgccaccgcgccctacgcgagggccttgtcgagtcgagcctccgcttcctcgggcgcgacgtcgagggcgaaggtcagctcggagaccaacacctggcgcgccttggcgagcatgcggcgctccccggccgagagccccttgtcgtgatcgcgcagcgtcaggttgcgcaccacctcggcgacctggtagatgtcgccggacttgaccttctcgaggtggttcttgtagcgccgcgaccagttcgcgggcatgcgcacgtccttcttccccagaacggcgaagacctcttcgacctcttcgtcgttgatcacctcgcgcaggccgacctcgtcgacggcgtcgacgggcaagcgtacggtgagatcgccataggccaccgtgacgacgaagtactccttggcctcaccgaaggcctcgacgacctcccgtccggtgatcacagcggcaccatgctgcgggtagacgaccttgtcaccgacgtcgaatggcacagcttcctcactttcccgacgccctcgtgcgcgtcgggctcactcgtagcgcttccagtataccaggtcgatcagggtgaaagtccaggtcacctggctattcgtaggacctgaggtgagccacgaccgccttggcccagtcgggatccacgccagccacggtcgccagctcgtcgggttccatgctcgccaacgcatgcagcgaaccgactcgctcctcgatacgcgcggcgatcgatcgcggcagccgcggcacgtggtgcagcagcctggagcccttcgacggcaggttcacgccgaggagctcaccgtcgtagagatcctcgtgcgcgagcgagacgcagcgcgcgcgctcggcgacgtgacgcgccagctggacgacgttcatgagctcgtcgagatccagcgacgccaagagctccttgatgtcgcgcacctcgccctcgtcgcacacccccagaaagtcccggaggacatcggtgtagtcgcggtcgaagtcgagggtgatctcggccgcctgcagtgcgacgaggcgtccgtccgcaccgagttcgaccagatagccgtcgatctcctcccgaatccgacgcaccatctcggctcgctgcagcacgaagaccacgtcgcgcaagctgacctgctcgcgcaactcgagcccgttcagttgctcgagcacctggtcgaggcgcccccgatagcgctcgagcgtcgagagcgcctggttcgcgcgcgagagcagctgggggatgggctgcagcgtgcgcttctcgcggcgtcgatacacggagatcaccgacagctcctccgagaccgccacgaccgtagcgtccacgctctctgccacacgctcggcggtacggtggcgcgtgcccgtctcactggtcggaaggcgtggatcgggcacgaggtgcacgttcgctcgcacgatctgcgacccgtgcgaggacaggatgatcgcgccatccatcttggcgagctcgaacagccgctgtggggtataggcggcctcgatgaggaagccgccggtacagagctcgaggacctcgggcgaatcgcccagcacgacgagcgctcccatgcgcgccagcaagatgcggtcgagcccttggcgcaggggcgtccctggagcgacgctccgcagtgcctcctcgatgcccgcgccttccacgctgctccctccgtcagacgcaggaaccggcaccccggtcgcgctctcgaagcctcgtggagcgcgccgtgcgacagcgcgctccaccgactactcctgtgggttcgagccggccagctccatcgggggcggctcgagtccctccatcacccggaagacgatctcctcgccctccacatcgacgaccaccatgtcgcccgccttgaactcttggtgcaagaggcgctcggcgaggggatcctcgacgagtcgctggatggtacgccgcagcggtcgagctccgagttctcgatcgtaaccacgatctgccaggaagcccttggcggcttcggtcagctcgatgccgatccccttcgcctggagctgatcttgcacccggcggaacaagaggctcacgatcgccatgacctcgtcgcgacgaagctcgtggaacacgatcacctcgtcgatacggttcaagaactccggcttgaagtgcgtcttcagcgcctcgttcagccgcatcttcatccgctcgtggttgacgtcctccgaggacttcgcgaaaccgacctgggcgcggtgcaggtcctgcgtcccgaggttcgacgtcatgatgaggatggtgttcttgaagtcgaccgtgcgaccctgcgcatccgtcaggcgaccgtcctcgagaatctggagcaaggtgttgaagatgtcgggatgcgccttctcgatctcgtcgaagagcacgacggagaacggccgacgccgaaccgcctcggtcagctgaccaccttcgtcgtagccgacgtagcccggcggcgcaccgacgaggcgagcgaccgtgtgcttctccatgtactcgctcatatcgagctggatcagcgcgtcctggtcgccgaagaggaactcggccagcgtcttggcgagctccgtcttgcccacgcccgtcgggccgaggaagatgaacgagcccgatggacgacgggggtccttcaacccagcgcgcgtacgacggatggctcgagacaaagcgctgatggcttcttcctgccccacgatccgatggtgcagctcgtcctccatgcgcagcagcttggaggtctcttcctcggtcagctggttgaccgggatgcccgtccacatcgcgaggacctcggcgatgacctcctcgtccacgacgccgaaacgctcatcgccctcgcgcttccacgccgcctcgagctcggccttgcgcgagacgagctcgctctcgcgcgccgccagccgcttggcttcgtcgaagttctgacgggcgatcgcgccttccttgtcacgacgcgtgcgggtgaggtcgttctcgacctgtcgcaactcgggcgggctggtgacgcgcttgatgcgcagccggctccccgcctcgtcgatgaggtcgatggccttgtcgggcaagaagcgatccgagatgtagcggtccgccatgttggcggcggccaccagcgcttcgtcggtgatggtgacgttgtggtgggcctcgtagcgctcacggagacccttcaagatctcgaacgtgtcctcgatcgagggctcgccgaccttgatcggttggaagcgccgctcgagcgcagcgtccttctcgagatgcttgcggtactcgtcgatggtggtcgccccgatggtctggagctcaccgcgggcgagcatcggcttcaggatcgacgcggcgtcgatggctccctcggccgcaccggcaccgacgagcgtgtggatctcgtcgatgaagaggatgatgttctccttggtgcggacctccttgaggaccttcttcaggcgttcctcgaagtcgccccggtaacggctgcccgccaccagcgcaccgaggtccaaggtgtagatctgcttgccgcgcaaggtgtcgggcacctcgccagcgacgatgcgctgcgcgaggccctcgacgatcgccgacttgccgaccccaggctccccgatcagcaccgggttgttcttctgacgacgcgagagaacctgcatcatgcgctcgatctcgttgtcgcgaccgaccacggggtcgagcttgcggtccctcgccatctgcgtcaggttccgaccgaactgatcaagaatgggcgaaccaccgggtgcgtcttgcccctgggacggtccggccccttgaccgaccgtggggcgaccctcggtcgacgacaggatctgcatcacctgctggcgcaccctggtgaggtcgacgccaagcgcgagcagcaccttggccccggtcccctcaccttcgcgcacgaggccgagcagcatgtgctcggtgccgatgtagttgtgaccgagctggagcgcctcgcggagcgagtactcgaggaccttcttcgctcgaacggtgaatgcgggggagttcggcgtcggccctggcgacggctcggactggcgcgtcacctcctcgcgcagctggtcgagtgagacacccagcgattcgagcgccttggctgcgatcccttctccctcatgcacgagacccagcaagatgtgctcggtcccgatgtagttgtggtggaggagcttggcctcctcctgcgcgagcacgagcactcgacgtgcccgatcagtgaatcgctcgaacaagtctctcgcctcctcgatcggcacctccgggttgaggacccttcgactccgatctggtacctggttccttcattctacccgcaacgctcaacatcgctcgaacatgccttgacgtcggcatcggcagcgccaggctgaaccaccgagttgctccagtctgccacggacagctgggctgtgtctgtgggcaggctcgacagttcgctcacggagtactcacgagaccgccctcgatgtcgccgagcggcagccatcgccgggcgcgtgcacgaggaccaaccaggtcgcattgaccgcgaacacgtgccagatcgcaccgaggtgcgcctccaaccacccgaccgcggcctgcggctgggcaagcaggctgcgatcgaccacgatggagcacacgtcgtggcgggcaaggtaccccggcagctcgtgggccgcccgcgatgccagcgacgcgtcgggttgggtcggttgggccacgctccagagatagccgaggacggcggagtcgttcaaccgagcgatcgtctgcgcgggcaggcgtgacacatagccctcgggcgtcggggtcccgatcacggcggcctcgtagggatagagcgcgatcccagctgcccaggcactctgggtcgggatgaccaccggcacgtagaacgtggtgccaccgaccgctgcgatcccgcggggacgagggaccagcgggagcgcagtgtcggggaacggcgtcggcgccgaaccgacccagagcgccaccgcaacggccgcgacgagccccgcacgcaacagccggcggtggcgacggcgcccgagcgcaacccagacccactcgagcaccgctgcgccgagcagtgccccgaacagcgccgtgagcaccgcgagacgctccggcagggtgtcggacacgaacgggatcgcatcgaagggcaggtacggaagcgggatcggcgtcagcaccccatcgacgtggaggtaagggcccatggacgccagagcgaagatcagcatggcgagcccgagtggcaggatcaaccgctcgagccgaggcgcgagcggaccgtgacggcgctggcgtacgacgatcgcgacgccaccgacgaggccgatccagggaccagcgccagggaagcccgagccgtccgcgaggttcggggcaaggtgccacacgggggcgaggaagtggaaggcgccccacggatcaggcacaaagaaggacagcgcgtcgaccacccacggggtcgagaagggcgtctgcgccccaccgtgaaccgcgagcggactcagcaggagtgcgtcgaggagcggcgcgacggcgacgacggcgacaacaccgaggacgagccagccccgccaccacgccacgagggtcgcgagacgcctcgacgcgagctgcggatgcacgaaccagagcaccacgatggcagcgatcgcgtagatgccgtagtcgtagacgctccagaccacgagcgccaggagcgcgccgagcacaccgaagcgccagagagcgggatcggcacgatcgaagaggtcgaaggcccaacccaccaccaacgcgagccctgccccgtcgaccaggttgagatgcccgagcatctggcccatgaagaacgggctcgcgaggtagatcgcaccggcgacgagggccgcgccgcggccgagcccgacgcgacgcgcgcaccacgccgcagcaccaccgtcggcgacgagggacccgaggagcgcgaggttgtaggcgaggaccggcgtcgcaccgaggtgctcgagcacgcccgcgacgatggcggcaggcagcgcgagggtggcccacgcgaggtccgcacccctcggatagagcacctggtgcgtgaggaagagcccgtgggcaccgaccagccagcccgcgacccagtggatgtaccacagaaactgcggcgagtcaccaccatcgccgatcaccctcgacgtcaggtgagcgccaccgggccagctgagcaggagcgcctcggcaccatagatcacgacgcacgccgcagcgaaggcgagctgtgcccacgttgagccgcgctcgcgcgcttgccgtgtcccgatccgtgccgccgtcgacgacgcagacacggtgtcgtaggctgacattcgcgagatactaccgaacaccacggccgctggcacgtggcgcggggaccaaggacccggggccacacggacccgacgggctctagggtggacgaggtggagcatccgttgccgctcggtgagccgtgggcgggtccgtacctccaggcggtcgaggaagggctgcgtcgagcagcgaccacgaccgatccggacatcacggcggccgccctgcacctcatcatggccggcggcaagcgcgttcgaccgctgattgcgctggcgacggcccttgcactcggcgaggtcgcaccgtctcccgacgaccctgtcgtccgcggcgccgtcgcggtcgagctcgtgcacctcgcctcgctctatcacgacgacgtcatggacgaggcttcggagcgtcgtggggtctccagtgccaacgcccggttcggcaacctcatcgcggtggtcaccggcgacttcttgttggcccgcgcggcgggcatcgcagctcgcctcggtgaagaggtagccgcggcgctcgcggacacgctggccgccatgtgcgaggggcagatcctcgaggttgccgacgcgcaccaactcacgcgcacgaccgagcgctacctcgcgaccatcgcgggcaagaccgcgtcgttgatggggaccgcggcccgcatcccggccatcgtcctcggacgcgaccaagcgatgctcgatgccctctcggctgctgggaccgcgctcggcatgctgttccagctccgtgacgacgtgctggacctcgtcgcgacccgcgagcaactcggcaaggagccggcacaggatctggtggaggggatctacaccttgccggtgatcctggcgctccacgaccccaccgtgcgcgaggccctgctggacgtgctcccacgagccgcagaccccgaaccacgagccgtcgcactcagcctggtccgtcgcagcgacggcatccctggcacgctcggccagatgcgcaggatcgaggccgatctcgatgccgtgctcgccgacacgctcggcatgtccgattcgtggttcggtcggctcgctcgcgcgctcgtcagctcagccgagcacctcgcagccgcggtaccggcacccagcgcactcgcctgagcacccccggcccagtttccaccggtcccaccaagagcatccgcgcatcagctcgcggcgccagagctccgacgtcgccgaactcacggccgggcatacccccgtcggaacgccccgtcctcgggcgcccagctcagtcgagccgacgagcgagcgagccgaccgacgcccggggtgcgccggcgacgagagcagccccgtcacgcggtccatgcgccgattcgctccgcgaccagcgccgctcgtctcctcacgccgtctcgtcggatgcgccatcctcgtcgacatcgctctccgaggatcccgcctccggtcgcagggtcgggaagagaatgacctccttgatgtggcgctgccctgtgagcagcatggcgagccgatccacaccgaggccgagaccacccgtcggtggcaggccatactcgagtgcccgcacgtagtccgcgtcgtaggccatcgcctcgtcgtcaccggcacggcgctgacgagcctgctcctcgaagcgagcacgctgctcgtccggatcgttgagctcgctgaaggcgttgacgagctcgcggcccccgacgaccagctcgaagcgctcgactcgccccggtcgcgaccggtgacgacgagcgagcggcgagacggactcagggaagtccagtacgaacgtcggttcgatgagtcgcggttccacgagctcctcgtagagcgcgaccaacgcccgccccgcctccggctcgagcacggcaagatcgaaccgtcgagcgaggtcgagcagtcgtgcgggctcgtcgaggctgacccgctcgccgaccgcctccgagacgagatcctccatcgtcgccgcgcgaaacggcggggtcagatcgatcacaccgagctcgttctcgccgcgggtcgacccgaagacagcgcgcgctgcgctcgcgagcagcccttccgtgagctcgcgcatcgcgtcgatgtcgccgtaggcctggtaggcctcgagcatcgtgaactcggggttgtggcgaggcgagataccctcgttccggaagtcccggccgagttcgaacacacgctcgatcccgccgaccacaagtcgcttgaggtagagctcaggggcgatcctgaggtacaggtccatgtcgagcgcgttgtggtgggtcacgaagggtcgagcggccgcgcccgaggcaatgggctgcaagatcggcgtctcgacctcgacgaagccccgtgcgtcgagttcgtcgcgaagggctcgcacgagtcggctgcgggcgaggaagcgctcgcgcaccccggggttggcccacagatccacgtagcgctggcggtaacgcacgtcgggatcgcgcacaccccgccacttgtcgccgaacgatcggcgcgcatgcgcaagaagctggatccgatcaacgaggacggagcgctcgccggtcctcgtggtcgcgatcacaccgtcgacgccgacccagtcgccgagcaccagggaatcggccagcgtcgagaacgcctgggtgcgatcggcgcgcagccagagctggatcgctccgctcgcgtctcgaagctccccgaacgccatcctcccttgccgcctgaggcgcaagatccgtccggccacccggacctgctgatcggtgacggtgtcgggcgcgagaccctcgctccgccgtcgcacgacatcgacgggctccaccccgccaaaggcgtacggaggcacgaagagcgctgcggtctcagcgtcgggcgctcgacgttcatctgcgctcatcgtccgtcctctccaccacgccccagagacgcaaggagtctaggctcgagcccgccgtccctggttgcgcgcccagacgagccgcagcccgtggagcgtcagccacggctcgatatgcccgacgacgggcacctcgcagccgatgacctcgcacagcccgcccgtcgcgacgaccggagcctcggctccgatctcggcacgcatgagctccacgaggtgggtgacctgcccgacgacaccgttgatcaccccggactggatcgactccaccgtcgaacgaccgatcgccgccttcggccgccgtagctcgaccttgcgcagcgccgcagcacgcgccaccaacgcatcgagcgcgacgaccacccccggcgcgatcgcaccgccgaggtaggcaccgctcgcatcgatcgcatcgacggtggtcgcggtgccgaagtcgaccaccagcaccggcgcgccatagagctcgaccgcggccaccgcatcgaccacgcgatcgggaccgacctctcgtggatcgtcgtagcggatcgggatcccgacccgcgtccccggtccgaccacgagcggacgaagcccgagatgcccctcgaccatgtccacgacgcttcgggtcacgttcgccgccgaggatgcaacgatcgcgccgacgagcccaccgacgaggtggtggcgatcgagaaaggtctcgacgaggatggcggtctcgtctgccgtgcgatcggcgcgcgtcgccagccgaaggtgcgcgacgagtccctcctcggccgtcgtcgccgcagcctcggtgtcgtagacgccgatcacggtctcggtgttgccgacgtcgatcgtgaccacgtgctcagccatcggcgcctccgatcgcacggttgtcgatgagccggacaccctcgacgcgccaggcagcgagcacgcgagacgcgggcgtgagggcccgcgtcggctcgagcaggggcggttctgcgacctcgacgtagtcgagatcgacccccccgagatcggcgagcaggcgagtccggaaggcggcggcggcgtctcccacacgagcactcgcgcagtgacgcgcgaggatctgggcgacacgtcgcgcctcgcggagcccgaccggcgagagccgccggttccgcgacgacagcgcgaggccacccggatcgcgaacggtctcgaccgcgacgacctcgacagggaggtggagctcggccaccagccggcggaccacgagcagctgctgaaaatccttctcgccgaagtaggcacgagtgggagccgtcaccgtgaacagcttcgtcacaacggtcgcgacaccgtcgaagtggccaggacgcacggcaccctccagccgctcggtgacgcccccgacgcgcaccgagacgaggatcggactggggtgcaactcctcgacgacgggtgcgaacacccagtccgcaccggcgtccacggcggcacgcacgtccgcctccagggtccgcggataggccgcaaggtcggtggggtcgtcgaactgcagcggattgacgaagacggagacgaccacgacgtcgtcgcgctcccgcgctcgccgaatcagcgcctcgtgcccctcgtggagcgcacccatcgtcggcacgaggccgatggcagccccggcgtcccgggcaggtgcgagcgcctcgcggagcccggcgacggtcctgatcagcgggtccacgcgcaccccgcggcatgagcgacgacgggcggtcgctcgaggtgggccaacgatccccccgccaacgaccgcgcgagggcggcgtcgaggtccgcgagcggccacagcacgaacgaccgaccgaacgcgcgcggatgggggacgacgaggcgcggaggcgagctcacgacgacgccgtccatccacaccacgtcgagatcgagcgtccgaggagcgttcgggacgctgcgttggcgaccgtggcgcgcttcgagcgcgagcaagtcgtcgagcaggcgaaacggcgaacggtccgtgcgcagctcgcacaccgcgttcaggtaccgcggttgcgcccccggcccgccgaccggctcggtctcgtagaggttcgacaccgcgacgacctcgccgatggcgccgagcgccgcatcgagggtccgcgctcggtcgccgaggttggcgccgagggcaacgaaagcgcggcgcctcacgagcgctcaccgccatctcggacccgcgtcacgaccacgtgcaccgtggccccggccagtgccagtgggggggcgagcttggtcgcacgaacggtgacgcgctcgagctgcgcccagccgagcgtcgcaacgatggcgtcggcgagccgcgccgcgaccgtctcgaccaaggcacacggcgtcgcaaggacctcgggcacgaggcgatcgagcacgctgtagtcgacggtggtggcgaggtcgtcgccgatcggctcctcggcgacgacgagttcgaccgcaagctcgaccggctgcggcagggaccgctcggcctcggtcacgccgaggtgcgccggttgcaccatgccctcgaccgcgatggtcaggcccactcgcgcgccgcctcctccatggccgcagcgagacgcaggtactcacggatcggccgtactcggtgcacccgcaccacgtccgcaccgtgctcgatcgcccagatggccgcggcgaggctctgctcctcgcgctcgagcgggggcaacgcgggctcggcacgactgagctcggccagcatgctcttgcgcgagaggccgacgacgaccggtgcgccgagggacgcgatttgacgaaggtgcgcgatcagcgccaggttgtgcgcgaccgtcttgccgaagccgatcccgggatcgaaccagacctccttcacgcccagcgcacgcgcctcgtcacgtcgctccctgagccacgccgacacctcgcccaccacgtcggtataggtcgggttgacctgcatcgtctgcgggtcaccctgggcatgcatcgcgatccacaccgcaccgacctcagccgcgaccggtccgagtcgaccgctcacgtcgttgacgatcgtcgcgcctgcctcgaccgccgcccgagcgacggcgggcttgaccgtgtcgatggagacgaccccgtagggagcgagcgccgccacgaccggcaggacccgacggagctcctcggtctcgggcaccggcaccgcgcccggccgcgtggactcgccacccacgtcgacgatgtcggccccctcggcgaagagttcgagaccgtgctcgatcgctctggccgcatcgaagtagcgaccgccgtcactgaaggagtcgggcgtgacgttgacgatccccatgatccgagcgtcgcgacgctcgctcatcggggcggccgtcctcgctcgagctccgcgagcgcgttggggctgcccacctccctgcccgccagcgcctgggtcgtcacgatcacgccctcgcgtcgcaccccccggatggcgatgcaggcgtgctcggcccgaacggtgacacggacgagacgcgcccgggccgccttggcgatcgcatcggcgatctcctgcgtcagccgttcttggagctggaggcgacgagcgtgccgctcgatctctcgcaccacggccgacaggccgaggaccccagctcccgggagatactccaccgagaccgtgcccgtaaacggcaggaggtgatgctcacacagcgaggcaaacctgatctcgtcgaggacgacgggagcccgctgctcgggcgcgaaccgcaccggatcgtcgggctcggcccgatacccgccgagcagttcggccagtgcctcgaccacccgctccggggtgcgcgtgcgcacgtcgtcggcgagcgtcgcaccgagggtggcctcggcccacgcgagcagcgtgtccacggccgcgcgagcgtcgtcgttcgtcggtgcgctcatacgtcctcccgataggtcgcgatgaacgggaggttccggtagcgctcggcgacgtcgagtccatagccgatgacgaaggcgggcgggatgtcgaagccgacgtaggcgatgggcagatcgcctcgaccgtcgtcaggcttgcgcaacagggcgcacacggcgagcgacgccgggttgcgcgaggcgaggttcgtcaagaggtagcggagcgtgaggccgctctcgacgatgtcttcgaccacgatgacgtcgcgcccttcgagctcgacgtcgaggtccttgatgatccgcacgacacccgaggtccgcgtggcactgccataggaggacaccgccatgaagtccaccgcgaccggcagctcgatcgctcgtgccaggtctcccatgaacacgaacgcacccttgagcacccccacgaggaacggtgcgcggcccgcgtagtccttggtgatcgccgctccgagctcgccgacgcgcgcacggaggtctgcctcactgatcaggacatcgccgatgtgcgggtcatccagcgaccacgtcacgggcgcctcccttcggactcgagcccgagacgggcgatctctcgcccacctgagcttaggacgagcgacgagcccacgcgtcgcacgtcgaggtcgctcgggagtgcatgcgctcggcgagtaccatcggcgacctggacgagcgcacgccgatgcgccgccgacagtcgaaggcctgtctggtgtcggacccacgtcgcgagctgggtcgtcgccggcgcgagctccgggtagcgcgcctgcaggcgcacggcctcgcgggcgtgcgccgccgcgcgcgccagcagcgggacgacgtcacgctctgcgatcgcggcggcgagcgggagcagctcggtacgcacgcgcacgcgccgaaagcgtacgtcctgattcatgggatcgacgagcggcacgagtccggcggcctcgcagacgcgcgcgagctctgagcgccgaaggccgagtgccgggtggagggggccgggctccatggcgccgataccgacgagcccgctcccccgcaggagattcagcagcaccgtctcggcttgatcatccatcgtgtgtgcccgggcggcgtccccgagggcgccgaggcgggccgagcgcgcgcgcgcctcgaggttggggccagggatcacgcgcacacggcgctcgagcaccgagatcccgagcggagcgagctggcgggcgacgtcggctccttctcgggccgagcccgggcgcaggccgtggtcgacgtggatcgcgaggacccgcttgccaccgaacgccagcagcgcagcgagacccagcgagtcggcgccacccgagacgccgacgcggaccgggtcgtcatcgagaggccacagccgctcaccgagcgaggcgagatcgatgccgagctcacgagctcggcgctgggcagcctcgacccacgacgggctaggccgcaccgaccctcgccagccacgtctctggcgcgtcgagctcggcaagcgttgggagcgactcggcgcgttcgaacacgtcgagcgcgctgccaggccgttctgcctcgatgcgctcaaagaaccgacgaccgcgctcgtactggcgagccttcgcgtcgagtccgaggagtcgcgcgacgatgcgcgcgagaccccgcgcactgcgacgctggtcgacgacacgagccagctcgtcgtcacccggcacggtccccgaggggagggtccgcatgacccagtccgcgtggccctcgatgacgctcatgatggcgctgacacgagccaacgaggcagcagcacgttctgggaggaccagctcgagtggcccgagctccccgaggcggcggtcgccacccaaccagctgagcagcgaactcaccgcatcgaccggggtcgccggtcgcgcagcgatgacctcggcgagcgatgcgtagagcgtctcgagcagccaggggcgcgcgaagaactgcgcccgatgggcgagttcgtgcgagagcacccacctcgccaccgtggcgagatccgtcccagcccctgacgcgagatgctgggcgttctggcctaccagcacgagcaggggctcttcgtcgccgccccccggcacgtactgccccagaacgcgaggcgagagggccgcgagcaccgcgccgagcatggctccgctcacctcggccgcaccagcgggtaccccctgcgggtacaagcgaccgatcaaggctgcgtaggaacgcgcattgtggatcgcccacgcgcgccgtgacaggttcgcgaccgcgagggtctccgttccgatctcgagcccacaacgagcctcgacgatgggggcgagctctgccaccaggccaatcagatcgagaggcggcggcgctgtgtccgggacgagcgctcggatcgacagcgtcgccacctggtgcgacacggggctcaccatgagctgagccccgaggaaactacccggccttgcgctgaccgcgggttcgcgacgccccgatgggctgatgcgcgtagcagtacttggacttgttgtaaatggagagcgtcgtcgtacaacccggctccttgcacacgcgtcctcgctggtaggtgcggggtgcgtgcccagtcgccagaggttccgcgacgatcgtctcttcccctcggctcaccatgtccagagcaacccacgatgccccccgccctattcctgtcgcgcgtcggagacgtggcggtccttggccgattcctcaaggaggaccatcgcgagacgctcacgcagcgaggtcggaacccgatcgcgtgctcgctccgcgatgaccatgcgcagctcggcttcgaactcgaacgcctcgagacaggacccacagtggtccagatgggcttggagcttgtgccggcgttcgtcggtcagctcgccatcgaggaagaagtacagctggctgatcgcttcccgacactcgggcgtggacggaccccgagggtcgggctcgatctcatgacccttgtgctccggaccagtctcgctcgtcaccatctacgcctcggtctccgctgcccgctccgcacgagccagtcgcttctcgatcaacgcgcgctggagcgcgcgccttccccgatgcagccgactcatcacggttccgagcgggacgtccatgatgtcggcgatctcacggtagctaaaaccttcgacgtccgccaggatcacggccaagcggaactgctctggcagggcctcgagcgccgccttgacgtcggcatcggtgaaggtgtcgaggacctcctcctcggcgctccggcccgcgagggctgcctcgagaccgcccaggcggcgatagaggtagagctgctcgacctcgtcgaggtccgtctcgtccgggcgacggcgacgagctcggtaggcattgatgtaggtgttggtgaggatgcgatagagccacgccttgaggttggtgccctcctcgaaggtaccgaaggcacgataagccttcaggaacgtctcttgcaccaagtcctcggcgtcggccgcgttgtgggtcatacgcatcgccgcggagtagaggttgtcggcgtacggcagggcaagctcttcgaagcgcgcctgatccgccacgtcgcctcccgtcaccagccgagcccgggaggggactcgaacccctgacctgctcattacgagggagctgctctgccgactgagctacccgggcgccgagcgaccagtgtagccatgtgccggggtgggacgctcgagcacgagctcggcgagcaccagaccgatggagagcctcctcgcgagcgagccgctcgcgcgccgcaccgcctgaccccaggaagcatccatcgggttggctcgaatcgcgaccgcgagtccgagccgtaccaacgcctcttgcgtcggagccggcaacgagctcggcgggcgaagcgacgctgcgatctgggccggatgggcatgggccgcaccggtcgcgagcgcggcccaacgctcgagccacgtccccggctcgggaaccgacccgagcgtgtggacgagctcgagatcacgcggcacgagcgcgaggagacgcggcgagagctcgatgcccgcgtcggcgacggcagcctcgatctcggctgcgctcggaggatcgacctggacgcggacgcagcgcgacgccatcgccgtgagctcgggagggatggcgctcgccgcgagcaaccaccgcgtccgcggccccggctcctcgagcgccttgagcaccactggcgctaccgacgccatgcgttcgataccgacgaggccggcgatgcgccagcgatcggcactctggcgtgcgtgcgcaacgagggcacgaacgtcggcgatcgacggggtgtcactgaggatgcgcacgtcggggtggcgtccctcggcgaccgcactgcacaccgagcactccccacagccgccgcgcggacaggtgaggtactgggcggcgaccaccaccaggtcggcgaggccactcccccgcgcgcccaccagcagcacaccggctcgcgatgcatcgagcgcacgctcgatgcgctccgtggtgtgcggacgccagcgtcgaatgccctcagcgacgcgcgtcgtcatcgagcccgagctccgccatgatcatcgcctgcacccgagccgctaccgcgtctcgcgagccgttcgcgtcgacgagccgccatccccacgatcgcgcacgatcggcgtagcgcgcccggatctgctcccacgcggagcggccacccgcctcgaaccggtcgccggcgtcgaggccgagcggctcggcacgatcgaggacgaggacgagatcggcgaccggatcgccggtcaacgcctcgagggcccagatcgcatcctctcccaccttcgggccctggtagacgatggtcgaagggaagtagcgatcgaggatcacgtgcgtgcccgcctcgacggcggggcgcaccaccgttgcgacgagctgtgcacgggcggcagcgaacgtgagcagctcggcccatggtgcgagcgaccgcgtcttgaccacctcgcggagcgcctcggcagcggggtcgccacctggatctctcgccgtgaccacgtcgacaccgcgggcacgcacggccgcgaccgcgaggtggacctgcgtcgacttgccgaccttgtcgggtccgtcgaggaccacgagtttcccccgcgtcacgagccagatcccaagcgcgcacgccgctcggccaagagctccaccgccgtgtcgagatccaagctggccggatcgacgcctcgcggcaaggaggcgttcacctcgccgtcggagacgtaggggccgtagcgacccgaacggaccacgacgcgcgcgccggtgtccggatgggtgcccaactcgagcacgctggccgagcgaccgcgccgcttgggctcgcgaaagcgcgcgagcgcttcggtgagatcgatggtgaagagctgctcgggcttgtcgagcgagcgggtgtcgcgacccttggcgagatacggaccgaagcggccgttgtgcgcccagatctcctgctgggactcggggtcgaccccgaccaaccgcggcaaggacaagagcgcgaccgcgtcctcgtagctcagggtctcgacccgctgccctggcagcagcgatgcacgccgcagcgagcgatcgtcgccctcgccgagctgcacatagggaccgaaccggccggtacgcaggagcacgggttgcccgtcgagttcgccgagcacacgatcgccgagcctgccccgctcgagcagctcctcggcccgctcgagggtgagctcgtcgggagggaggtcctctgggatggaggcggtctcctcgcctgcctggaggaacggtccgtagcggccgacacgcaccacgaccggcgttccatccgcgcgctggccgatcgggatcgagttcacgtcgcgtgcgtcgatctcccccagtcgctcggtgacgagctgatggagaccgggggcaccgttgccccagtagaaatgcgcgaggtagggcgtgggctcctcctcgccgatcgcgatgcggtcgaggtcgtcctcgagacgcgccgtgaaggagtagtccaccagctcggcgaagtggcgctcgagcagctgcaccaccgcgaagccgagaaaggtcggaatcagcgcttgcgagcgtcgccatgcatacgagcgctcgacgagcgtgctgatgatctgcgcataggtcgacggccgtccgatgccacgctcctcgagcgcgcgcacgagcgatgcctccgtatagcgcgccggaggctgcgtctcgtgcccctggggctgggcacccgtcgtggtgagcgcgacaccagcggccagaggcggcaggtcgacctcgtcgtcctcgctgagttgctccgggtagaccgcgaggaaccctggatcggtgagcgtgcggccacgagcgacgaacgtcgcccgctcgatctcgcgaccgtcgatgcgaacctcgggcccgagcgcgacgtcgatcgtcgcgacggcggacatcccgcgggcgtcggtcatctgggaggccagcgtgcgacgccagatcagctcgtagaggcgcgcctcgtcgccgggagcctcccttgccacctcgtccggcgagcgccaacgggtacccgctgggcggatggcttcgtgggcctcctgcgcgttcttcacacgcgagcgatactgacgcggcgcgtcggggagtgctcccgggaagcgctcggcgatgagtcgacgggcttctgcgagcgcctctccggcaagctggacggagtcggttcgcatgtaggtgatgaagccctgctcataaagccgctgggccacggccatggtgcgctgcgcggagaagcgcagttttcgcgaggcctcctgctgcagcgtcgaggtcatgaacggcgcgtccggtcgtcgcgtgaacggccgctcggtgagctcgcgtaccacgccacctcgaccctcgaccgcttctgcgaccgcgagcgcgtgcgcgccgtcgaggaccacgacgcccgtggcgacgcgaccggtcgcgtcgaagtcgcggccggtggcgatacgcgcctcgtcgagggcgaccaggcgcgcggcgaagggcgcgggggcctcggcacgcgagaactcggcgacgacgtcgaagtagctcgctcgacgaaacgccatccgctcgcgctcgcgctcgacgaggagccgacaggccaccgactggacgcgaccggccgacagtcgcggcatcaccttcttccacagcaccggcgagacctcgtagccgaagagccggtcgagcacgcgccgtgtctcctgggcatcgacgaggccgcggtcgatcccccgtgtcgccccgacggcctcgcggatcgctcgctccgtgatctcgtggaacaccatgcgacgaacaggaacgcgaggggcgagcacctcgagcaggtgccaggcgatggattctccttcgcgatcctcatcggtcgcgaggaagagctcgctggcgtcggcgagcagggccttgaggcgcttgacctgctcgcgcttctccggagggatcacgtagagcggccggaacccgtgctcggtatcgacaccgagacgcgcccacggctccttcttcaccgcttgcgggatctccttcgccgagcgcggcagatctcgcacgtggccgacggacgcctcgacgacccactcgtcgccgaggtagcgccggatcgtccgagccttggtgggcgactccacgatcacgagtggctttggcacgaaccgatttgctcctcgctaggactcctggtgggccggctcgaggaactcgtagctcgggttcatcatcgcgagccgaccctggaactcccctaccgtacccgctgcgcggatcgtcgcaccggcggcgatccccggtacctggcgacggccggggaagacgaggaggataccaccggtggcgtcctcgagccgcgccacgctcatcggcatcccatcgagcgtgcgggtgcgcaccgccgcgatacgccccacgaccgtggcctggcgccgcggcgtgcaggccgagacaggcgtggtgccgtcggtgagctcgggcgccttcgtccccaacgtggtgcggcgggccttcgccgtgaccgtcgtacgggcactgcgcgtgcggactcgatagggtacgaggatggccgtggcgtgtggcagctccccgacgacttgggagatctgcaccgccgactggtcgtggagcagcgggccgaggatccgcccgtagacacggtgcgggatgatcgctgagacctcgacgtcgctgcctgatgcgaccgcatcgagcacgacctcggccgcgcctcgccgaaggcggcgatccgggcactcgacgagctcgagctcgaggttcgccaagcctgcctgctcccactcggctcggagcgtcgtcgcctcctgtgcatcgacgacgaggtgcacggcacgcagcgcgtcgggcaggagcagcttggcgtactggaccgcccgcgccgtggcgagatcgacgcgatcgacgaacagcaacaccacgtgcgtccgagcggccggagcctcacaggccgccgccaccccctcctccagggcggcggcctcgcgctcgaagcgacgacggaaccgcgtgaacatgaagaccagcagtgggacgacgacgacgaccagccaggcgcccgaggtgaacttcgtcacgatgaagacgatgtccacgatcgccgacaagatggccgacgatccgttgacgatcgcccgccggcgccagtggtcctccttgtggatgaggtggtagcgaaccatgccgctaccggcgatggtaaagccggtgaagacaccgatggcatagagggagatcaacgaattgatgttggagttcgttgcgacgaggagcacgatcgcgatcgccgcgacgatcacgatcgcggtcgagtagaccaaccggtggccacgctcacggaagcgccggggcaggaggccgtccgtcgccgcaaacgacgcgagcaacgggaatcccgtgaacgacgtgttcgcagccaaggtcaagatcgccgtcgtcgagatgtcgaggatcaccgtgaggacgtgaccgaccgaactttggccaaaggccgcctgcgccacctgcgagagcacggtcggcgctcccgagagatacggcacggcgtgggtcgtcgcagccaggccagacaccccgagaaagagcgtgccgaggatgacgctcatccagatcagcgtcacgcgagcgttgtgcacctggggatcgcgaaagaccgagaccccgttcgagatggcttccgtgccggtgagggctgtgccgccggaggcgaacgacttgagcacgatgaagacgctggcgccgacgagaaggccaccgcctggcttgccggccgggaacgcaccgggggcgatgatggcgtagtgatggatgtggccaaccagcgcgcgaaccgtgcccaccgcgatcatgagcagcatcgagccgatgaagaggaacgtcggcagcgcgaaggtgcgcccggcttcgcgcagcccacgcagattgccgaaggccatgccgatgacgaagacgacgccgatcggcgtgatgaaggggacgagcgccgggatggcggaggcgatcgcgtcgacaccggccgccacggagaccgcaacggtgagggtgtagtcgatgaagagcgatgcggccgcgatctgcgcgagccacaggccgaaggtctcgcgcgcgacgatgtaggcgcctcccgccttcgggaaggcccggatcacctcgagatacgaagccgccacgaagatcagcaccacgatgacgaggagcgacaccggcacgatgaggtggtaggcggcgatcccgaccgccgggaccaagacaccgaggctcgcctcggtggcataggccgacgaggacatgacgtcggacgagaggatcgcgagcgcggtcggtttgccgaggcgctccgaactcagctcctcgttgatcagtggtcgcccgagcagccagttcttcagccgatagctgagcttctcggggacctcgtagctctcgagggcagcgagcggtgtgggctgcgagggggtgaaggagcgcgcgaagcgctcggacggttcctcggacatggtcacttcctcaggcgacggttcgccgctagagcctaggtgacctgcgcccgcgggcagcttcgaaccacgagggctctggaccgcgagcctgctcggtcgcacgcgcccgcggactgtagacttcggccgagcggcctgggcgccgaacacagcgaggggttggggcagtggagtcggtgcacgtcatcgtcgtcgggtgcggtcgtgtgggtgcagagctcacccgtcgactgagcgctgaaggacactccgtcaccgtgatcgaccgcaacccagacgcctttcgacgcctcgggtcggcacgagcgacgaccatcgtcgggtcagggttcgatcgagacgttctcgaggccgccggcatcggcgaggctgctgccttggcagcggtcacgagcggtgacaactcgaacatcctggcggctcggatcgccagagacgtcttcgaggtgcccaacgtcgtcgcacgcatctacgacccccgtcgagcggtcgtctacgagcgcctcggcatccagaccgtcgcgaccgtgacctggacgacggatcaggccctcgcccgcctcttcccgctgcgcatcgagcgtccgtggatggactcatccggggagctcacggtggcggagatcacactgccccccagccggatcggcaaacccatcggcgcgctcgaacgagagggcgagctccgtgtggtcgccgtcgtccgacccggcggagcccgcctggccacggcagggctcatcggtcaagagggagaccgcatcgtcgtcgccgcgagccaacgcgccctggccgaactcggcgcctggtccaacgaagtggggagctagcaccatgcggatcgcgatcgtcggcggcggcaacgtcgggcgcttcctcgctgcggacctccagcaccaccacgacgtcgtcctgttcgaacgagatcacgagctggcggcacaccttgcttcccagcttcgctgcaccgtcgtcttcggagacggctgcgagctgtccacgctggcggacgcgggcgttggcacctgcgacgtcgtcgtggcctcgaccggcgacgacgaggacaacctcgtcgtctccctgctcgccaagcaggaatttgctgttccgcgggtcatcgcacgcgtgaaccacccgaagaaccattggctgttcaaccgatcctggggcgtcgacgtggccgtctcgaccccgcatctcatcagcgcgctcgtcgaagaagcggtcagcgtcggttcgctcgtccagctgctcgcgttcgacaactcgggcgcgcgcctcgtggaggtcacgctcacggcaacgtctccagcggtccaacggacgatcgcgaccctcgggctccctcgagacgcctcggtggtcgccgtggtgcggggagagaacgtgatcgtccctcggggtgaggtgaccctcaagcccgaggatcacgtgctctgcctcgtcgtcggcgagactgaggcggcggtgcgcagcgttctcatcggcgacgaggacacgatcgccgaggccgacgcggccacgccctgagctcgccctcggctcccctacggcaccggcgacaccggtaggctccacgtcatggaggcagcgttcttcgacctcgacaagacggtcatctctcgcgcctcgctgctggccttcggagctcgcttcttccaggagggcctgatcaatcgacgcaccgtcgcgcggagcgtctgggcacagctcgtctaccgctacctaggggcgaacgaacgtcggctgcgccggttggagcgttcggtcctcgacctcacgcagggatggcaccagagcgtggtgcgacgcgtcgtcgccgaggcgctcaccgagatcgtcacgccgctcgtctaccgcgaggcggtcgagctcatcaagctgcaccagctcgctgggcgcaaggtcttcctcgtctcggcctcgcccgaagagatcgtcgagccgatggcagccttccttggcgtcgatggccagatcgcgaccaagccgagggtcgacgaggagggcacctacacgggagagatggcgttctacaactacggcccctacaaggcagaggcgatggccgaggttgcgcaacgagagggcatcgatctcgctgcctcgtatgcctactccgactcctacaccgacctcccgatgctcgaggccgtcggccacccggtcgcggtgaatccagatcgggtgttggcacgcgtcgcgcgcgagcacggctgggagatcctcgagtttcgccaccacaccaaggtgggacgccaccgagtccttcgaaccgtcggtgcggtgggacttgggatcgccatcaccgcgataccggcgacacccttcctgcgccgagcgacgcggcgtcggcgaggagtcgagcctacggacctactcccgccacccctgaggcaatgaggccgtgcacgagacgcccaccactcatcggcctccacgaattcgtatcgtcgctgacaacccgggctcgacgagcgcgcgcgagctccaggccgtcgatgtgagcgcagtgtttccgcgcctccggagcagcgtcgctgcgcgatccctcggcgcggcatcgtgtttgccccacacacctgccgccaggtcgcaaccacgtcgagattgcgtcatgcgtgctctccccgacgctatccgaacccaccaccccgcgaccgctcgtccgacctcctgagtcgaattcctctgtcgccaccgcgagcatctccgtgctcgcaaggatcggccgttcacgaccgctcacgtcgctccctcagcgcgggtgcgaccacggatgacgaccatgagttgtacatgagagcggcaggcctcgctactagcatcgtcgcgcatgaaagccgaggagcgcgttcccccctcatcgctgcagaaggcgctggcgtggatcctcgagccacggcaattgctggcactgaatctcatcggctctctcgccgctttcgtcctcctcggcacctacgagtacttgagatggcgggacttcgacctcggcattgattatgccatccagaaccagggaacattcctcattgcgcatggacatcttgcccctcgtgacaccatctacggtggcggcttcgacaacaatgcgctgacctatctcttcatcgtcatcggccttgtacggacgctcgtaccgacaggcgtgatgctgctcgtactccaagctctcgctgtcgccgccacgtacctgttcatcatgcagatcgtcatccgagtgactcggagacttccactcggttggcgtggtgctgtcgtcatcggttccgccctgctcaccttcctcaatccctgggcgctcgaggctgtgtcctttgacgtgcatggggagcccttcggagcactcggactcgtcgtgctcctgtacggcatgctccgaagccagcgcacatacttctatgcaggcctcgcactcgcgctcctctcaggggccggcacgctgatcgtccttgctggtttgagcgtgggcttgctggcgacgaagtcgacccgccgatgggggatacgtacgacgatcggcgtggtgatcatcggcatcatcgcgctcctcaccggtgactccggctcctcattctcgtcgctttatggctatctcgcgtcctcttcaggcgccacacctggcgcgacggccatcctcagatcgatcgtcgagcaccccacgcgccccgtctcggtcctggtcagtcgctggcccgagatccgcgaactgatcggctacgcggggatcattggcttggcatggccgccgacgctcgtcgctgcggtggcagcggtcgtagcgaacggactgccacagaactcggcgttcctgtccctgacgcaggggttccagaattggcccgtcgaagcagtgctcgtcgccggtggggcgatcgtggtcagccgactggccggagcgcaccatgccaaccacgatgccctctcggagggcgatcgtgcgaacggccggtctcgatggcggctcctcggcggacgagccattgtggccctctggactgcggtgagcgtcgccatcggcatcggggccctcagcacagacctcgggatcccccgcagctggttcaaccaaccctacgcgagtgtctcggccctccgagtggcgcaacgctccatccctcgagacgccgaggtcgtcgccacgatcaatgcaatcgcgcgagtgtctgctcgcgctcagctctttcagcagatcgcccccactcaggcgcagccggtctgcgcagcggtcgtcgacgtcttgatcgaagtgccagggccctatgcggtgctgacgagccaagaggcgagccacgatgtgcgtaccctccttcgtgctccgggtcacacggtgctccaacaatcgggcgtggtgcttgtccagttcgggggtctgcatcccggtcgagaggcgctgatcgtcccgacggggcaggtggtcaccggaccgcaagcggcgagcctcgacgcgtcacagtgtcagtaggtcggccttccgacccatggagcgtccgactccggcaggagcaactccagccgtttggttcgccgcgactctcgccagcgaccgcaccggcgtcccccatctgctcgacggcaccaacgcgcagcgatccatacgcggtgcaggcacgagggggctcggcgttgccggacgactgctgagcgtgggccgctagggccacgtacggcacgcgatcccagcggcactcgatcccagcgaccttgccatcagtgtccgtcgcgtgctcgattgaccctcgcaggatgtcaacgccgccggcgcgaggcgtcgctcgacctgcgccggcgggttccgtcaaccctgcctcgagccctcaccgagtgaccatcgttcgcgtgcaatcgtcgacgcgcatgcaggttcgaaggggcacccaaggcgcgatacgcgctccggtgtcggggatcgagcctcctgacgcggctcgttggcccaggtctgtctccagagcaagcgtggctcgaccaaggcgctccctgctgatgcagcgacccgtctgttccaacgcactcacgccaactgcagtgcctggctcgattggatcgagggcatccgtgcccgggctccgcagggcatctcagcaggcacctcgcgacctgcgtcagcttgcagtcgatcgagaacgagcgaagccaccggacctccagccagcagcgactgcgtccgcacggctgatcacctctcggtattgctgtggcgtgcggccacggtcgcacacgggcccgaggcgcgaatcatcggcgacgacaacctcgagggagctcgcgctcgtgtcgggaggggctctcccagaccccgacgctcgcctcgcgcgaactcccgagggttgctgaaggacgagctcgccgcccgcgcaaggagtccgagggctgctggctccacgaacacgctccaccaccagtcaacaccaagcgccagctgtcacgcgcgccagcttcagctggacactgtcctgctcgaggtcataggaacgccgcgcgtcgccgcgcactcggtcggccgtggcggaccgcgccagcgggagccgatggtcccgccacaaggccgccggtcaccctcgcgacggtctcgcctcgtgccacgggcttcactaggtcaccgacgggcaggcagatctcctcaggcctgcgacgaccatgcgttgacgtagcgtcagccctcatcaccgttgggtcgcgtcagccccggggtaccgaccggagcgaccccgttgaggagaggcgaggggttcggtgacgccgacgacggacgagagtcgagatcaggcccgtcagcgaggcgccaggacgatcacggcgactcctgccgcgacgatcgctgcggcgacgactcgcgagcgaccgcgagcctcacccatgatcgcaccggccagcgcggcgatgaccacgctggtctcgcgcagtgccgacaccaccgcgagtggagcgcgctgctgcgcccacagcaccgcggcgtaggtggcgtaggagagcacaccagcagctgcccccaggccgagggagcggacctcgggccgagtatgcgcacgtcgcgctgcgagggccgacacggatgcgaccacgctcccttcgagcgcaaagagcagaccggcgtaggcgaagggatcggggctgtggcgcacgccgagtccgtcggtcagcgaatagccagcgatcgtgacgccggtcgcgagcgcgagcagcactgcccgcagaccatggtcgcgctgcggcctcgcaaggagcgcgatcccaccggcgaccacgaccacgcccgccagctcgaaggtggtcagtggctcgtggccgatggcgagggcgccgatggcgaccagcaacggcgcgctgccgcgcgcgagcggatacacctgcccgagctcgccagcggccaacgaggacccgagcaagaggttgtaggcgacgtgaatggccgaggagccaaccgcgaaggcgatcgccgccgctggtggtgggccgacgaccacgagcgaggcgatcccgatcgcggcaaccacggcgttgatggtcgcgacggcatcacgaggtgacggtgcaagcttggccagtgcgttccaggcggcgtgcccaacagcggccccgagcaccaccgcgataacgacgagcatcacaccagccacacggatacgtgcacatgcaaccagtttgccgctacactgagggcgtgaccatgccaacgctgtatctgggacatggagccccaccgctcctcgatgacgcgcgctgggttgccgagctgcgcgagctggcgagccgcatcgatcgtccgcagagcattctcgtggtctcggcccactgggaagctcgaccagtcgcgctgtcgtcggtcgtgggcgccccactcgtgtacgacttctgggggtttccggagcgctactaccgcctcacctatccggcaccggggtcgccagacctggctgcactggtcgaggggcacctcggggctgcgggccactccgtggctcgcgacgaaggtcgaggcctcgatcacggggcatgggtcccgctgctcgccatgtacccggaggccgatatcccggtgctgcagctgtccctcccgagtctcgatccagaggaactctacgccgtcggacaggccctcgcgccgctgcgcgacgctggggtcctcctcatcggcagcggcttcttcacgcacaacctccgtgcgctcggacaggttgggcaccctgacggccccccgcccgcctggtccgtagagttcgacgcctggggcgccgaagcgctcgccgacggcgagatcgatgccttgctcgacttcgaacatcgagcgccggctgctcggctcgcccaccctcgcaccgaacacttcgctccgctgttcgtgaccctcggcgcgggcgaagggacgcccgtcgataccgccatcaccgggttctggttcggcctctcgaagcgcacgatcgtccttgcggaggcaccgatcggcgaggtgacacagcacgtctgagcccacgcgcctcgcgtcgagccccgcgcaacgagcaacctccgccagcaagcccgctcgaaacctcgtgtccaacgggacgtcaccagctggctgatggacctctaaggtacctgtgtgcccggcggattcgtcgctgccctcggtctcgctgcgctcgccgcgagcgcacccacctggatcggctcgatcccagtgggtcgtggcgcggcactgccaccagaaggcatcccgtcaccggtccagccgctcggaggcatgctcgcccatgctcccgcgtgccggtggcgcatcgccgccggagagcaaggcgccacgacagccctcaatgcgctgatcgcacgcgtcgagaaccgactgacccggcctgcagcactctgtgtgtcagggacgttccgccagccgatcgtcgtcgagggcaagtggcgtccggctgcgctctggatcgaacctgcgcccggcaccacagcactggtggcgccgggccgtcttcgcgccgccgacgttgcccacggcgttcccgacggcacggtagcggcggtctcgatcgtcggctcgacgggcgtcgtggtgcgagggctcgtgatcgaccacgtcaccgccgcgagcggcgtgacgccagccggcatcgcggtggaggtcgcaggacccaaggagggggtccgagtctccggctgcctcgagcgggggagccgacgatgcggcgacgttgcgctcgtcgacgacaccgtctcgggagtccgtgcacccggtgacgtctggcccccgacgctggccgcgtgtggctccggatccgtcgatgcctacggcatcgaagtcttcgacgcggcgacgacaccgcgggccgccctgaccaacgtggtcctcgccggcgatcgcgtcgccgacgcgcgcctcggacagagcgaggccatcgcgatctccggtgacgtcgccgacgcactcgtcgagcacacgagcgtcctcggcgtcgacaacatcggcatcgacgtcgagggctactacggcacgacggcccaccccaacgacgtcgcgctcgtcgacgacaccgtcgcagcggtcgactcgtggacgaacgcgggctacggcgttcgcgctcatggccgatgcctccccacgccaccggcggcggccgggatctacgacgacggtgcgacctcgctcgtgatcgcccacgaccgcgtactcgacaccaaccaaggcgtcagcctcgacacggagacgaaggatcacgcgaccagcaggatcgtcgttgccgacacgacggtggtggacgctccgtcgctcgcgctgcccgccggaacgacatccgcagctgaaggggccgacgtggccgggtccatcagcgacgccggtcgggccttcgatgccttctacgtggacgccttcggaccgcggacctcgatcgaggacgtcgtcgccagccacgacacgttcgtcaatctcagcacgttctggatgcgtcgcctcacgagccaggccgcggtcatcgtccttgggggtcgctatcggtcgatcgagcttcgatcgcttcgcgcacgatcaggaactggcccggcggcacccataccgctccagttcgatcgcctgccgatcgagtggtcggggatgcggctctgcgacctcgcgttcacgggtggtcctgccggtaccacggtggagacgccgacgaccgcggcgacgtcgatcgccggagccttcaaggggctccctgtccccatccgatccgcgataacgtgcggcggccaagcgcgcccgtgacgtggcgctcgaggcgcgcgtcaaggcaccgagtgcctcaacgagcaggtgcgacgaccctgagcaccggccctccgtcgcacgcgtcgcacacgccaaggccgcggcccagcggctagtgaatcagcgcgacgatgtcctgcacgactaggtacgtcacgagcgcgatcacggcgaggtagatcgccgtcatcgaccagcgccaacggtgacgcgcgacgtggaagcgccgaatcccccgaacgtcgaagatcaacgccagcaccccgaccgggatcccgatctcggggccgaaccccgccaccgcgccgaggcccagtgcgggcagcacgaaggggatgatgacgtagctcaacgtgcaacggagcccagacaggatcatcgcgaccgaaaagagacgctcagcggcctcctcgcggtccgatgtcgacgtcggctccgggatccgcagcagccggcgcaccactcggtccgcgcgactgtcgctccgcgccccgaccggacacgccgtggcccgaagcgccgcgtgatcaaccgggcacgcacgctgctcggccgacgagagagccccccgagccgaggcggtgtcgatcgccggctctcgagcagtatccatgctcccagtgtacgcgagccgcgcacgtcaccagaaaccggcctcgtcgggctctcagggatcgaccaccgaaccgaggtcgtcgatgccccgatagcccggcagcgctgcgagttcgcgatgcagttcgtcgctcgcaagggcggcatcgagcgctcgacgcacctcctcatcgctcggtgccacctcgcggctcacggcgaggaagaagcgctcgtctgcgagcggcgcaaagtagagtccgaactcccgcgccgcgggctcgaggacgacgcccgtggtcgcgactccggtcgcgaccgcttcggccaccatgaggtgagaatcgacctcggtgtcccaaccagggacgcgctcgggcacgatgccctcggatgcaagccagtcagcgaggagggcgcgcgcctcagaaccaggctggcggttcgcgagccgtccctgcacgagttcgaggggacgagtcgcgtctcgagcgcgcgacaccagcccctcgcgccaggccgcaaacgatcgcacctcgataccgggcggcaggggcggcaaggagacccgacccgatggatcggtcgccacgtggaagcccgctgcgtgcacgagaccgtccgcgagcgctcgcagcgcggcttcggagggcgccggccaccagacgagctcgaccggccgagggcggtgcgcgagaggacctgcgagcagcaacagcgccggatcgcaccccgcaaccacgaccgcaggcgcagggcgcctcgtcaccgtggcccgacgagggccgagcagccgagctccagcgggatgaaatcccggcacgatgccgtgctcacccccgcgcggaaccccgacgagtcgatcggcgacccgcgcgacctcgatccgctctccgaccgcggctgggccgacgagctcgatcgcctcctcgcgcccagcaccgctcgtgtcgaagagttcctccacgctcacgccgaagaagcgtgcgagcgccatcgccaccgggagcgacggttcgaaggctcctgactcgattcccgcgaccgcctggcgggagatgccgagtgcgtcggccacctgctgctgcgaaagcccccgcacgcgacgcagccgccgtgcgatctcgctcacgtccggaccttctgatcgaagaccaccgcgtccgtaagtgccacccatccctgcccgagcggccggtcccatgacgtctcggcgcgcagcgaccccacgccgtcgaccgaaacgagctgctcgaggcgtcctcccaccacccgcgcaggctcgaggacccgcgctggggccccgatcggaccatcaggaccgtcggcgaggtgcagtgctgacggccaggcccacgcctcgccccaccgacccacgaacggccccaccataccgagtaagcgcgcgacacgagcgctcgcaggctgtcgctgcacctgggaggcgggcccgatctggagctgcgccccgtcgtcgagcaccagcagcgtgtcggcaacgcgcgcgatgctcgcgaggtcgtgatcgacgacgacgaccgcacaacgcgtcgcactgtcgcggatcgcctcggcaacgtcgtcgacgagctcgtggtcgagaccggccatgggctcgtcgaagaccagcacgctcggacgcgcggcgagcgcacgcgcgatggcgacccgacgagcctgcccaccggagagggtgccgaccgagcgatctcgaagggtggcgaggccaaagtatcggagcaactcctcgacgtcctcagccgacgcacgacgagagaaggccacgttcccgaccacgtcgaggtgtcgaaacagcgcggtgcgctgggggacgaggccgaccccacgccgctcgagcgcgacgcgcacacccggactcgacacgatcgtctcgccgacacgaatccacccttcggcaagaccgacgagcccggcgatcgcgtcgaggagggtcgtcttccccgcgcccgagggtccgaccaccccgagcaccgacccctgagggacctcgaaacgacagcgcagcgtgaacgagccccgtcggacagtgcagtcagcggcgagcatgtcgccctcgagcgtacgcgaggagcgggaacggcaacgccacgacgagcaggaccacggcgtagggcaacgcggtggggagcccagtctcgttgagtgtggtccagatctgcatgggcaggccgtaggggtgatacgccacgatgatgaccgccccgaacgcaccgatggctcgcgcccaggcgatcgagagggcagtcgcgagctcgcccgcgacctcgggcaccatcgcgcgccagaaggcgcgccacggcgaatcgccgaggagccgggcttgcacgacgacgtcgtggtcggcggccgcgaacgctgcagctgcagcaagcacgaagtacggggcagcctcgtagacctcggcgatgacgagcgcagtgaacgtgttcgtggcatcgagccccactcgcgcgagcagccccccgatcggggtcagcggacccaccatgaacacgaggagcaggccgatgacgagcggcggcatcaagagcacgaccagcaaactcgcctcgaggatacgagcgacggcgccaccgcgctcggcgatgacgagcgcgaccggcgtgcccaccgccacgacgatgacgagcgcgaccgcagaggccaaaagtgacgtcccagccggaccgagggcgtccggtgcactgagggcgaccaccagcgcgtgcgggcccaggtgccacagcagcgtcaggagtggcccgagcagcaccacccatgcgacgagccccccggcgaccgccagggcgctctgggcgatccgaagcggctctctagccgtcggcgcgcgcgacagcggtgcgaacgacatgcggaacaccggtccccgtcacggtgggccgcagcagggtgtagccacccgccgcgagcgcctccctcccagcaccatcgatcacgtagtcgacgaaggccatcgccgcgccctggtcgtggcgcccgagagtcgtcaccgcgagcgtgagcgcgtgaccgtggacgacactgccatcgggaagggtgagcgaggccgtcgcgtacgttgccgcgtccgccggatcaccgaagtcgatggcggcagggagcgcaatgtagggcaggtggagctggatcgcctgggagcggaaggcgctcgctgcatcgagctgaccgctctcgagccgagcctcgagcgacgtctccgaatacacctgcgacgggttctcgaggctaccgagcacggcgctcgtcgtggaagccggaaggtggtaccggacggtggcgagttcgaccatctcgtagaacgcttgtccctgggggtcggtggccgggttcgtccgtccgagcaggaagccaggcgttcgcagcagactgaacagctcagtgaagggagctcggcccgctgcgatcgcagccagacgaggagcaaacgacgtgtgggggttgtacgcgaggacgatcggactggaggccaccgtcacgtaccaacgagtgaagcgcggctcgagttcggcgatgggcgccccgccgatcgactcgaacacgttcgggctgatctcgccggcgatgatgtcatgggcaagaccgaaggatcctccgccgcgtccttcgtagacgtcaccggtcgctcgggcgaagtctggcccaatgacgtgctcgttgaggtactcgagcgagccggcgtaggcaacgctcgcggtttcgtgcgtgtgcgaggcactcgcgtgctgcgtcgagccacaggccccgagggcgacggcggcgagcgccatcacagtggcctgggcggttcgcgtcgttcgcatgccatcaaagctagcacaacgccagtcttactggcaacgcgcgtcacgcccgcgccgtccgcgacgctcggcgcgtagactcccgccgtgcaccccgcaagcgagcgacgacgcatgatgggcgagaccatcttcgcgaccatgtcgcgcctcgctaccgagcacaacgccatcaacctcgggcagggcttccccgatacgcccggccccgcactcgcgatcgaggccggcgtacggagcctccgcgcgggccacaaccagtacgcaccagccggaggcgtgccagagctccgcacgcgggtggcctcgatctggagccagcggctcgggcgaccgatcgacccgctgcgcgacgtcacgatcacggtgggcgcgaccgaagcgatcgctgccgcctgcctcgcctggctcgagccaggcgatgaggccatcgtgctggagcctgcctacgacgcctacctctgggccgtacgcatggcgggagctacgccggtcggggtcgatctcgggtccacgatgcgcctcgacgcggagcggctcgaacaggccatcacgccgaggacccgcatgctcatcgtcaactcgccgcacaacccgagcggtatggtcgtctccgacgaggaactcgcggcgatcagcgccgttgcgacccgacacgacctgcgcgtcctctccgacgaggtctatgagttcctggtctacgaaggcagccaccgctcgatcgcgaccttcgacgcgatggccgatcgcaccgtcgtcgtctcctcggcagcaaagaccttcggcctgacggggtggaaggtcgggtgggcgatcgggcctgccgacctggtgagcgaggtgcgatcgcaggcgcagtatctgacctatgccggcgccaccccactgcagcacgccgtggcggacgcgctcggcaatctcgatctcatcgtccccctggtgcgcgatccactcgcccggcaacgcgacgtgctcgtcgacggcctcgccaagctcggcttcacgccactcgcgacccaagcgggctacttcgtgctcaccgacctcggccccgtcgaggccgagaccgccaccgaagccgccctcatcctcgccgagcgtgccggcatcgtcaccattcccatcgagcccttctacgtcgagccggagcgagcgccactcgtgctccgctggagcttcgcacgccaggcgacgacgctgcgtgacgcactggcccagttgcgtcgagccgccgaccggggtctgctcgcacccaagacgcgctaagggagcacgcgacgcccgatcgagcgcgaggctcggccctcgtggtcgagccggctagcgctcggcgtcgcgtcggaccacggcgaccagcgacggggcgacgtggccatgatcggcacggtctcgaacgacctcgagcagttcgatcgaccgctccggaaactgcgagcggatctcgtcctcgctgaggagccgatccggatccggaggaccagcgatgccgaccccgtcgacgtggtggccgatgatgacgagccgccctccggggctggcgaggccgaaggcgagcgcgtgcagtcggcgtcgctcctcggcaggcggatggatgttcgcgagcagcacgaggtcgaactggaggccgagctgggcaaactcctcgatggtggcgtgttggatcgtgacagccagaccttgctcctcggcagcgcgggcaaggcgctcgagcgcgacgtcagccacgtccaccgcggtcgtctcgatcccacgagacgcgagccacagcgcgttgcgcccttcgcctgcgccgagatccactgccgatcgaggctgcactcgttcgacgatgcccacgatcgcaggatccggctcgccgatccagagtcgatcattctctcggtagcgagcgttccagacctgccgcatcgcttcgtccacggcgcctccttcgtccgagccccgggtcgaggctaccgctccctcgctccgagcacgtgtcgcccccatgacctaccatgagcccgtgctcatcatccacacctccgactggcagatcggcatgccagctcggaccatgaccgaggaggctcgccaccgcttccgccacgatcgtgtcgacgccgccgagcgtctcctcgccgaggcgagctcgcgtggcgcgtgttgcgtcatcgtggcgggcgacctcttcgacgacaacacgctgtcggaggaccagatccaacgcacgctcggcgtgatcgcgcgccagcagctccctatcgttgccctccctgggaaccatgacgccctcgagccgcacgccatcctcgcccgcgacgatctccccgaccagctgatcgtgctcgactcttgggagccgcgcaccgtcgttccaggactcgaggtggtcggcgccccgtggcgctcgcgcatcccggggcgcaaccccgcctgggacacggtccgcgccctcgagtcctacggtccgccacccgccgggacggttcgggtcctcgtcgcgcacggtcagtgggagcgctacgacagcgtgaccacccattcgacgctccccgccgatgagatcgtggccgccctcgacacggggctcatccactacgtcgccctcggcgatcatcactcctaccagatcttcgtcggtggacgcgtcgccttcagcggaacccatgaggtcaccgccgcagatgagcgcgacccaggctgggcacttgcggtgaccctggagccgtcgcacccgccagcgatcgagcgaatccgcgtggggagatggcgcatcctcacgctcgcggagacggtcaccagcgccgacgacgtcgcggcgatcgccggtcggcttcgcacgctggaggatccggcacgctgcgtcgtccgcctccacctcgacggcacgctccctctcgcggcccgtctcaccctggagcagaacctcgaggcagccgctgccgccctggccggcttcgagctcgacgtcgagcgggtcgcgagcctgtcggatgccagcatcccggccgactttcaccttcgaggggccgccgccacggccttcgaacgcctcctcgacgaccccgaccccgtctcacaggcagcgctgcggctgctcgcgcgactcgccctcgaggggaacgaacgatgatgcgtctcgtccgcctccgtatcggcgaggcccgccacctccggggcctcgagctcacgttgcgaagtccggggctcaccatcatccacggccccaacgaggcggggaagtcgaccatcgtcgcgtgcctgcggctgctgctcgcgaccccctccacgtcacgtcaccgcgaggtgcaagcgctggccggcccgtctggcggggtcgaggttggtgccgtctttgcgctcgacgacaccacggtcgagctcacgaagcgctggctcacccgacctctcacacagctcgtcatcgccggcgcaggacagctcgatggacgagaagccgagacgcgcttcgccgaattgctgacgactgcgggacttggcgagggtgctggcgatccgctcgtgagcaccctcatcgacaacggagcgggaactacgcacctcgccgcgagcaggatcgtggccgaagccctggagcgacgaagtggcgaggaggccttggtcgatcccgggctgcttgcccgggctcgcaccgagcttgcccgctacgagacgcccggacgctcccagccaaccggggacctccgccaagcccgcgacgaactcgaccgcaccgaggccgcctacctggttgccaccgcagacgtcaacgccgtggctgaggcgcgccgggacctcgagacgatcgccgagcagctggcgacactccccgacgacgaggctcgcctcaaggccgaacaggacgaacgtctccgacgccgcgcggagctcgagggcctcgacgtcgaggtcgagcgatcgtcgcgccgagtcgccgacctctccgatgcgatcgcgcgagagctcgaggccctcgaacgtcagcgtgaactcgcgagcgcgctcgcacgctcgcgagaacgcatcgaacagctcgatcgcgacctcgaggagcggcgcgagcagctcacgcgggtgcaggcgcaactcggtgcttcgcacgacggcctcgaccaagctcgacgtgagctcggtgagctccgcgagacccaggcgcgcgccagggagcgcgaagcgctggccagcgtcgctgcaggcgccgaacgtctgagcgcccaggttgcgagagcagtggagctccgcaatcgcgtcgccgccctcgagatcgctccaccgcgcaggctcgatgacgcactggtggcgagcctccaggaggccgaggccaggctcttggccacgcgaaccgtcttcgagaccgtcggacccagcctcaccatcaggagcgagcggtcggtcgaggtcgtcgtgaacggggacctccaacggctcgagccggcccacgcgatggtgcgaccgatcgacgagcgtatcatcgtgtcgctcggggacgtcaccatggagatctcgcccggctcggcggtcagcgaactcgaggagctcgccgccgaacgcacccgactcctcgcaagtctcggtgtcgcgagcctcgacgaggcgcgcgccctcctcgagaaggctgcccagtacgaccacgaactggaccagctgcgacgcgagctcgcgaacctcgctcccgacggcatcgagcccctcgacgacgaggcgactcgcgcccgtgctgcagcctcgagactcgacgacgcccccgagctcgcacccagcgacgagctcgagcgacgagtcagggccctgagcgatcacgtcgaggcgctcgaggccgctgcggaggaggcacaagtcgccgaacgccggtaccacgaggacctcgaacagctcgtcggcgcacgcgagcgtgaggccctgcaactcgaacaagcagagcgcgaccttgccgcagagccagccgagagcgatcgcgtcgcgcgcatcgaggacctcgagcgcgaactcgagacggagcgccatcggcaccgcgaactcaccgacgccatcgagacccggaaccatctcgacgaggagctggaagtcctcgccaccgagcttgggggcctctcgaaccgaagagccgagctcaccacccaacgacgcctcctcgaggagcgcctcgagcgcgccacaggactcgccgaccgcgtcgtcaacctcgaggagcgcctcgaagggcttcgtcgacgagtcgccgtgctcgagggccagcgcgcggccgcacgacggcttgtcgaggtcttggaggaagaacagcggcgtgcgcgggagcgaaccgaagctccgtatcgacagctcgtggaacgcatcctcaccgccacgctcggcgagcgcgtggaggtgatcctcgacgaacacctcggcgtcgagagtctgcgacggccgacgagctcgcggacggcgcttgcgacgacgccgatcgccgcgctgtcggcaggaacccgcgagcaagtggagctcgcctgtcggttcgcagcgacccagctcactggcgccgtgcccatcgtgctcgacgacgcgctcggctactcggataccacgaggacgcgcatgctcgtcgcacagctcaccgcactcgcgaccgacgcccaagccatcgtcctcacggcccaccccgaacgctacctcggtgcgagcgatgcggaacgcatcgatctcgcgcgtagcaccgagtcctcttcggacaccgcgcgtggcacgtcgccacctccgaccggagcggcctcagaggcgtcgctcgaggacgcggtgcgctcagttctcggcgacgccggtggaccgctcaaccggaacgacatcgcatcccggctggatgcagacccagatgccgtcgcacgggccatccggacgctccgcgatgccggtgtgatcgagcagatcggacaacggcgaggggcccgttaccgcttgtgcgagcgtgatcggacagacccgcacgccacctgatcctcgcaacgtggagccgcgccggagcgcgaacacgccaatggccctgatcgcatcggcggagctgcaacctcgcccacggtggctgaagcgctccagcgacccagcgcgaggtgagcgcgcttggcatgccaatgctgaagccggcgaggatctctccatgagcgaggcacgacgaccgctcctctccggatgacatgaagagaacggtgcccatcccgcctcgcgcgagcgccgtcgccaagggccgctgcccgtcgctgcggtggcgccagcgagccgaacgcgaacagcatgagtgcacgggagagcccaaagggagccgatcatcagcccggacacgcttctcctgcgagccaccagcctgctggtccgcgccatgcaacctcggcgacacagcccgcaagccgtcggccaacagcgccacgcccacgctcgggcgaatgacgaagcagtgcacggcaacgactcgaggacaggctccgcacgggcactcacgactccagatctactgggtcgccaccagcgagcttggttgagggctgcggggcggggggctcctcgtgtcctcacgacccgcctgcccctacgactcgagcgcctcccgaatggtgttcgtggcctcgcgtgctcggttctcggccgccacggtgaggtccgcgtggcgataccagacctcgttcgcaccctcgcgccaggtcaccgtcggggtctcgaggagctcggggtcgacgttggcggcgttcgcctggacgaagtccacgagggagtcgatgagggtgtcggcgaggtagtggggttgcagaccgaggtcgagcagggccgagtgacgggcgttgtagtagtgctcttccttctcgatgcgtgggttgtcgaggtggacgatggtgggctcgaggcctcggcgtcccaggacgcctgccacggtctcggcgagctcgttcagggtgaactgctcggtgaactggttgaagacacggaactcaccaggggcggccgggtgctcgagggccagggtgatgcaggccatggtgtcgcggatgtcgaggtagccacgggtctggccgccacggccgtagacggtgatggggtagccgagggacccttggatcacgaagcggttgagggcggtgccccagaccgagtcgtagtcgaagcgggtcgcaaggcgcgggtcgagcaccgtctcgtcggtggcgacgccgtagacgacgccctggttcaagtcggtggcgcggaagttccacacccgcgtcgtgaagtggatgttgtaggagtcggccaccttggagaggtggtagaagctgtgcggcagcttcgggtagggcaaggtgtcgctgcggccgttgtgggtgatggtgaggtaaccctcttcgatgtcgatgttcggggttccgtactcacccatggaaccgagcttgacgaggtggatctcggggttgacctcgcgcatggcaaagaggatgttgaggttgcccacgatgttgttgacctgagtgcgcaccgcgtggtcgcgcgagatcatcgagtagggggcgctgcgctgctcgccgaagtgcacgagggcctctgggtcgtgggcgcgcatggtctcgaggacgaagtcgtagtcgcagatgtcgccttcggcgatgcggatgggggcacccttgccgagggcgttccaggtctcgacgcgctcggtgaacgaggcgatctcgttcaggggacgggtaccgccttctgcgtcccaacggcgacgggcaccgttgtcgatggcgagcacgtcgtgaccttgggccgcgaggtgcagcgccatcggccacccgatgtagccgtccgcgccgtagacgatgatgcgcatggtggtggtcctcccttgagcgatcgtcattcgttcgtgtccaaggcccgaacgaatgcggaacatcagtttacgaagccaacgaggccgaggcgccgcgtagatgtgagcggttgatcagggccgcttcctcgtgcgaccgagtcgcacgaggaagcgtgtgagtgtcgacggtgttggtacgccatcatgacttctctcccacatggtgcacttgcgcttcttggatccggcgagctcgctccgtcgatggtcgcggtccatcgccagctcctcgccgagctcgacccaccacggccggtcttcctcgatgcaaccttcggcttccaggagaacgccgacgaactcgtcgccaaggcccaggagtacttcgacgtaagcctgcatctcccactcgaggtcgcgagcgcgcgtcgtgcgagcgcgctgagcgcactcgaacgcgggcggttcctcgagaccctcgcctggggcaactacctcttcgccggacctggcagtccgagctacggcttggctcagcttcgcaccgcgggtgcaggacccgtgctgcgtgagcggcttgtcgacggtgccaccgtcgtgctggcatcggcggccgcactcaccgcaggtcgctacacaatccccgtctacgagatctacaaggtcggcgaggatcctcgatggctcgacggtctcgacctcctcgatgccttcggcgtgacggcagcggtcgtccctcactacgacaacaaggagggggcgacccacgacacgcggttctgctacatcggcgaacgtcgccttcgtctgctcgaggaccagctccccccgggcgtcggcatcctcggcatcgacgagcacaccgctgtcgtcctcgatggctctggcaaagtgcgggtgctcgggaagggacgcctcgtgcttcgcgtgcgcggcaacgagcatgcgatcgcggccccggcaacgctggcgctcgacgaactgcgcgaccggctcggcgccacagatcacccacggccaggtgacaccgcctcggcatcggcggctggcgaccttgcggcactcgacgaggccatcgaccgaggcgagatcaccgacgcccttggccagatcgcagcactcgtcggcgtcgacgacgaccgcgtcgtcaccgggctcgcccggctcgcccgacgcctcaccgacgggctcgtcgaccgcgaagcggccatcgccccggttgtcgaagcgatcatcgcacgacgcgaagcggcgcgagctgcgcgcgacttcgcgctcggcgaccacctccgcgacgcactggccgccggaggtgtcatcgtggaggacacgccagagggtactcggtggcggctcgcagaggtcgtacactgatatagcgacaggcgtgcccccatcgtctagcggccaaggacgccgccctttcaaggcggtagcacgggttcgaatcccgttgggggtgccagttcgcgttccgagccgagacgaggggtgacgcaggcgatcgagcgagccgacaatgcggtgcaacagcagcacgtcccacgtaggtcgaatcgataggttccatcgaggcgatggtggcacgagtccacacggctccgccgacctcaccgcagccgcatacgacaggcccaacgtcgatcggagcagcagccagcacaaacagcttcggcctgccgtcatgcgcacctcgccgccaccctgtcgcagcgagacccagtcgatatcgatccaacgtcgtgtgcatggccaccgtgcattgcgctcggtcacggcttgcagggccaacctcgaagagcccccgcgagcgagcagatcgacggctcgatcagtcacacgagctggagcgaggaatcggcgggctcgcaccacgatcgcaggccgcggtgcacctgccacgccgagagccgcagatcacaacccgatcgccttggaacagaccacgcggcgccgaccacgcgcgtgcgccctcgccgcccgcgatggagcgtgcctcggcgaacgagcgctacagtgaccgcggcacggcatcgtgcgcgccgagttccgtcgcagaggactgggcgcccatgagtgcgaatcgcacgatgaacgaggtagtcgtgacgggatccctgacgaacgacacgcgcagtgatgatgctgtgttcaccccacgtccgtgtgaacacgcacgatgatcgatctccacctccactccaccgcctccgatggctcgaacgaccctgcggaactcgccgggatcgtcgccggtgccgagatcgtcgccctcaccgatcacgacaccgtcgagggcatcgccgcgtttcgcgaggcgctctctggcacgagcgccttcatcgtcggggcggagctctccctcgcgacgaccacgggctcgttgcacctgctgtgctacgggactggactcctcgggcccgctggcacgtcgctcctcggcacgctcgccgacgatcgcacccgtcgcaacgagcagctcctcgcacgtgccgcagcgaacggactcgacgttcctctcgaagcggtgctggctgctgcgggagcgacccggctcgacgagaagagcgtcgggcgcccgcacgtcgcagcggtactcgtcgaacgcggctacgcccgcgacatccctgatgcgttcgatcgctacctcgccaagggtcgccctctgtacgtgccgaaggcacgccttcgcttcgccgacgtgatcgagccgctcgctgcgatcggtgtggcgacggtcgtcgcccacccgctcagcctcgagctcgcgcccgatgcactcgaggaccacctgcgcacgctccgtgacctgggtctcgtcgggctcgaggcgcactacgccgcctacgcgccctcgacccgcaccgccttggccgagctcgccgaccgcctccacctcgtcgcgaccggcggctcggacgcccatggacgcttcaaggccggcctgtccccgctggtgggctacggcgacctcgatgtcccggtcgtaagtggcgaggcactcatcgacgccatcgcgcgcctcggcggccatgccgacctatactgatgacgcccagggcccgagggcccttcgccccaccggggacctgtggtgcagctcggagtgcacgccggcctgtcaagccggaggtcgcgggttcaaatcccgtcaggtccgctgagcacgtctcgcacgtgcatcgggtcggatagctcagttggtagagcgcacgcctgaaaagcgtgaggtcaccggatcgaaaccggttccgaccaccatcgtcagagcgtgcgacgaccccttcgtcgctgcctcgatctcccgctcgacgagtgagcgctcgagcgaaacgtgcggtctcgcggccccagcaacgctcgctcaccgccaagctcgctcactgccaacgtgtcaggtcgcggacacgacggccaccaggtcgcccgcttcgatcgtgcacgatccccgacacctccgcgcgcgcaggctaggctcggggtctgcgatggatgaccaccccacccacggctccgagcaaggctccgaagccgaccacccagaggaagcctgtggcgtcttcggtgtgctcgtcgcgtccgaggacgagcaagcctcgttcgccgtattcgacggcctctatgcgctgcagcaccgtggacaagagtcagcaggcatcgccgccgtcgacgacggtcgtatcacggtcgtgaaggacctcgggctcgtggcgtcggtcttcgacgaggcgaccctgcgtgcgctgcgcggtcggctcgcgatcgggcatacgcgctacgccacggctggcgaccgaggatgggagaacgcccagccgctcctccacgaccacgccggcgcccagatcgccgtcgcccacaacggcaacctcaccgacccgcctcagacgccagcccccaacggccggatcccttcggacaccgaacggatcgccgcggccgtcgccgaggccctcggatcggcgacgacgccagcggccgttgcggaagccgtcgcgcatgccctcgcgccccttcatggggccttctcgctcgtcatgaccgacggccagcacctcatcgccgctcgcgatcgccacggctttcgccccctgtgcgtcggccgcttccccgatggcggttgggtggtggcctccgagacgcccgcactcgacgtcgtgggcgcaagcttcgagcgcgaggtggaccccggtgaggtcctcgtcatcggcgacgacgcccaggcgagctcctcgctccccggaccccacttccagcatctgtgtgtcttcgaattcgtctacttcgcgcgtcccgatgccaagctgctgggccgagaggtgcacggtacgcgccgtcggatgggcgagcatctcgcgcgcgtcgcacccgtcgaggccgacatggtgatgggcgtgcccgactctggcatccctgccgccgagggctacgccctcgcctccggtatcccctatggccagggactcgtgaagaatcgctacatcgggcgcaccttcatcaaccccggggctgcgcagcgccgacaggcgatccgacggaagctgaacgccctcgaggacaacgtccgaggcaagcgcctcgtcgtggtcgacgactccatcgtgcgcggtgcgacgacacgtcagctcgtcgccctgctgcgccaggcgggggcggccgaagtccacctgcgcatctcgtcgcctccgtaccgctggccctgctactacgggatcgacacgccgagtcgccccgagctcatcgcctcccgcctgtccgtcgacgagatcgcccaagaactcggggcggactcgctcgcctatctcccgcttgcgcacctgcgagacgccgttggcgtgacccatggctgctgcgatgcctgcttgaccggggcataccccgagacggtcagcgaagcggcagccgcgggtgcgggctcgcggtgagccgagccgccgtcatcgctccagcgcccacctgacacctcgaacctgcgccacgtggccactagcctcggcgccgaggaggccactgtggagtaccgcgaggcgggagtcgacatcgaggcggcggatagcgcggttgcgcgcatcgctcagatcgtcgcccggacgtttacggaacgggtcgcgagcccgatcgggggcttcggcgcgctctacgagatcggcggcctcggtggtgcacgtccgaccctcgtcgcgacgaccgacggcgtcgggacgaagaccgaggtcgcccgggccggcgcccgctacgaaggactggggcgcgacctcgtcgccatgtgtgtcgacgatctcgtggtcaccggagcaaccccgctcttcttcctcgactacctcgccctcggtcgcgtcgagccctcgctggtggcattgctcgtcgatgccatggcagcggcactcggcgaggtcggggcgtcgctcatcggcggtgagatcgccgagcaccccggcgtgctcgagccgggtcaggtcgatctcgctggcttctgcgtcggcatcgtcgatggcgacgcgacgctcggatccgagcgcgttcgcgctggcgaccgcgtcctcggcctccgctcgccgaacctccgctcgaacggcttctcgctcgtgcgtcgcgtctacgcagacgtcctcgaggcggtggcacgcggtgagaccggaccgctcctcgccgacggccgacccctctacgacgccctcatcgagccatcggtgctctatgcccccctggttctcgagttcgcccgcgccggcttgctgcacgccgccgcgcacgtgacaggcggcggcctcgccggcaacctcgtacgggtgctgcctacgggcctcggcgtcgaggtcaagccctgggcctggcccgagatcttccgtcggctcgccgacgacggcgacgtctccctcgaggcgatgcgggccaccttcaacctcgggatcggcatggtgctgatcgcgccacccgatgcggcgagcgcgctccgcgagcgagtacctgacgccgtggacctcggcgtcgtcgaagcgagtgacgaaggagtgacatggtcgaccaccgtgccgtcctgatcgatgccctcgagacctacgggatcctccgaggtagcttcacgctcaagtccggtgccacctcgacctggttcatcgacaccaagcgtgcgatctgtcgaccgatggcactcgctgcgaccgcggaactcgcactcgaggcactcgatcccaccgtcaccgccatcggcggcctcaccatgggtgccgacccggttgccttcgcgaccgcgacgctcgcgcagctccggggccgcgcgctgaaggccttcagcgtgcgcaaggagcccaaagcctacggccagggaggggccattgcgggagcgctggaccccgacgacgtcgtctgtgtcgtcgaggacacgccgacgcgcggcgtctcgctgctcgcggcgatcgacgcggttcgcgaggtcggggccaccgtgtcccaagccctcgcggtcgtcgatcgcggaggcaccgccgccgacgtcatcgccccgactcccttcgtcgcgctggtccgcgccccggacctcggcctgccctacgaaggcagcgacagagcgtcttgacatctggcggcattgagcctagagtccgcttgggaggtgggtgtcgtgcgagtgagagcgtcgtcacggggaacatgggctgcgcggatcggtgtcgtcggcgccctcgccgtcgccgcagcggcctgcggctcctcgggcggggcaagctcgtcgtcgtcgtcgagcaccccgaccgcttcgttgccaccgtcgcagctgctctcggacgcctccgccaaactcgtctcgatgacctccttccgcttcaccggatcggggaacgtggcgaccccggcctcggcgagtgccccaagcgcgggatcgacgaccgtgaccccagccggctacgcgaccttcaccctgtcgggggcggcctcgatccctgagcacctcttcgaggtgacgacgagcgtccacggccttcgcatcaccgagatcgccacccagtcggatctctacctgcactatccgaccgtcgcgacaccgaacgcgaccgcaacgacctggctcgaaattccgtcgtcggtgctgcctatccccacgaacagctcggccttcgcgagcaaggttgcagcagcgctccgagccgccgtcaagccacagcccgacggcaccgcgacggtcgacggtcaaacgtgcacgctggtgaaggccaccatcagcgggtcggcgatgtcgcagctcctctccgcggccgatccgagcctggcaagtcaagcggcgtcgacgctcgacaccgtcagtgccgtcatcacggcggccatcaacagcgcacacgagctcgtccaggtgcacgaggccgtctcgaccagtgctggcgtccaggtgaacctgaccatcacctatgaagaccagaaccagccggtatcgatcaccatcccaccgtcgaacgaggtcgaactgatcacgagcgcgggcgagctgtcgggtgtcctcgggggctcggcatcgacatcggcgaaccaaggggcgtcacagggctagctctacgagctcctcgcaggcgggtacgtgccgtgcgtccgcacgagtatcggtagcggagcgttgctcctgggctgatggctcgagagacctccagagagcgcgaggagaccgcccggccccatgccagccggcatcaccgaagcatcccctatcgccacgtcccgcacgctctgtcgtccctggcgtcgacgctgcgagctggcagaggcatcctgtcccaccatccgcgccagctcgtgatgtcggcctaccaggggacgagcaccggtgatcaatcgctcgtgcggtcgccgcctgcgctcgcgccgccaacggcgtcgtgcgtgatcggacggtaccacgatggccaagcctcctggggtccctcgagtcgcgtcgtggcttcggggaccgcgacgcgccagtggtccgccgcggcgtggacaatggcacggctcagctcgcctgcgacgctcgccggcagcgcctgcaccatccaggcgacatcccaccacgcaccgagtcgcaaccacggaccgacggcctcgcaccaacggtcgagcgccgcgacgtcgtcgggagagccgagcgcaaaggtcacaggctctgcctgcctctgctccacggccacctcgaccacacgaccacgacgccgaacactgagccgagggtgcaggagttgcgcgctcgcatcgagaccgtcgtcgaggcgtgccgatggcccaagggccgcgcggtcgctcacttggcgcgcgaagacccagcgcgccaccgcggcttcgtcgccaggggagaggtggacgaagcgcaggcgccacacctcatcccccacaccgacgacctccgccaccgcccgcacgagccggccgctgacgtcgaacgacacggcccgcaccgtccccggcgcatcacgcaccccatcaggtgcttcgatcgcgacgcccccgaccgacacatcgacggtgaccatcgggacgccgagcgtgaatccgtggaggtagtacgtaccgcgactacgaaggacggcccgcggcccctcgcgcaggttccaggggcgcgcggcctccacccgaccacgaaggcgcccgtgctcggcgcgcacgagcgaggcgccgagccacgctcgcgcggcgacgcaccgggcagagatcgccatgacgctcgcggggtcgcacccgtccgccccgtcgaactcgaccgtcggtcccgcgagcgccgcgaccgtgacctcgatcccgaccggctcgaggcggacgaccttgccgggccagcagacgaggttcgcggggagcagcgccatggtcctcagtcgtcgatcgcgtggcgcacgacgccctcacggatggcctcgcgcatgaccgcttcggcaaccgcaggcgcgacgctccggttgaacaccgatgggatgatggtgctcggagagagctcgtcgtcggtgacctgtgcggcgatcgcctccgcggcaacgagcttcatgccctcggtgatcaccatggcgtgcgcgtccagtgcgccgcggaagatgcccgggaagcagagcacgttgttgatctgattcgggtaatcgctccggcccgtcgcaacgacggccgcgatgccttcgagcgactccgggctcacctctggatctgggttcgcgagcgcgaagacgatcggattcgtgcccatggtgcgcacgtcttcggcggtgatgacgcccggtcccgacacgccgatgaacacgtcggcgcccgcgagcgcctcgcccaccgaccccatgcgacgctctgggttcgtgtgctcggccaaccacgccttctcgccggtgaactcctcgcgcccgctgaagatggcacctcgacgatcggcgacgatgatgcgtccgacaccggcgtggtcgagaatcttggccgtcgcgacccccgctgcgccagcgccagcgatgacgacggtgagctcctcgagcttcttgtcgacgacccgacaggcgttgcgaagcgccgcgagcaccaccacagcggtgccgtgctggtcgtcgtggaagaccggaatgtcgagccgcgaggtgagcgcagcctcgacctcgaagcaacgcggcgccgcgatgtcctcgaggttgatccctccgaaggcaggctcgagcgccgcgatcgcctcgatcagcgcctcggtggtgggagccgtgatcgggaccgggaacgcatcgatccccgcgaactccttgaacagctgcgccttgccctccatcaccgggagcgacgcgtgcggcccgatcgccccgagaccgagcaccgcggtcccgtcggtgacgacggcgacgctgttcgacttgatcgtgtagcgatgcaccagactggggcgctgggcgatggcgagcgacacccgcgcgaccccgggcgtgtaggccatggagaggtcgtcgcggttctggatcggggtcttgccgcgaacctcgatcttgccgccggcgtgcagacggaacacgcgatcgaccagcgagcgcacgtgcacgcccgggacgccctcggcagcttctcggatgcgctcggcgtgctccggatcgcccgagagcaccgtgatgtcacggacgatggtcgcagcatccacctcgaccaagtcgacgccgagaatgttcccgcctgcctccccgatcgcggtggtcaagcggccgagggttcctggctggttggtgagctcgacgcgtagcgtcaccgaatgggagacattgggtgttgccatggcgataggctagcttgcccctcgtcggctaggttggccacgccatggcgaaccccctgcgcaccctcgatgagcgaacccgcgaggtcgccgagcgagcactcacctcgtggatcgcgaccacccctcgctccggctcgctggcggccctcggccttggcgtcgggctcgctgcgctgggtggcctcgcgaccagtgatcgagcgatcgccatcggtcatgcggcggcctcgggcgcacacggcgcgtcggtgtgggagacctcgacgctcgccgcgctcgccctcgccagcgctgaggtgccggtcgtctgctggctcgatgggaccatcgacgaccaggagttcgccgtcgcacgagagctggttcgtcaccgagctcgcgcgatcgccctcaccgactcgccagcgcgcgcggcgctggtccgtgccgccgggtggcaccgcgacgagctccgcggcgacgacctcgtcgcaggtatctcgctgggtcgagacctcgcccggcgtgaaggaccggccgcggtgatcgtgcacacgcccgagcacacggtcgaggcaccggaggaactcctgcgtcgccgagcgcgccgcgcgctccgagatgcccaaccgctcgaggtcgtcgccttcaaaccacccatcacggccgagacggcgctcgaggcggtcgacgaccgaggtcccgacgcccccgtgcgggcatttctcggcggcgcggggatcgttcgcatcacccgcacggggctcgcccgcgacctcgaggtgcgcctccgggccccggtcatcggggtccccgatcccgaggggctcgcgcgagaggtcgccagcgccggtgcgcgtgcggtgatcctcgacgtcgatggcgacacgctgatcgccgcctcccctgcgccaacgctggaactcgctccgatccgcacggaggacgtggcactcgccctcggtgcgctggtggcaggtgcgggcttgcgcgtcgtcgtatcgaccgtcgggcgggtcgcaggagtaggcgagcgcgtcgtgcaccatctcgctgccgacccgagcttcgtcatggtcacctgggcagcaggcgccctcgcaactgcccaggcgcgtgcactggtcgcaggcgagcgacgcacccccagcgtcgtcgagctcgtccagaccgatcccatcccagccgtgctcgacgagctcctcgctccggccgagcgcatcgtcgtcgtggggcccgcggcctcgggcgtggggcagcggctcgccggctggctctttgcccgcgacctccatcgccgcacccagtggtacgaaccaaccgtacccgcgagcgtgctcggcttcgccgcgcgcaccctcgcgagctcctgagcagccctgtctcaagccgccgtcacggcggccgatgacctggtgatcgctgatcaccgaggagggccagatggagagcccgcggcttcgcgagcgcgcagcttcgccaccgctcggcgccgcgctcgtggccgcgggcctgctcgacgagcacgacctcgccgtggcactcgagcagcagacccggagccgacgacgcctcggtgaggtgctcgtacgccgaggcatcgtcccacgcctcgatctcgcccgtgtgctcgcagaacgcgctcgcgtgcccttcgtgaccctcgtcgatcgcgagccacgacgggagctgctcgaggggctcgacctcgaggcgtgcgtccgcgagcggctggtcccgatcgaccgagacgacgatggcacgctcgtggttgcgagctcggaggtgccgaccgacaccgtgcgcgagagcgccgaacgtctcagcggcgctcctgtccggctcgtgctcaccaccgagtgggacctgctccgctacatcgtgcgcgcaggcgccgatcacatcggccgacgagcggcctacggtctcgcggagacggatctcgacctgtcggcagcccacgtgctcacgagggcccaagccatcggcctcgtcgtcgtcgcggtcgtggtcgtcctcgttggcatcgtcgacacccgagcactcctcggggccgcactcgctggcgctgccaccctcctcgcgctcgtcgtgctctttcgagcggtcgttgccttccggggcgccggcgtgccgtgggtcgtgccagagcgcctcctcgacgacgcagacctgccgacctacaccatcctcgtcccgttgtatcgagaggcggcggtggtcccggcgctcatgacctcgctcgccaacctcgactacccaccagagaagctcgaggcgctcgtactcgtcgaggccgacgacgacgccacccgggacgcgctcgtcgcggcgcgcccgccgagctgggtcaccgtcgtgaccgtgccgcccgaggggcccgcgacgaagccgaaggccttgaacgtcgggctcgcgctcgcctccggtgagctgctcgtgatctacgacgccgaggatcgacccgaacccgaccagctccggatcgtggcctcgatcttcgccgacgccgaccacgaccttgcgtgcgtccaggcagcgctgaactaccacaacgcccgccacaacctgctcacgcgcctgttcaccctcgagtactcccagtggttcgattacctcctccccggcctcgaggcgctcgagctgccgatcccactgggagggacctcgaatcacttccgcacgcagctgctgcgctcgttgggaggctgggatccgttcaacgtcaccgaggatgccgatctcggcattcgggccgcggtgaagggtgcccgggtcgccaccgccgcctccaccacgtgggaggaggcgaccgctcgccccggcgccttcatccgccaacggacgcgctggatcaagggctacgtccagacagccctcgtgcacgcccgccacccgatccggctggtccgagcggtcgggccgatccaggccctcgccttcgccgtcctcatcgccggcacgccgatcgccttctggacgatcgtgcccctcgacctgaccttcgtggcctctctcgtcctctcgccgcacgtcctcgtcgatctcgtaccgcgctgggcgctcgccgtcggattcgtcgacctcgtcatcggcaacgccgtggtgatctacctctccatcgtggccgtcttccgtcggcgtcaatggtcgctcgtgtgggccgccttgctcacgccggtctactggatcttgcactcgctcgcggcctatcgagccctcgcccagctcgtgacccggccgcactactgggacaagaccgaccacggagtcgcgctgtgaggggccggcgcattcgctggtggatcgtggccgcgagtgcactcccgctcgcgatcgccgagatcgtcggactccttcgcctgggcccgggcaccgtcgtcctcgaccacgtcgatcccctcggcatcggctcactccacgcggtcgtcgtcatcgccctcgcgaccatgacgccgctcgccgtaggtctcgccatcgcgagcgcgcatcgctggatcgcgactcggctcgaagcgacgccagcgatggtcacggctgcactggtcgcgttgtggtggctcctcgtgctcgcaggcacgacggcggccggggtgatcgacctcgcgctcctcgcactcctcgtcgtgtccgtcgccgaagccggcgccttcgtgctcggcgacacggtcacggctggggtcggcgcagggcttgccctctgcgcgctcgcgctcagcgacccgccccttgccctctgcgcgctcagcatcggcgcggtggtgctcgtgggactcggggctcgtggtagggacgaggccggcctcgcgttcttcgccgtccttgccttcccgagcgcggcgctcgtggtcggggtgcccttcgtcgactggcgcctcaccggcgacgcggccgcgacccgcgcctacgtcgccgccgtgggcatacaccatccgttcgccgcactcgtcgtcgcgtgcggcgcggttctcgcggccctcgccagaccacgggcactgctcgccgcggccatgctcgctgcagccgtcgcgggggccatcgtcgccggcatggacgcacgcgccatctcggcgctcgtcatcgtcggcctcgcggtcgtcgtggtgccattggtgggggggcgccacggcccgacgctccccatcgccgccgccggaacggtcggcgacgacggggcccagcgtcccaacgctgcctagcggcgccgacgcagctcgtcggtcgtgttcggcacgatcccagcccgctcgagcacctccgcactcacgccggcctcgcgccaggtctcgtagctgatccccttgcgttccccatagcgcgctgcatgctcgatgaacgcctcttcgagctccttgttgtcggcctgatgctccaggcgccacaactcactctcgaggtccttgcgctgctgcaacagctcgatccggtgcaccccggttgcgctctcgaggtctgccgtcacctgatccaagagcatacgaacacgctcgggagtgcggcggcgcccacgcctcggcttgttctcctcgagatagcgcaggtaggcgtccacggcctgggactccctacgcccgcgggcgatcgccgcgcgctgctcgccactcatctgacgaccgtcatcagccattgctgctccttctccttgtctccatcaccgcgagacagctgccacttccgaccgaggtccccggtcggcgacccagcgctccgaacgcgacggcgaggtgccgacaccacaaccaagagagccatcagcgcagctcatccacgctcccctcgacgttgcgtccaccggcccaaccacgccgatcgtcggcgcagtcgcgtcggagccggccagggggagtcacctgagccgtctcccacccacgcaaaaccgccgagacgaacccgccggaatgagcgagccggaacgccgcttcaggctctcgccaggcgaggcgaggcccacactctcctgatcgtcctcctgatcgtcaaacggtgtcgaggtcgccgctcttccctacttcccatgagctcgatgctcaccaacaaccatcatactggccggacgagttcatccaatgtatcgcaccgacacagcgaatcaggtcgtctttgcaatgcaattgcgatcgccaccgtgcgctcataattgctgcctcccagctcgagcgtgggcgtgacctccgatcgcacaatggcggcccggtaggctggcgccatggacgagccgcgccaccgatccctcgggctgaccgacgacgagtacgagagcattcacacgttgctcaggcgcgagccgaacgataccgagctcgcgatgttctccatcatgtggtcggagcacgcgtcctacaagtcctcacgggcactgctcggccgactcccgtcacgtggttcgcgtgtcatcatgggccctggcgagaacgccggcgtcgtcgcgctgacggactcggtggcggtcgcgatccgcatggagagccacaaccatccgagtgcgatcgaaccacaccagggtgctgcaaccggggtcggcggcatcctccgcgacatcttcaccgtcggagcacgacccatcgcgctgctcgattcgctgtggatggggccccaggacgacgcgaggagccgctggatcaccgacggagtcgtcggcggcatctctgcttacggcaacgcggtcggggtgccgacggtcgggggcgagctacgggtcgatgcgtgctacggcgccaatcccctcgtcaacgtcgtcgcggtgggtgtcgcgcccaccgaggcgctcgtgcgtgctcgcgccgagggtatcggcaactacgtcgtcctcctcggcgccccgaccggacgagacggcatcggcggggtctccgtgctggcctctgccggcttcgatgccaccgcggagcagaagcgcccgagcgtgcaggtcggcgatccgttcgaggagaagaagctgatcgaggcgtgcctcgcgctcatgcgcgccggcctcgtcaccggcgtccaggacctcggcggcgcgggactgacgtgcgcgacctcggagacggcggccgcagcgggcgtcgggatggacatcttcctcgacgccgtgccacgtcgtgagcccgggatgacgccgatggaggtcctgtgctcggagtcgcaagagcgcatgctcgccatcgtcgagcccgggctcctcgacgaggtcatcgcgacctgccgacgcttcgaggtgaccgcgtcggtcatcggggtggtgcgcccacccgatgcggagggcccgtacgccggtgaaggagttctgcgagccttcgagagcgacgggggaccgctcgccgccgtcatcccggcgcggctgctcgcccacgacgggccgcgctatcgacgccccatggcgccgccggccgacctcaccgagcgacgcgcacaggtcgtgaccctcgatgcgccgggagcgacgctcctcgccgaggtcgtcaacgacccgatcgaccccgccggggtgtggcgacgctacgaccacatgctgtttcgcacgagcctggtcgaaccaggcgccgacgcggcactcctgcgtgtgcgcacgcccgaggtcggcgacaccggacgcgccatcgccatcaccgtcgatggcaacaaccgctggacccgtgtcgacccgcgtcatggggctacgtggctggtcgccgaaggcgtcgcgaacctcgcgtgcgtgggggcaacgcccctggctctcgtcgactgcttgaacttcggcaaccccgagcaccccacggtgatgtggcagctcgccgagagcatcgacggcatcgccgaggcagcccgagcactgggggtccccgtcgtcggtggcaacgtcagtctctacaacgaggcagacgggatcgacatcgacccgacccccatcgtgtcgctgctcggcgagcgcgccacgccgaccgcgccggtacccgctccggagcgcgcccacggcagcctcgtcgtcctcgcgccacgaggggcagaaccccagctcgcgggctcgcgagcggcggccgtggcgggtgtcgatggcggcaccctggcgccgctcgactgggaagcgcaccgtcgtctgtgcgacgcggtggcggacctcgtcgtcggggacgaggtgagcgcggcaaccaacctgtccgccggcgggctcgcgcgatcagccgccaggttcgcccttcgcagtcggcaggaggctcggctcgagaccacggacacgctcgcgctcgtcggcgagcacccgtcgcgggtcctcgtcgccaccgacgacccggagaggctcgtggcctgggcgtcggcgaaggacctcgacgcgaccgtcgtcggctcgctggctccgtcgggcgagccagccctcgtggtcggcgcgcaccggatcgtgctcggtcgtacccaggacgtgccggcgctcgtgccgaccgacgcctaaccgagcagaccagcgagcaaccggccggcgggctcggcaagaccgtagcctccgccggctcgctccggatgcggcatgagaccgaccacgcgacccgacgcatccgcgatcccggcgatgtcgtgggccgagccgttcggattcgcgacgtagcggagcacgacgcgaccggactcctcgagcctgcgtagcgtgtcgtcgtcggcggtgaagttgccctcgaagtgattgatcggcagcgacagacgctcgtgtgccctcatcttctgggtcaagacgctctcgacgctcgcgacctcgacctcgacgtgctcacacaggaagctgaggcccgcgttcttctggagcgcgcccggcaggagccccgcctcgcacagcacctggaagccgttgcagatcccgaggatcgggaccccacgccgcgctgcatccatcaccgcgcccatggccggcgcaaaccgtgcgatcgctccgggtcgcaggtagtcaccgtaggagaacccaccagggatcacgacggcgtcgaccgctccgagctcgctctcgccatggtggacgaggcgggcggtgacgccgagttcggcgtaggcgccgaccacgtcgtgctcgcagttcgtgcctgggaagacgacgacggcgacactgctcacggggcaacgacctcgagttcggcgatgcgccacgtctggatcaccggattggcgaggaggcgctcggcgagcacgctggcctggtccagcgcatcacgctcgtcgacggcgcgaagctcgaggcgaaaggcgcgtcccgcactcacgttgacacccggcgcgagctcgaggtgccgagccgcgtccgtgatggcccgcccctcggggtccgcgatgcccggtctcggctcgaccacgaccaacgccacccaggtgtgcgcactcatgcccgctctcctccgtagggatcggcgctgcccggccactcgtcgaacgagcgtcccgtcagcgtctcgtagaccgtcacgtagcggccacgcagctcaccgacgagatcgctcggcaggggaggtggcggtccctcgccacggaaaccctcggccacgagccagtcccgaaggagctgcttgtcgagccactgggggttctggccgaggtccccggcgacgatgcgagccgcgtcgggcgtagcgatctcgtcggcgagcaccaacgcacgcccgtcgaggccgaactcgaacttcgcatccaccaaggtgagccccttcgcgtcgaaccaggacgcgagcagggagaacacctcgagggaccggtcggcgagctcgcgagcacgccgctcgccgacgagctcgccgagctcgtctggcccgagcggcaggtcgtggccgacgtgagccttggtcgtcggggtgaacaggggctcggggaatggagcaccgaagtcgaggtcccgtggcagctcgcgaccgaacgcggtgccgtcgcgctggtaggactcccaggcgctgcccaccagccgaccgcgcaccacgcactcgaccggcagcatcgcgagtcgccgcacccgaagcgtacgaccgagccacacatcggggacgtcggtcgcgacctcgaggaggtgggtggccacgtcgctcgcgacgcgctcgaaggccgcggccgcgatggccgtgagcagccgacccttgtcggggacgagctcaggaaggacgacgtcgaaagcgctcacgcggtcggtggcgacgaccagcagcgccgcctcgtccctcggatccacccaggtctcacggaccttgccgacaccaacgcgcgtgaggctcacgatgcctcctcgagacgagcgaacaggggggcaaggttcgcgaccaggcgctccgcggaggcgagctcggcgagctcgcccggggagagcggcacggcggggtcgtcggccagcgcatcgaggaagggcacgtcctcgtccagggtgcgagcggccgctgcctgaacgatgcggtaggcgtcgtcgcgagccatcccgcggcgcacgagtgcgagtagcacctgctgcgagtacacgagaccgcgtgtggcggcgaggttctgcgccatcgcctcggggtgtacggtgaggcccgccacgatccgcgtcgccagcgacgtgccgtagcaggccacgtggaaggcatcgggcagcatgacgcgctcgaccgacgaatgcgagatgtcgcgctcgtgccagagggcgacgtcctcgagcgcgggcacgacggccgagcgcgcgagacgggccatgcccgagaggcgctctgcgagcactgggttgcgcttgtgcggcatggccgatgagcccttctggccgacggcaaagggctcggccacctcgccgacctcgctgcgcgcgaggtgacgaacctcgagggcgatggtctcgagcacggctccgagcgcagcgagcgcccacacgacgtccgcgtggcggtcgcgggggatcacctgcgtcgccgacgtgggacgcaagccgagggcctcgagcgcgtgacgctcgatggccggcgagagcgcggagtaggtcccgaccgcgccggagagcttgccgacgctgatggtctcgcgggcagcgacgagacgagctcgcgcccgttcgagcgcgagccagaacagggcgagcttcgcgccgaacgtggtcggctcggcagccatgccgtgcgtgcgacccaggcagacgaggtcgcgcgtctcgagcgcacggaccctcagcgtgtcggcgagtccgtcgacgagctcgagcacccgatcggtcgcgtgcacgagcgccagtgacagcgcggtgtcgacgacgtcggaggaggtgagaccgaagtggatccaccgcgcagccggatcggcgatgcgggcttggagcacgtcgacgaaggccgcagtgtcatgatgggtgatgcgctcgcggtcgttgacggcctcgacgaaggcttcgtcgggcgtcggggcgagctggcgtaggcgcgcggcatcctcggcagggatctcgccgagggcccccagggcgtccgtcacggcaagctcgaccgcgatccagcgcccgaggcgcgcctcgtcggcgaagagtcgcgcgatcaccggatcctcgtagcgagggatcacgccaactcctttccgaccacgccgccgatgcaccatgccccaccgtccgccgcttcgcgcggcgatgagcgcgcgacgacgtcgtcggaccgtgggctcactcggcgcccaagcctagatcgctgcgccaggtcgcgccctcgatgcgaatcgcctgacgggcccgataggccacctcgcgcgccgtggccaggtcgtcgccccggcccacgacggtcaggatgcgcccaccggtcgtggcgagggcgccgtcggcctcggcacggaccccggcggtgtagacccgcgcgccgaggcgctccgcctcggcgatcccctcgatgcgatcgccaccgatcgacgcctccgggtagccacgggccgccatcacgatcccgagcgccgcgccggcctggacatcgagatcgccgatggtgcccccgcgggcagcggcgaccagggcgtcgacgaacccttcgccgaggagcggggcgatcgcctgtgcctcggggtcgccgaggcgcacgttgatctcgagcagcgacaggccgtcctcggtcgccatcaagccggcgtagagaaaccctcgatagacgatcccgacccgacgaagctcggcgaggagtggctcgagcacccgatcggtggcttcttcgatgagcgagtcgttggcccagggagccggtgcgtaggcacccatgccgcccgtgttcggaccgaggtcgccgtcgaggagccgcttatggtcctgggcgacgggcaacagccgcgcatcgcgctcgttcaccaaccagatcatcgagagttctcggccaccgagaccctcctcgatcacgaggcgccgacccgcatcgccgaacgcctcgcccgagagcttggcccgaacgtctgcctccgcggccaggcggtcgcgggtgacgagcacgcccttgcccgccgccaacccgtcggtcttgatgacgtaggggggcccgaagcgatcgaagagcgcagcggcctcctcgatcgtggtggcgacgccccagcgagccgtcgggaccccggccgcgtcgcagagccgcttcatcgcgatcttcgaaccctcgagcgccgcccctgctgcacctggtccgacgacgaggcgccccgcggcgcgaaggtcgtcggcgagtccggccacgagcggagcctccgggccgatgacgacgaggtctgcctcgatggctctggcctcgtcggcactgacctcgaagcgggtcgcgatcccggcgttgccaggggcgaccaccaccgaggctcccccacgcgagacggcgtcggcgagcgcgtgctcgcgagctccggagccgacgatgagcactcgcatgggctctacgagagctccacgatctggtcgcggctcgggccgaccccgacccagcgcaccggcacctcgatccgcgcctcgatgaactcgaggagccgacgagccgccgcgggaagcgcggatgcagtggtcacctgtccgatcggggtcttccagcccggcagcttctcggtgacgggatgggcgcggtgcagatccgactggtgatacgggagctcgtcgaccctctcaccagcgacctcgtaggcggtgcacacctggatctcgtcgaaggtgtcgaggacgtcgagcttggtgatggcgagttcgctcaccgaattgacgcgcaccgcgtgctggagcagcacgaggtccagccagcccgtgcggcggcgccggcccgtgttcgtcccgtactcgtgaccacgatcaaccagcgcatcggcgagcggcccctcgagctcggtcgggaaggggccggcaccgacgcgcgtggtgtaggccttggcgacgccgatgacctgatcgatctggcgaggcccgaggcccgagccggtgcaggcgccaccggcggtggggttcgacgacgtgacgaacggatacgtgccgtggtcgagatcgaggaaggtggcttgggccccttcgagcaggatcgtgcggccctcgcgccagagtcgctggacgagccccaccgaatcgacgatccgaggcgcgatcaggggtgcgtaggtaccgaggtagtcggcgacgacccgctcggggtcgatgggtagacggttgtagcccttcgcgagcacgaggttcttctcgcgcagcgccacgtcgagcttggcccggaagatcttctcgtcgagcagatcctggactctcaggccgatacgggccgccttgtccgcataggccggaccgataccgcgcttcgtggtgccgagctgtgccttgccgaggtagcgctcggtgagtcgatcgagctcgtggtggtagggcatgatgagatgtgcgttgcccgagacgacgagccggctcgtgtccacgccgcgctcttcgagcatgcggagctcctcgacgagcaccttcgggtcgacgaccacgccgttgccgatgatggggatcacgccgggatagagcacgccgctcgggacgagctggagcgcgaacgcatcgccgtcgacgacgatggtgtggcccgcgttgtgtccaccctggtagcgcacgacggcagcggctcgccctgcgagtaggtcggtgatcttgcccttgccttcgtcgccccactgcaggccaacgaccacgatggcgcccacgccacctccttcgactcgggtgccccgccaggctagggcacgcggaacacgaggggttcgccgttggcgatctcgagcgagaccacctcgtcatcgtcgaggtcgcgcagcaccttcacgaggccccggagcgagttgccgtgcgccgacacgagcacggtgtgcccgtcccacagcagcggcacgatgacgtcgtagtagtacggcagcacccgatcgatcacgtcgcacagcgcctcggtacgaggcacgagtgcgagcgggagcatgcggtagcgctcgtcggcatgcaggagacgctgggcctcgacgtcggtctcgggtgggcgcacgtcgaagctccgacgccacagcttgacctgctcgtcgccgtagcgagctgcggtctcggccttgttgagtccctggagcgccccgtagtggcgctcgttgagccgccagctgcgcagcaccggcagccaggggcgctcgagttcgtggagcatcagctcagcggtcgtgatcgcgcgctcgaggacggaggtcacgaggacgtccggccgaaggccgtcggcctcgatcgccttggcggcctccttcgcctccgcgacaccctggtcggtgagtggcacatccacccacccggtgaagcggttctccgcgttgtacgtactctggccgtgccggacgaggatcagcgtgcccacgtggctcgagcctagcccaccacgccaatggtcaagaaccggctggtcggtgaccgattgaaccgtgtgggaatgtttctgcggcgtgaagcgtcctaaaacttgatattctgtgactcaagcttcgcaggggctctcgcgtcaggagacgccgatccccacagcccagctcacagcagacacggacggacagcaagcacggtcgtaacaggcaagcacaacacaggaggagcagccatgcccaaggcagtcggcatcgatcttggcaccacgaactccgtggtcgccgtcctcgaaggtggcgacccggtcgtcattcccaacgcggagggtggacgcaccaccccgtccgtcgtggccttcgccaagaccggtgaggtgctcgtcggcgaggtcgccaagcgccaagccatcaccaaccccgatcggaccatccgctcggtgaagcggcacatggggaccgattggaccatcgacatcgatgggaagcactacacgccccaggagatctccgcgcggatcctcgccaagctgaagcgagatgccgaggcctacctgggcgacaccatcacccaggcggtgatcaccgtccctgcctacttcgacgacgcgcagcgcacggcaacgaaggaggccggacagatcgccggcctcgaggttctgcggatcatcaacgagccgacggctgcggccctcgcctacggcctcgacaaggaagccgaggaccagacggtgctcgtcttcgacctcggcggtggcaccttcgacgtctcgatcctcgagatcggcgagggcgtcttcgaggtcaagtcgaccgcaggtaacacccacctcggtggcgacgactgggaccagcgcatcatcgactggctggtcgcgagcttcaagaaccaagagggcgtcgacctctcgaccgacaagatggcgatgcagcgtctcaaggaggcggccgagaaggccaagatcgagctctccgcgtcgctggagaccatggtcaacctgccgttcatcacggcgacgaccgaggggccgaagcacctcgagatgaagctcacccgagcaaagttccaagagctcaccgccgatctcgtcgaggcgtgccgcgcaccgttcgagcaggccattcgtgatgcgaacctgtcggtcggcgacatcgaccacgtggtcctcgtcggtggctcgacccggatgcccgccatccaggagctcgtcaccaagctcaccggcaaggagccgcaccgcggcgtcaacccggacgaggtggtggccgtcggtgcggcgatccaggccggcgtgctcaagggcgaggtgaaggacgtcctgttgctcgacgtcaccccgctgtcgctcggcatcgagaccaagggcggcgtgatgaccaagctcatcgagcgcaacacgaccatccccaccaagcgcaccgaggtcttcaccacggccgacgacaaccagccctcggtcgagatccacgtgctccagggcgagcgcgagatggcggcctacaacaagacgctgggccggttccagctcgtcgggatcccgccagcgccgcgtggtgtgccgcagatcgaggtgaccttcgacatcgacgcgaacggcatcgtccacgtgtcggcgaaggaccgcgccaccggcaaggagcagtcgatcacgatctcgggcacgacgtcgctcggcaaggacgagatcgagcgcatggtgcgcgacgccgaggcccacgaggccgaggaccgtcgccggcgcgaggaggccgaggtccgcaacaacgccgacaccctcgtgtaccagaccgagaagctcctcgcggaacagggcgacaagctctcgggccccgagaaggatcgggtcaccgaggccttggggcagctgaagctcgcgctcgacggcacggacatcgccgcgatccgcagcgccaccgacgcggtggtctcggcgtcccagagcttcacccagcggctctacgaggaggcctcgcgcagcgcccagagcgccgatgccagcggccagtcgagcacctcgtcggaggatgaggtggtcgatgccgagatcgtcgacgagtctggagagcagaggtcctgagccatgggcaagccgtacggagacgacgccgacgagccggtgacgccgtccgaggacgccacgcccgtcggggggtccccccccgacgggacgaccggcgacgacgagccgaccgcggaggtgcagccgagccccgacgacgaggggcgagagagcgatccggtcctcgcggcgatcatggaggacctcgcagccgtcacacgggagcgcgacgagttcctcgagaccgcacagcggctccaggcggagttcaagaactaccgcgagcgtgtcgcgcgccaacaggccgaggccggtcaagctgcggtcgcgagcttcgtgacgaagctcctgccggcgctcgacaccttgaacctcgccctcgcccacgcccgtgcggagggctccgaggagacgacgagtgcgctcgcccaggtgcacggcgtcttccacgaggtgctgaccaaggaagggctcgaggtcgtcgagcccatcggcaagcgcttcgacccgaccgaggccgatgcggtggcccacgaggagggcgagggcgagcccacggtcacggaggtgttccgggcggggtaccgctggcgcggacaggtcatccgaccagcgatggtgcgtgtgagcggatcgtgaacgcgacgagcgagacgggctcgtcacgaggggcgagaagggaggtgagctgacgtggccccggcgagagagtggttcgagaaggactactacaagatcctcggcgttcccgagacggcgagcgagaaggacatccagcgtgcgtatcgcaagttggcccgccagtaccaccccgatgcgaaccccgggcacgaggagcgcttcaaggaggtctccgcggcctacgacgtcctcggcgatcccgccaagcgcaaggagtacgacgaggtgcggcgcctcggtccgctcggatccatgggcgcccccaccggcaacggcacccgtggcgccgggacgttccatgctgaggacctcggcgatctgatcggctcgctgttcaatcggggccgtcgcgaggccagcgggcctcgacgcggcgccgaccaagaggccgaggtcaccatctcgttcgaggacgcagctcgtggcgccgaggtgcagatccccgtcaccggtgaggcggcgtgctcggtgtgcaagggtacgggtgcagcccccggcaccgtgccgaagacctgcgcccgctgcaatgggaccgggacggtctcggacaaccaggggttcttctccttctcgcagccctgtcctgcgtgccacggccgcggcctcatcatcgagcagccctgtccctcgtgccacggcaccggcaccgagcaccgaacccgcatcgtgaaggcgaggatccccgcgggtgtcgagcccgactcgaccatccgcctgcgcggccgtggcgcgccggggcgcaacggggctcctgcgggcgacctcttcgtgcgggtgcacgtgctgccgcatccgatgttcggtcgacgcggagcggatctcacgttgcgtcgcacgatcagcttcgccgacgccgccctcggcaccgtcctcaccgtgcccaccctcgacggcacggtctcggtgaaggttccgcctggcacgagcgccggcacggtgctgcgggtccgcggcaaggggctccccaaccccaagcgcaagggagcccgcggcgaccttctggtcacgatcgacatcgacgtgccggacaagctcgatgccaagcagcggcgctacctcgaggacttcgctcgcgtcttcccccacgacgcagcctgaggtgctctgagccacgagaggaggtgagatggctgagcacgaccgatcgcactccccggagcgctcccgcggcctgtacgtgatctccgtcgccgcagagctcacggggctccatccgcagaccctgcgcgtctacgagcgccgtggcctcttggagccgaggcgcaccggcggcggctctcggcgctactccgaggccgacctcgctcgcctgcgccgcatcatcgagctcacggagcagggcctcaacctcgagggcgtgaagcgcgtcatcgagctcgaggaggaggtcgagcggctccgcgccgaactcgacgctgcgcgccagcgcgcccgcgagcgcgagcgcgagctccatcgccactaccggcgcgacctcgtgccgctcagccaggcggtcatcgtctggcagccacaacgccaacgcacgggcgacgcccgctgatccatcgagtccctcctcccccaaccccaacccccaaaccacgaacgaccacgccggcccgaggccggcccggaggcaaccatgagaaccgatcacttcacccacaagctccaagaggcgctgcaggatgcgaagcgcctcgccaccgagcgccagaaccccgaggtcaccccgcagcacctcgcgctcgccctgctcggccaacccgacgggatggcgctcgccgtcctctcgcgagccgggatcgctcccgccagcgtgcgcaaccagctcctcgaggccctcgagcgcctaccacgcgcctacggccaagcggccgaaccggcaggatcggcggcgctcgcacgggtgctcgagcgcgccgagcagctgcgcggtgagtacggcgacgactacctctccgtcgagcacgtcctgctcgccatggcggccgtgctcaaggtcgacgaggcgacgctgcgccaggcgatcgacgccgtgcgtggcggacgccgtgtgacctcggccgaccccgaggacaccctagaagcgctcaccaagtacgggcgcgacctcaccgaggctgcacgcgcaggctccatcgaccccgtgatcggccgtgacgaagagatccgtcgggtcatccagatcctctcgcgtcggcagaagaacaacccggtcctcatcggcgaacccggcgtcggcaagaccgcgatcgtcgaggggctcgcacgccggatcgtcgaaggtgacgtgcccgaaggcctgcgcggcaagcggatcatcgcgctcgatctcggctccatggtcgcaggagcgcagtaccgcggtcagttcgaggaacgcctcaagagcgtgctcgacgccattcgccagagcgaaggcgaggtcatcaccttcatcgacgagctccacaccgtggtcggtgcgggtgcggccgagggatcgctcgacgcctccaacatgctcaagcccatgctcgcgcgcggcgagctgcgcatgatcggcgcgaccaccctcgacgagtatcgcaagcacatcgagtccgacgccgcactcgagcgacgcttcgccaaggtcatggtcgaccagcccagcgtcgaggagacggtcgcgatcctgcgcggcttgaaggagcgctacgaggtgcaccacggcgtgcggatccaagacgccgccctggtcgctgccgcggtcctgtcggatcgctacatcaccgatcgcttcttgcccgacaaggcgatcgacctcgtggacgaggccatggcccgactgcgcatggagatcgactcgcgacccgaggagatcgactccgtcgagcgccgtctgcgccagctcgagatcgagcgcatctcactcgcgaccgagaccgaccgcgcctcacgcgagcgcctcacccgcctcgaccaggacatcgaggccacgaagctcgagctcagtgagctgacccgccagtggcaagccgaacgggaagcgatcgacgtcatccgccagcgcaaggagcacctcgaggagctgcgtgcccagtcggaagcctacgagcgccaaggcatgctggaccgcgccgccgagctgcgctatggcgagatccctcgcctcgagcgcgagatcgaggaggcgaccgaagaactctcgaagcgccagggtggccggcgcatgctcaaggaggaggtcgaccccgaggacatcgccgaggtggtcgcggccgcgaccggcatcccggtgaccaagctcctcgagagcgagaccgagaagctgctccacatcgaagacgcactgcgtgcgcgggtggtgggtcaagacgaggcgatcgacgcggtggcgaacgccatccggcgcagccgtgccggcatcgccgatcggaaccgccccatcggctccttcctcttcctcggcccgacgggcgtcggcaagaccgagaccgccaaggcgctcgcggagtacctcttcgacgacgagcgagccatgatccgcatcgacatgagcgagtaccaggagcgtcacagcgtctcgcgcctcgtcggtgcgccccctggctacgtcggctacgacgagggcggacagctcaccgaggcggtgcggcgccgtccctacgcggtggtcctcttcgacgagatcgagaaggcgcacgccgacgtgttcaacgtgttcctccagatcctcgacgacggccgcctcaccgacggtcaggggcgggtggtgaacttcacgaacaccatcctcatcatgacctcgaacctcgccgacgatccgcggcgcttcttcaagcccgagttcgtgaaccgcatcgacgagatcgtgcgcttccacgagctcacctcggaccagatccgcgccatcgtcgaccgccagatggcccaactcgccggtcggctcgccgagcgctcactcggtctcgaggtcaccgacgccgcggcggccctgctggccgagcgcggctgggatccggccttcggtgctcgacccctgcgtcgagccatccaacgcctcgtcggcgacccgctggccagagcgcttctcgaagggcgctacggcgagggagacacggtcgtggtcgacgcggccgacggcgccatcgtgctgcgctgagcacacggcacgaccgacgacgcacctcgggaagccccggggtgcgtcacgtcgtcgggagcggccacgggagttcgtagagcgcgagggcgttctcgtaggcgacgagcctggcgagtcgaaacgcctctcgttccgcaatccagccctcggcgagcaggggctcgaggtaggcggccatggcgcgccgatggccgagcgcaccgagcgcgtagagctcggggaggccgaacgcgtccgaggagtagcagagcttgccccacggggcgagctcgagcatctcggcgagcaccgccggggctgccgggcccacgaaggactccgcgaggccgagatccacgaagacgtgcggatagtcgtgggcgaggagtgccgcctcgcgatggaagggataggtgtgcagcagcacgaggcgcacgccatggggagcgatggcctcgatgaagggctggagctcaccagggtgaccgcgtgccaggcgaacgtccggatcgccgatgccgacgtggaactggagcggcaggggtgccacctcgagtgcggcccacacgatcgccgcgacgaggtcccggtcgacgacgcgcaccccatgtccacggtcgcgttcgtcgaggatccgtgcgagtgccgtctcgagcgctcgcggcgcgggaggtcgatcgggaagatcgaggccactgcgataggcagccaccgacttgtaggcgaccgcccgccgcgcggcccgggcgacggccgcctcgagcgcagcccggaagtccgccgtcgcaccgaggtcggcgagcacacgttctgcgatcgcctcgagtcggaccacctcgagcgcgggtaccccgctcgccgcctcgagttcggcgggctcgagcacgagttcggaacgaaagccggtgtcgacgagcagcccacggacgccgcccgtggcgagcgagcgtgcaaacaggtcctccggtgcgtacgcggcgcgcgccgtgaggtagtcctcacttcgaaccggggcctcgagcccgagcacgaggccgagcgctgcgcgcacgccgatgccgagcgaggactcgagcggggtggtacgagccgcgaggcgatcgggggcttcggtgaggtggtcgagcaccgtgtcggtatcgggggcttcgcgtacgatcccatgacagtgatggtcgaggagggggacgtctgccaagcgttccgcgagcacactggcgggcgcgagcgggttcctcaccgctccacctcgacgagggctcgggtcagctcctcgtagcgagccagtcgacgacgcgccggctcgccgatgcgctgcaccacggcggcgatgatcgcctcgacgagcgcgagggccggcgtgagcgcatcgaagatcccgggtccgtcgacctgggtggtgagcaccaccgagctgcctggcgcggccgggctgagtccagggtcggtcacgagcacgacggtcgcgcccgcctgactggcggccgtgacgaaccgggcggtctcgagctggtagcggacgaagtcgaaggcgaccaccgtcgtcgaggcatccacgtcgagcagggcattcacacgagcgccggcctcgggcggcacgtggcgcaccgacggtcgcaggacctcgagcgtccaggcgaggtgacgcgcgacgacgtcactcacgcgcccaccggacaccaccaccggacggcggacgtcggcgagcagggtgacgacggtgtcgagcgactggggcgcgagcccgacgaacgagcggcggatctggtcgatgaggtcggcttcggccgagccaacgtcacccggcccggtgacctcgaggcgctcgagcggcgaggcgagccgctcgccgatctcttcgcgcgccgccgaccggaactcctcgaccgagctgaagccgagcttggcgacgaagcgcaggaccgtcgggggcgagacgtcagcgagcgctgcgatgtccgcgagtcgctcgagggcgacgaccgggtactcccgtaacaccgcttcggccacacggcgctgggcggggccgagctcgggtgcgactcgacgcacccgctcggcgagcgacgtcatgaccagctccaacgcatcgccgcgaccagctcctcgggcgtcgcgtcggcaaagcgagcgagctcggcctcacggacagcgccgatggccgtgaggaaggacctgcccaggacatcttggagtagctccgaggagcgcagtgcgccgagggtggcggcgagatcaccaggcagtcgctcgaggcccccgtggtgcgcgggatcgccctcgacgggaggcggcggcgtcctcgggtccgcgagcgcatggcgcgcgatgccgaggagggaggtggcgagcagatacgggttggcaccgagatcggcgcccttgagctcgacgtttgccgcgcggccatcgaccagcgtggccgcaggcacgaggcgtagggccgcctcacgattctcgatcccccagacgcgatacgcacctgcccagtggctgggcacgagccggaggtacgagaccggatggggggctgcgatcgcgaggatcgcggggagctcctcgagcagccacgcgatcaccgactcaccctcgggacgcacgccgccaggcccgtcgccgccggcaaagatcggctcgccgtcacggtagagaccgaggtggatgtgtccgccgttgccgaccccaccgacgtccaccaccggcgcgaacgacgttcgcagcccgtagcgctctccgacggcccggatcacggagcgggcaagcacggaggcatcggcggctcccacgggatcgctcggggcgagcgagagctcgaactgcgccggtgcgtactccggatggagctgtgccaccgcgaggcccgccgtctcgagggcgtcgtacaacgaccggagatagtcggcgagctcgatcacgcgcgacagtccataggccggccccgacgtcgcgggcacgaagtcgtcttgaccggcgaggccgacgacccactcgagttcgatccccatcgtcgcgctggcacccgcatcggcgagcagggcaacctcgcgctggagcgccgagcgagtgcagagctcgtagggagtgccgtcgcggcggaagcggtccaccggcgcaaaggcccatccatcgagcggcgcgagcggcctcaggaaccgggggtcgggacggagccggaggtcgtccatcgggccaccgctcacgctcgaggaggtgatggagtcgtcggtgagaaaggcgtcgaagaccgggctcatgccgacaccggcgtcgcacgccacggcgaagccctcggccggaatcgtcttcacccgtgcgatcccggcaaggtccacgtagaccagcgccacctggcgagcgtcaccgagcgccgaaacgtcgctccccgagcggtcctccagatcgcgctgtgctcgctgctgcgactcgtcgacgaccaccacgcctccttctggccgatgcggctccgaacgtagcgcacacaggtcgcccgggccagcgctgtgacacaatcgtaacaacaatcccttgcgctgaaacttcagtaacagctaccatacgtgcaccgtcgagagggggacgtatggccggtggttccaccaagctcaggggcaatctgtcgctctggcaggtcgtcggggtctccgttgcgctcatggctccgtcgatggccgccaatatcaatcctcaaggtgcgatcggaacggtgggacgcgcgatcccactcaccttcgtcctggcgttcgttgcggtgctcttcatcgcctatgtcttcgcccgactcacccagcgcttcaaccacgcagggagtgtgtacggcttcgtcggcgcgaccctcgggccacgctggggcgtggtggccggctggtcgctgatcggtacgtatgtgtcctacggtctgctcacgatcatggcgtcaggcatcttcctgacagccctcctccaggcgctgtcgatctggcactctcctcctgcctgggccccgttcctgctctcggggatcgaggtcgtcggcgtcgccatcctcgcagcacgaccagctcgcaacgcgacgcacgtgctgctcgtcacggagctcacgaccgtggcgctcatcatcgtgatctcggtggcgaccctgatcgaactcgcggtgggacatggcccgagcgggcagcacttcacctggagcgtcttcagcgttccccatggcatcagcgtctcggcactgttcctcggggtcgtcttcgggttcttgtcgttcgcaggcttcgaggcatcggcaacgctcggcgaggagtcgaagcgaccacggcgtgacatcccacgggccatcgtgggaacagcggtcttcggcggcgtgtacttcatcgtcgtgaccgcggccgaggtgatgggatttggcaccaccccacacgacctcgcccgcttcgccgcgacgggatcgctgctcggcgcgctcgggacgacgtatctcgcggcctggctcggcaacgtcgtgacgctcggcaccgtgatctcggcctttggctgctcgctcgcctcgacggtcggggccagccggctcaccttctccctctggcgcgacgctcgcggtgcgagtgggctcggggtggcctcggagcgctccggtgcgcccgttcgtgcaaccctggccgtcgtcgtcgcgatgctcggcatcacctggctgagcgcgatcgcgttcggcgcgaccgccttcgatgtcttcgcctggttcggcaccatcggcaccctcatcatcctcgtcgtctacctcctcgccaccgtcggtgcgatccggttgctgttcttcaaggagcacaccgtggcggcgtgggagatcgtcgtcccggtactcgcgggcgtcgtcatcgcctacacgctctatcgcaacatcctgcccttgccgacaggtgccgcgctttggttcccgatcgtggcagccgcctggatcgtggtcggtgcgatcggcgtcatcaccgcacggcgaagcgcggagcgcatcggagcggccatcgcgcgcgacgaaggcctcaccctcccgagcgcgccgacgcccagcagccaggggcagccggcgccggccgactaggcatctctcgaccaccatccagatggggccgttccccacggccccatcccccacgtcacgtcgtctgaacctgccaccacgaaggagttctctgtgtccacgtcctccgagcaccgcctctccgccaacgccatcggacggcgcgaggtcctcttccagagcgtcaccgcgatggcacccggcgccgccatcgcggcttcgatcccggccggtgcaggcttcgctgggggagcgcttgccctcgcggtcgtcgtggcgctgatcggaagcctgctcactgccctctcgatcggtgagctcgcctctcggttcccgtcagctgggtcgttcgccacctacgcatcgaaggcactccaccccatcgtcggcttcttcgttggctggtcctacgtgttcgtctacgccctggtgcccgcactcctgtttctgcagctcggcttcacggtcgcggggaccctccacagcgagttcggctacccggcatcgctctggtggccatggtcgctcgcgggtatcgcgctcgtgggaaccttggcgttgctcggtatctcgacatcggccaaggccgggaccatcctcggcgcgatcgagatctccgtgttcgtcgtcgcagcgatcctgttcatcatccacgccggctcgcacaactcgttgacgccgttcacgacccgagacaccccccatgcgttccccggcctgaccggcgtgttcgccggctccgtctacagcctcctcgccttcgcgggcttcgaggcagccgctccgctcgccgaggaggcgcgcgatccgaagcgcaccgtccgcttcgccattctcggctcgacccttatcatcggcctcatctacgtcttcaccacctacgccgccgaggtcgccgccggacccagccacttcgcgtcctttgccggggctggcgccgagtcgtggattggtctctcgaggagcttcttcggtatcttctgggtgctcgtgttcctcgccatcttgaactcgacgatcggcaacgccaatgcgggtacgtcggtgtcgacgaggatggcctttgcgctcggacgcattggggtgttccccaccctgctcggacgggttcacgagaagacgaaggttccccacgtcgccgtctactcccaaatcatcgtctccgccgtcgcaacactcatcctggggctcgccttcggaccggagaacggcttcgctctcgacggcacgatcatcaccatcgtcgtcgtcgcggtctacatcgtcatgaacctcgctgcactcgtctacttcgcacgtcgcgcaaatggagagcgcttcaacccactcctccacggcctcgcgccgatcgtcgccatcgccttcctcctccccgcgctcctcgccggggccggcatcgctgtcttctcgttcatctcaccgctgaccccaccggcgtcctacgctggtcccatcgtcgccgtgtggctggtcgtggggatcgtcgtgttcttgaacctgcgtgcacgtgcgccacaggccgtcggacggattgccgaggtctacctcgacgacgtcctcgatgtcgaggaggcatgagatggcagtaccggtcgtttccttcacgccaacccctgaccagctgtgttggaccttcgggggagcagaccccgtcgcagagatcgaacccggcaccattctcgaagtgttcaccgaggactgctttgctggacgggtacgccgcacgacggacctcgtctcggaggtctgcgagttccccttcctcaatccccagaccggcccgttcgcgatcaagggcgccgagcccggcgacaccctcatcgtgcacttcatctcgatcgagccggcacgagactgggcggtctcgacgaccgtgccgctcttcggcgcgctcacctcgacccacctcaccgcaacgttgcagccacctttaccggagatcgtgtggatctgggaactcgatcgcgagcgccgcacgtgccgcttccgagcgtcgaagggcgacaccacgatcgagctccccatggacccgatgcacggaacagtcggggttgctcccgcgaatctcgaagtacgctcggccctcgtgcctgatgcccacggcggcaacatggacacgcccgagatgcgcgcgggcgtgacggcgtactttggcgtgaacgtggagggagcgatgttctccctcggtgacggccacgcgcgccagggcgagggcgagagctgcggggttgccgtcgagtgtgcgatgaacacggtggtctacgtcgatctcctcaagcagaccgcaaccccgtggccgcggctcgagtccgatcagttcctcatgacgaccggctcggctcgaccactcgaagatgccttccgcatcgcccacaaggacatggtggagtgggtagcggatctgtgcgaactcgacatcatggacgcctaccagctcgtctcacaagccgcgacctcaccgctggccaacgtctgcgacacgaactacaccgcggtcgcgaaggtcgatcgaacattggtgccgctccgacacgacccctatgcgagcgcccatcgccgagcgcgcgctgtcgcggcagaccacgcatccagtggatcgctcgactgaaatctcggatcctacgactccggggcctagcacgataggtagctccgctcccgctcgacggcgaggagactctgagggttcgatcgagccaggaccgtacgcaccgctgctggaccctgggcttcccttcgacaagttcacgcgctgggtttggtcctgtcctatcggcgagacgagaacgaccctatgcagcacacttcgaccccacagcacgagcgacggtgcccgatggccacgggcgcctggatcagcgttccatccttcggacgctgctaaggtaccgaccaatgcctagtctcctgcgcttccccgtcggtcaggcggtttttcagcttccagaacggcttaccgaggtcaactcatggcacgggcacatccccttcgccttctggatcgtcgaagcactcgagccgtcggtcttcgtcgagctcggtgtccaccgcggggactcctacttcgccttctgccaggccgtcaagtctctcggacttgacaccaggtgctacggcgtggacacctggaagggcgacgctcacgccgggttctatggggaagagatctacgaagacttctctgcgtacaaccgcgagcactatcaagacttctcaaagccattacgcaccacatttgccgaggctatcgagcagttcgaggacggcagcatcgaccttctccacgtggacggctaccacacctacgaggctgtcaggtcggactttggatgctggctccccaaactgagtgagcgggccgtcgtgctcttccatgacatcgcagtcaccgaccgggggtttggcgtctggcgcttctgggaggagatcgctgcgcagtacccttccttcggcttcatgcattcctttggtctcggagtgctcggcgtcggcaaggagctgccagacagcctagctagcttcttcgaagacgccaaagcgaaccctgagatcctgcactccttctatgaggcgcttggaacgagatgccaactcttcggcgatctccagcgcgctcgagatgagcttgcgaataccactgcagccccagctatttccgaggaagtagccaccttgcgccaacaagtactcgacctcacctaccgctacgaacgagcgctcgagcgtaaggaggcggaggccgaacagttagaagccaaggtggtagacctcgaggcacgccttggccagtcgtcgcactcggccgcagccctcgcagaacaccttgcgtcagtcacggctcaacgcgacgagatcctccaatcggagacctggaaactcaccgctcccgctcgcggcttcctctggtggatgcgtcgagtggcgaactggagacgcttcacacagacgttccgtgtcacactgcagccccttcagggtgttggcgagtcactcttcgagaccgacagcttcgtggctctcggtggcagaatgcgctttgcaatcgaaggcgcacctcggcctcccgggtggtacgagctgacttgcacggtcaccaccacctccgacctctcgaaaatgcgcccctacatcatcaccgagacacaagaccaccaacgctacagccaacagattccaggcaaggtcgacccagagggccagatccgagtcctgttccacgtcaacaagcaagctgctcgccacgagctgctgctcgtgggcctcaacgggatcacctccatttccgcaccacgcgtcaagccagcgctgcaccttggcgagccgatggctcgcatacttgccgccgcgattgttcccacaatcgcgtacgcagacctgccacccatcgcagctcatcaagagctcctcccgcaggaggacgagttctcccgctggatcgaacgcaacgagcggatcaatcaagacgaccgagagcgcgtcgcccgagagctcgccacctgggaacacccaccactgatctccgtactcatgcccgtctacaacacgccaatacggcacctcgtaaccgcgatcgagtcggtacgggcgcagtggtatccccactgggaactgtgcatcgccgacgatgcttcaaccgatccagagattcggccgatccttacccgctatcaggaggcggatccccgcatcaaggtcgccttccgagacgagaatggcggtatctcggcaaactcgaatactgcactcacgctcgcgaacggcaagtttgttgcatatctggatgccgacgacgaaatctccgaagtcgcactcctccactacgctcgagagattcatgagtatcctggagtcgagttgctcttctgcgacgaagacaagatcactgaagatggtgatcgctccgacccctacttcaagccgagcctctcccccgcgctccttctcgggaagaactgcgtcactcacctcggcgtctatcggaccgacaccgtccgccgcctcggcggaatgcgctcagagtttgacggatcccaggactgggacctagcactacgctttcttccgatcgtcggtatagacttcacgcgcgcacgtcgcatcccgcggctgctctatcattggcggcggatccatggctcgacggcaaccacactccgatcgaagagctgggccgttctggcggggcggcatgccgtgcaagactacttggatacagcagtgccaggtgcgaaggctgagcccattccgcgcgcctccaatctcaaccgactcgttctcccgactccggatccagctccattagtttcgattcttctgcctaccgcgggaaactatcagctacttcgcggctgcctcagctcgctcctcgaacgcaccgactacccccgcttcgaagtgcttatcacgatcgactccgacaaccccgacgcggactcgctcgcataccttgacacccttgagcacaccggaaaggtccgggtgatccggcgtcggcgcccgcctggcgaaacctttaactactcccggatagtcaacaacctcgctcgctacgcagcagctgacctcctcctgctcctcaacgacgacaccgaggtcatcaacgctggttggctcaccgagatggtcgcggtactatcgctgcccgacgtgggcgtcgttggcgcgcacctctactacgccgacggcagtatccagcacgcgggggtgatgactggacaccacagggcgctacatctttacagcgggctgccgggcgcaagctggggatactatgcagacttactactcgcgcgcaacgtgagtgcggtcactggtgcttgtctcctgacctcgcgtcgagtctgggacgaggtcggtgggttggacgagcagcttgcggtcagtttcaacgacgtcgcctactgccgcgcagcgggcgcactgggatatcagatcatcgtcaccccgcatgccaggctcaagcatttcgagtcagtgacccgaggcttcgacgacttgacgttgccccgcaggtcacggctcgcatcagaatttcagcgactcgccacactgttccccgacattgccgcagctgacccgttctacaaccccaacctcgtccccgaagggcaatttcggcttcagtatgaatcgccgataccggtggtctaaactccttcccccgcttgttgtctctgccgactaagcaacgtggcacccaaagacgcaatcaatgtcacaaccatggtacctctaagctggaagcacggctgctttccgagaacaccacgaagcccaatgaagatatcccagccgagaccatccggtcagcgctaacttattgagcccgacattgaatgacacgccctcttgtgaaggataagcacactcttgttcgcttgatagtgtggatacaggccctgagcgtctctgaacagcaatagcatgcgggcttcgccgacattggagatgcgagagcaagcgccacaatcgcgcttcaccctcgccacgaaggctgggcttcgccgatttgcttggcagtcggattgaggccaacaccacctcctgaccggcccaagagagctcgtactcgccggccgttaatatccaagcgtcgagtggaggcggaccgtcttgtagcggtggatccgcgtagcgtgggcttccccccatgtgcttgacagtctgaattgaggccacggccgcctcctcccgggcccaggagagctcgtactcgatcggcggtcggtacccgaggctcgagtgcagccggaccgtgttgtagcgctgaatccagctagcgatggcagagcgggcctcgtcgaggttcgcgaagcggtagcgagccaccagctcccgctcgcaagctcccgaagaaggcctcggccacggcgttgtcgtagcaggttgcgaccccgcccaccgactggcgaagcccgagcgtcgcgcagagctggcaaaccttccgggagaggtactggttggcgcgatcgctgtgaaagatcgccccagcgaggctgccccgggtccgaagagctccgcagatcgcctcgaccaccaggtcatcgggaatgcgacgctggagcgaccagcccacgatccgcctcgagccacgatctgccaccgtggcgaggtagcagaacccttcgtcgtttcggccgtcggtgatgtcgctcgcgtagtgactcctggctcgccaggggcggagtcctggcagacgagatccgggaggggtgcgtcttctccccgcctcgtcgtgactacgaagcgccagcgtgggcagctgccatctcgagctcgcgcattaggcgttccactcgcttgtggttcacgcagtaacccacgtcgtcgcagctcgtgggtaactcaggggctcgacgtaggtgccgtcgttcgcctcccagacggcccggacttcgctgacgagccaggtgtgctggggtcctcggctcggtcccgacggtgtcgccaggcgtagtaggcctggcgggagaccctggctgctcggcatggcaccgctaccgggacgccattggcctcctggttggcaaccggagtggtagcgggtcactggttgccccccgcaggatccgcaaagaccaggcaacgtttcgccaggtctcgttccatagtgagctgcttgacctggcggcgcaggcgggtcatctcctcgcgctccgcgctggtcagcccctctcgcttacctcgatcgatgcgttcctggcgcacccagttgccaagggtctgctcgttgatgccgagctcacgggcgacgtcggcgatggtgcggtgctggtcgaggacgagagcggctgcgtccttgcggaactggctggggtaacggccgcgtcgtcgtcgagcggggccgtcgcccggtggtggtggcggtgtctggtgcatcccttcctcctgtagcaggtgtcaacctggaggggtaaggccaggggtgttgcaagaccgattgaaccgaaccaccaatcgtttggacgtgaccgctcgctggacctgtcgtggcgggtctggccgccccgagggggcactagcgtgtcgacctcggatccaccgtgaagttggtcccggctctgaggtctgctcagaccgaccttggctccccactcaacccgaggtgctcgtgtttcgaccaaatgcatggatgcgccgcagtcacctcatccttgaaacgaccaagacccgctctcgcacgagttggctcccgaccgttcacctcactctcacgctctccgccgccgaggtctcggggccactcgtcctgaagaacccctcccgctccgtgcttgccctccgcgccgttgcgcagagcgctggccagacccttcgcgtgagcgcgacgggccccgagagcgcaagccttccggagcccgatggccgttcgctgctgctcgttggcccaggcaagaccacgctcaccatcgaagacccgctcgacgccccagcgaccctcttgatagcaccatcccgggaactcggcgagtctgcgcgcgatcttctcgacgaccgatgcgccgcagcagagcgagctcgcaccctcgcgcggcgattgctcgccctcaacggtgagagcgagcgactccaggcagcccagcgacacacgaacgacccgtcgtccaccctgccagatccacttcgacccctccgcgaggtacgactcgacggccggcccctcagaccgaccgagctgcacaccttgcttgcacgggcgacagtcgaaccctctcctccgtacacgtcgatcgccgtcgttaccctcggtcaggcgcaaactgcagcagccacggtcgactcgctgcgcgtcaccgaccccggcccatggcgcctgctcgcgtcagaacacgaacccaccctcgtcgcaaccgataccggagtcccctcgcgtatgctcgcggacaccgcagccgacgacgccctctccgacatcgatcacgttctcttcctgcccgctggggcaacactcctgcctggatggcgagaagagctcgccagagcgagcgccgacctcacgcttctgggtgggatcgaggtgcgtcaggacgtgggagacgttgtcctgtacggagagctcgatcccgtcctcctattctcgacgccagcgttcggcctcggcgtcgctgtgagacgcgatgcactgcctgcagaggtaccgctgccacatggcatcgaggggatctgggggcttgttgccgagctcgtccagcagggctgcaccgctgcaggcaccgacgcactcgtgctcgtcacgccgccttggcccaggaatgcggacgaggcgactgcgctgcccgaccgcctcgctggactggtgaacgcagagctcgtcggcacctcgcagactgagcacagccagtggcccccgattgtgctccaccaccgccttcggccgccctcgtgggcgagtgtctccgtgatcatcccgacgcacgacgcgccccagcaccttgaagcggccctgcgatccgtacgcgaggcggactaccctggcccggtcgagctcattctggtcgcccatcgggttcgcaacccagacgtagagcatctcctcgccgacgcgatgacctggggggcgagcgtcgtccgcgacgacggagccttcaatttctcccgcctgatcaacaggggtgctgagcatgcgaccggagaactcctgttgttcatgaacgacgacatcgcgccgacgggcaccgactggctgcgcgagctcgtgagcgcccacgttgcccacggtgcacgcgtcacgggggcacgcctgctcagcgccgacggtacgcgcatccagcacctcggccaggttcgctctgcactgggcacgctccagcacctgcacgtgggtcgacctgcggaggatctcggctactgcggccgcggtgctgcgaccgcctccgtcacctcggtgaccggcgccctgatgctggtggacgcggctcgattccgcgccgtcggtggcttcgacgagcgctacgacgtcgccttcggcgacaccgatctcgtcctccgactgcgtgcaaacgggggcagagcgatcgtctgcaccagcgcgacggctctccatccagagctcacgacgcgcggctcggacgcacggccagcacggcacctcgggttcgcctccgagtcgatggcgtttcgccgcgagcacgggtggcagctcgccaccgatcgatgcctcgccccgcgtctccgagcacgcgacgacacccttgaggtcgtgcccgcaacggggcgccacgagtgcaatctcgtcgccgtgcagctcggcccagaggacgctgggggtggtttcgacgtcgtcctgctcgactccgagaccgcgcagatcaccctcgagatgccgagcgacctaccgaccaccgagatcgtcgggatcgaactgcgcctcacgctcctcgggggtgacccgcaggcactgaccgccacgctcgacgggaccccactctcgtggcacccaagggccggtcatctcgccgacctccggtgcgacgagggcgtaccaacggccggtcgacaggtccaccacctcgacctcgtccccggggcagagctcgcgagcctgcgcgtcgtacccgcgccgacggcccaggtgaccgctccaacgacccgaggactcgagctcgcctgcgccgcgaccgcctgggtacgcctgcctcgccaacaggtcccgatgagccagccgcacgtctgagccactacctgggctcgtcatgcgtggggcgccgaggagtacacagcactcaacggactcctcgcccactgggcggcagcgtcgccgcctcgcgccgcaagtccgacgatcgccgacccgagaacgtcgctcgctccccaggtcggtggagacctcggtcaaccttggcgcactccgatgcgactcgcaccagagcgaccgaacgtctgtgcaccctcgcgaggagccacggccttccggcagcccatagacgctcaacccggacgatgcccccgagtcgctccacgaacgcaacacgatgtctggcgcaagagcgggagggtctgatgcgaacgccgggccctcagggctccccgcagccgcgacaagacgggcatggcacagctcacgaggagccgaccgatgccctggccgccagtcgctcgtaggtcgcaagcagggtactccaccgcgcacgcacggcgtcgtagcgctcgtggacttgggaagcatcactcgccgcatgaggggcgtcgccgacgtcgcggggtgtgcggatggctgcgcacagcgcatcgacgagttcgccaacgagcaggggctgatcgctccggacgacgacacaacgacgatcgaggtctgcgtcgtcaacgaactcgacggtcggcccctcatcgtcgacgaccaccacgcacagcgatcgctgcgcaagctctctgaggacgcgggcatcgggcaggggccgcacccacaccctgcgaccagcgagggtcgtgacagcgcccggtgcccgaccacctcccaccagtcggagaaccccgtcgatgtccgtacacgcctgcgcggcaaggcgcgccacgagcgggccgcggtcagggcgagggttgggctcaacgagcaccacgagccgatcgagacgaggcgccggaccatcatcgaggtagagccacgccggatacggctcgctcaccacctcctgatcgcgaaggacggcccccgatgcagcgacccacctcgcaagagcaccatcgtgcacgagcacgtcgtcactcccagcgacgaccgtgagcagatccgtcgtcaggggcctcaagcgtgtcccgagccggagcacggcatcctggtccactggcccagcaacggcagccgccacctcggcgagtaaccgcgcgacgtcgacgtcctgagcgtggagctcgacgacccgtcggcctgaactcgtgagcaccgccgggacctcaccgtgcaaggcatcgggtgcgagcaccagctcgtggagcgtacagacaggatcggggtgacctgctcccagttcagtccgcagcagcgtcccgacgatgccgtccgactcccagcctggcgcctggagctcgaggtcaaagcgagcatccagcacgcacgcgagctcgccgaggtacgaccgcaacccatgggctcgatcggcaccccagcgtccgtcgggctcgagtcggggcaagcgcagtgccagcgtcggtcgtccggactcggtcacgctcggcgtcccgagcgccgcaccgatcgcgtccgcgctgcgtcgccccacctggtcccacgactgacgctgcacgtgctggcgctggcgctcgaagagctgctcgcgccaccccgacactgcggtcaattgtcgcagcagaccgaccaggtctccgacgtcacctggccgaaagagcgcctcgggagttcccagcgcctccgggagtccaccgacgtcgctcgcgagcaccggcgcaccacacatgacggattcaaccgccgggagcccatacccctcgtcgagcgaggggatgacggtgcaccaggcagacgcataggcgcgcaccagctcctggtcgctcaacccatgctcgacccgcaagcgatccgacgggatccccgccctttcgccataccggcggatgcgcggtgcttcctcctcgttggtcacaaggtgcactcggagccggtcgtcctcgcgcatcgcgatggcggcggcgtccaccaggacctcgggccgcttgcggtagtcctgatggtagacgtagagcagcgtcctcgacgcatcgtcaggggctcggtctccacgcacctcacccgtctcaacgccgccgaacggcgccgagccgacgacgtgcacgcgttcgggctccacaccgaggagggtcgtgacgtcgagcgccacggcgtgggagatgcacagcagggcgtcgctcgcccgcaggacgtcgagctggcgccgataccaggcatagaaagcagggtgcggcgcgagatacagcgccgggtgacgaagcgggatcaggtcgtagacgacgctgaccagcctgcgtgcccagtgaggacgctcgctcggggccatcgtcatcgaggtctggaagccctcgaacggactcgcgaccaccagcacatccacctcgccgggcgaggtacgcgtccacccgctcgcgtcgatcggcatcccctcgtggccacggcgcggctcgtgcgaaatcggcgtccaccgctgacgagctgcgcctgcttcctcgacgcttgcgcgcaacgaaagtggcaccggcacgttggggctcaccagccacacccactcggtgtcggggtcgaacgaacgaacgagcgctcgcgtgaactcacgcacccagcgtccaatccctcgattggcactccccccttgcgcgccctgaaggtcgacggcgacgcgcacgtcagcccctctctcgaagctcgggagccagggtacgacgttctggtgcctcgacggctccgagccgatgcttgacatcggcgacctcacgcacgagctgctcagacagcgcttcgagcgaggccaatgcctcgaggcgcccgtaggtgtcctcaagaagacgtccctgggccttcgtgctctccctcaccgcagactccaggtcgccgaggaggcgctcaagcctgtcgacgcgctgggcgacctcgaacacggctcgccgcgtcgcgggggcccgcacctgcgccgcaacggcccgagcaagggaaccggtgagtccgccccgcacgaggaccctcgcccgtgccacaagctgggtcacgagtgggggtgtgacatggcgagcggggccggggtggccatctgctcccggagcggtccgctcacgccacctcgcgcggatcgccgcgtccatcggcagtgcatcgaggatctccaggagctcacgcgcaccgtcatgccacgtgcgatcgacgatgagcgggtgtgtcggcggattggtgatcccgacctcctggatctctccgaggagcgcagcgagcgcggaggcgtcgcccggcccgacgaatctggcatagccgtcgaagagttcgcgatggaccggaatatcgctcaagatcagcggtacgccattgaccgccgcctccacgctcgggagatcgaaaccttcctcgaccgagagcgagaggagggcgcggcttcccatgatggtacgccacaacttctcgtcagaggcgtctgcaagccaggtcaacggccgcccggcctggacgagctcctcgatgcgagcgccgatatggttcgcacgccatcccaaccgaccgacgatgaccagggggaccgatccacctgcctgccagtgagcctcgaagccgtcgaggacggtcgtgtagttcttccggggctcaagggtcccgaccgcgacgaccggaccgctctgtacgtcgacgatccgctgtgcagagggctgccgagcatgcatgcccgagagccagcagacgcgcacacgctcagcggccagctcacgccacggcaccgtccgcgccagcatcgctctcgtcgcctctgccgtcgatcgcgagaccgcgacgaccccgtctgcgaacgtccctacctcgagcatccacagaccgaactggcgcacgagaccttcgtcggcggtccaggagtgggtgagagggacgacgtcgtgctgcaggaccgcgagtcgcatcccctcgagccaccacggggccaagcgatagctcaggcccaggtgccagctgctgtcggcgacgaagacgaggtcgtcacggctcagctcgagcggccgcctgggcacgccgagcggcttgtcctgcgggcgagggatgcgggcaagctcccagaccgtcgggccaacggcctcgccccccaagctgcccaccaccacgtctcggccacgacgacgaccctcgacgacgagcgcctctccgagttcgcggacgaccctctggatccctgtcgctcgccacggttcgcgatcgatgtaggagcagtcccagatgatccgacctcgagcttgcgcggacccctgcgacgcgttcgaccggcgagaggggctctgcatgctcccgcatgctagcgctcgcccacccgcgcgactagccagcctccgagagacgccgacacctgcggagacgagcagcgcgagggccgaagccagtgcgccagagggcgaggcccgacgacccagcgcgacgaccgacgacgacccaccggccccgggaagccgacaacgggcacggggacggcatctgcgccaccagagacgagcaacggggcgggggcaatccgtgcccccgccccgtcctgatgcctcatcgcatcgtgcgcacatgcaccgacctatgcgctgatcgaacccccggctgtgaacgggcccgtgtcgccaaacgccggacccgatcccatgtactcggcattaccgaaggcgaacacgccgccgtcagccgcgaggagccagtagcccatgccgtcgggggtgggcacgaggccgatcaccggttgggcgagcgggtgagctccgtgcaagccggtgagcccgtccgtgtaggtgttccccatgtagtgcgcatcaccgaaggcgaacacgccgccgtcagcgcccaccagccagtagcccatgccgtcgggggtggaggcgatgccgacgatgggggcggcgagcgggtgagctccaccgagccccgtcaggccgtccgtgtaggtgttccccatgtactcggcatcaccgaaggcgaacacgccgccgtcagcgcccaccagccagtagcccatgccgtcgggggtggaggcgatgccgacgatgggggcggcgagcgggtgagctccaccgagccccgtcaggccgtccgtgtaggtgttccccatgtagtgcgcatcaccgaaggcgaacacgccgccgtcagcgcccaccagccagtagcccatgccgtcgggggtggaggcgatgccgacgatgggggcggcgagatgcgtcacgccagccgtttgcaccgatccgtagctgggcgcgccacccaccgacatcaccatgccgctcgccgtaacctcccagcccgcaccggccatggcggggtcaggcgcatagcccacgacaccgctcgcgggtgccgccggctggccagtacccagcggaccgaagctcgacacgtgcccattgccccgcacgaacgcgtacgaaccgtacgcggtgttcggcgccatcagggcgttcagcgtcgaggagttcgagtcgtcgtagtagacctgcagctgacccatcgcgttcgtcgcggtggcgaggccgaagaggccgccggcagcgccggtgtcgagcactcgggtcgcgacgaccatcccgttcatcgggttgatctcgagcaggtcgttgttcgtcgcaccgttcacgacgagaagatcgccgttctgcggattgatcgcgatgttctgcggcgactgcaggagtgggctctgcgacacgaccatgggggtctgcggcgtcgtcgcggtcagcgcgttcggaatcgcatagatggtgttgttcacgtcgtcggcgacgtagagcatcccgttcgccgggtcatacaccatgccctgaggcccaccggcattggacgcggtttcaccaccggagacgttggagttggtcgggagccctgtcgcgagcgccgtgtaggtggcgttcagcggctggccgttggacgtgccggtcgggttggggttgagccgccacacctgtccgtcagcgccggtgttcgacacggcgacgttcgaccagaagaaggcacccggtgcgaccgcggccccccaaacgcccgcgaaggtcgagtttgtgctcgtgtagttcgcaatcagcgtgcccgaggagttgatcaccgcatacccagaacctgaaccgttcgctgtgctcccccagtagccgacccagacgatgtcgttcgaggggttgatggcgatccccaccggtccggtgatgtcggcgttctggtagaaggtggtcgattgaccggtcgtggggttgacctcgacgatgctcgtcccagcaccgaacgtgccggccgacgagttgaaatctgccacgagcacgtcgcctgcgacgagattgcccatcgtcttcggtacgacggcgacgccgtagggattcgtatcgttgttcgacgctgtcgcggacccgaccttcacgttggcgagctgggggaacagattgcccatcggactcgtctgcgcaacgagcgctgaactcgagacgcccgcgagggcgagcagcgcagaagcggcgaccacgccgccactcgcaacgccccagcggcgcttccacggactccttggcatgagggacctccttggcaccactcgtcagcggccgccagcagcacacgccccatggggtgtgtggtctgcggccacggcacgcttctacgtgccgagaggaggtacgtacgaggaccccagaacgttcacggatccacgccgacgggcctcatcaacccttcagcattggccttcagcattggaacgtgccggggcctcgtcgcgccggagtggctcacgccgccttgacggccgcgacgagggcggcgagcgacgccttcgcgtcgccgaagagcatcaccgtcttcgggttgtagaacaagggattgtcgaccccagcgaagccaggccgcatggagcgcttcaagaacaccaccgtcttcgcctcgtcgacgttgaggatcggcataccgtagatcggactcgacgactgcgtcctcgcggcagggttgacgacgtcgttcgcgcccacgacgaggaccacgtcggtggtccggaactcgtcgttcgcctgctcgagatcgtggagctgctcataggggatgtccgcctccgcgagcagcacgttcatgtgacctggcatgcggcccgccacgggatggatcccgaagctcacctcgaccccgcgcccctcgagagcgcgcacgagatctcgcaccgtgtgctgcgcctgggccaccgcgagaccgtagcccggaacgatgacgaccttcgacgcataggccagcatggttccgatgtcgtcggcggtccccgatcgaacggtcgcaccctcggggatgccctcggcgccgcccgcgcccttaggcgccgagcccaccgccgcgaagaggacgttggcgagggagcgacccatcgcgtccgacatgagcttcgtgagcagtgtcccggacgcaccgacgagggtgccgccgatgatcacgacggtcgagtggacgacgaaaccggtcgcggcgacggcgagaccggtgaaggcgttcaggagcgagatcacgaccggcatgtccgcgccaccgatcggcagcacgaacgccacgccgaggacgacggctgcggcgaccagcacaccaagggccacccgatcggtgggccccaccgcgaccgcgaccatccctccgatcaccgcgagcagcaagagcgcgttcacgacctgctgggcggtgtaggtgatggggcgcccggtcatgagttcttggagcttggcgaaggcgatcgccgaccccgcgaacgagatcgcgccgatcgcgaccgagagcaccgaggccaccgacgcgagcgtcgcacccccacctcgcgtggcgagcacgctcacgatcgcgacggtggaggccgcgccgccacccacgccgttgaacgccgccaccatctggggcatcgccgtcatgcgcacgcgacgcgccgagaccgcgccgatcaccgcacccacgacgacggccgcgaccgcgagctcgacgaccccggccgagggatgctcaccgacgaggctcgcggcgatggcgatcaccatgccgaccgcggccgtgaggttgccgcgtcgagcggagcggggtgaggcgaggccccgcagaccgaggatgaagagcgacgctgcgacgaggtaggcgatgtcgacggcgacctggcgagcggcgagggccgcgaggatcactgctggctccttcgccccttgaacatctcgagcatgcggtcggtgacgacgaagcccccgaccacgttgatggtggcgagcaccaccgcgaggacaccgagtgtgacctcgagcgccccgtgcgcaccgaagagaatgccgagcgctccggccaggatgatgccgtggatcgcgttcgatcccgacatcagcggggtgtgcaggatcgtcggcacgcgcgagatgacctcgaacccgatgaaggcaccgagcacgagcaccgtcaggtcgttcagctcaccagcggtcatcaaccccccgatcgtcgatcccactcagcctaggcggggcgcgaccagcggatctcgccgccgtcgacgaccagcgtcgcgcgaaccagctcgtcgtcgaggtggagctcgccgtccgtcaccatgagctcgacgaggttcgcgaggttgcgggcaaaggtctggctcgcgtgcgtcgggagctcggcggcgaggttcgacgcgccgacgatgcgtaccccgttcgtctcgacgatctcgccgggacgcgacccctcgacgttgccaccggtgtcggcggcgagatccacgacgaccgcgccgggccgcatcgcctcgaccatcgcgccgctcacgagcctcggcgcctggcggaacgggatctgggcggtcgtcacgacgaggtcggcctcggcgacgcgctcggcgagcagcgcccgctgtcgctcgaggtactcctcgctctgggcggctgcgtacccgccttcgccctcggccgcatcgagcggcacctcgaggaagcgagcgccgaggctctccacctcctctctcgccgcccgacggacgtcgaaggcctcgacgcgcgcaccgagccgccgcgccgtggcgatggcctgcagaccggccaccccggcgccgagcacgagcacctgcgcgggcgtgagcgtgcctgcggcggtcatctggagcggcatgatgcgcccgaggaggttcgcacccaccagcaccgccttgtaacccgcgagcgaggcctgcgaggagagcacgtccatcgactgcgcgcgactcgtgcgtgggaggagctcgagcgcgatggcgccgagtccgcgcttggcgacggcctcgaggatcgcatcgtctgtcgcgagcccgagcagtccgacgacgagacccccggggcgtacggtgtcgagcacctcgccgggcggcggcccgatggcgagcagcaggtcgggtgcgagcgccgcaaggtcggtgagcgtggccccctgttcggcataggccgcatcggaaaagcctgccgcagcgccggcaccgtgctcgagcactacctcgacaccgagccggctgaggcgtcccaccgtgtccggcacgatcgccaccctgcgctcgtcgtgcttgcgctctctcgccgctgcgatgcgcatcgccagccccctgcctccacccgtcccacgaccaaccccagtcccaccaggctaggggccacccgagccaaccgcgccgcgccccttggtgaagtactcgaggctgcgcgcgatcagaccgagttccatcgcgcgcagcaccgcagacgtgcgattggtcgcaccgaccttgtcgaagacgtgggcaaggtgcgtcttgaccgtcgcttccgagatggcgagcgcctctgcgatctcgacgttcgtgcggcctcgtgccacgagctcgagcacttgacgttcgcgatcggagagcacgacgtccgaaccgaggacgcccgccacatccccgacgccgacgaaggcgatgcctcctcgcgccacccggcgcaccgcgtcgtgcaggacggcctcggtggcgtccttgagcacgtagccacgcgctcccgcctcgaccgccgatcgcacgaggtacggatcctcgtaggcggtcacgaccagcggcgcgcccgtcccccgcaccgagagccacgcgatgagccgcaccccgtcaccgtcggcgagacgcaggtcgcacagcaccacgtcgggtgcgacccgatcgatgacggcgcgtgcctcgctcacgctcgctgcctccccgacgaccgcaacgtcaccggcacgctcgagggatgcggtgaggccacggcgcacgatcgggtggtcgtcgaccagcacgacccggatcacgcggtccacgcaggctcctcgatggctcgggccatccgatacggcagacgggcggcgagctcgaaaccaccgtgctctctcgggtgggcctcgaacagacccccgagacgctcgacacgttcggcgagcagcgcgaggccgaggtgcccctcgagctggcgcgggtcggccggagctgcgccgtcgtcgaccaccccgagcacgagctgcgctccctcgagtcgggcctcgaggcggacgcgggtcgcaccgatcgcgtggcgaaggacgttggtcgagccctccgcgagcaaccgtgcggcgaggtccagtaccatcggcggcaactcgagcccctcgaggtcccccaccacctcgacctcgagacccgccgcgcgaaggcgcgccgcctccaccaagaccacgtcggcaagcgcttcgggcgactcctcgcgccgtcgcagctcgcggatcaacgatcgagtcgcctcgagacccgcgagcgaggcctcctcgatgagccgtgccccttcggtgggcgcctcaccacgcaccaagaggaggatgcccacgaggtgttgggccacggtctcgtggatgcgcgcggcgagtcgctcgcgttcgtgcagctctcccatgcgataggcgagctcgcgcatggtggtctgggcagcgcgcagctcgtcgatggtgtggcgcaggagttcctcgtggcgcctcgtgcgctcgaggaacaccgcgagcatggtgcccgcggcgatgtcggggacgtaccaggacacgatggtggcccagggaacaggggggcgagggagcaggtgcgtctcgaggccgacgagagcggcgacccccatgacgaccgggaccgacaccgaggccgccagcagcacgtaggcgaggaagctccaagcgagcaagaggtaggccgcgttcgcatcgagggccaccgccaccagcagcaaggtgccctcgagtcccacgagcagccagcgggcgagcccaggccgctcgaagccgaccctgccgagcgcgagccacaccgccaccatgagtgcgaggacgaagccgaccgacacggcacgcacggccgagccgatcggatcgagcacgatcacgaagagcgttcccgccatcgtgacggtgccgagcgcctcccacccgagtcgcaccctgcgtccggtgcctccggcacggccgcccagctcgctggccatggacgcatcgtagcatccgacggcgaccccgatcgggatgcgatcggccgtggtatcgaccctcgacgacgatttgcgtcgcatccttgtcaacaggcgatgtaatccttagactcagagccagaacacacacgaatccgatccaacggaaggatcccctatgacactcgtcgaccgtgatcgtctcggcgcgctcctcgccgacgaggccgagcgcttccgtgccagtcaccccgtgagcgcccagctcgccagccgacggggcgagcatctcgtcggcggtgtgcccatgacctggatgcgccggtgggctacgccgttcgcgatcaccgtcgagcgcgccaagggctcagaactcgtcgacgtcgacggccaccgctacctcgacgtgtgcctcggcgacaccggtgccatggcgggccacagccctgagccaaccgcgcgagccatccgtgctcgcctggagtcgggtggtctcaccacgatgctcccgaccgacgacgccgaggtggtcgcggacgaactcacgcgacgcttcggagtcgagcgctggcagttcaccctctcggcgaccgacgccaaccgcttcatgctccgcacggcgcgccagctcaccaagcggccgctggttgtcgtcatggactggtgctaccacggcacggtggatgagtccttcgtcgtgctcgacggtgcgctgacccgctcgcgcccggggaacgtcggccccgccgtcgatccagcgacgacgacccgtgccgtgcccttcaacgacctcggggccctcgaggccgcgctcgccgaccgccaagtcgccgccgtcctcaccgaacccgcgctcaccaacatcgggatcgtcctccccgatgagggctacctcgaaggcctcgtcgagctcgcgcaccactacggctcgctcgtcgtgctcgacgagacccacacgatctcggctggcccgggaggcctcaccggcaagctcgggctccgtccggacggcgtcaccatcggcaaggcgatcggtggcggcgtcccgatcggtgcctggggacttcgtgccgaactcgccgacgccatcgtcgccgaccgagacgccgacctcgaggacaccggcggcatcggcggcacgctcgcgggcaacgcgctctccctcgcggccgcgcgcgcgaccctcaccgaggtgctcaccgaacgcgccttcgacgagatgggtgcggtctcccacgaactcgtgcgacgcgagcgagcgctgctggccgaccatgggttcgactggagcgtcgtcgagctcggtgcccggagcgaggtgcgcttcgtgtccccgcctccacgcaccggggccgactcggctcgcgcggccgacgtcgacctcgaccgctacctccatctcgcgctcgccaatcgcgaggtgctgctcacgcccttccacgcgatgacgctcgtggcgccgacgacgacgctcgcccacgtcgagacctacctcgacgcgctcgccgatgcgctcgcgccgctggcgcgctgacctactggccctggcccatcgagaagccgggtacgccgtcgaaggtgaagagcccttcgaccttgacgaacgcgaggccggcttcggcgagcgcgccgaggagcgcgacgccctcggcgggcgccatcgcaccggcgtcggtcacgaaccggcaccgccaatggtcgacgcagaaggtctccggcaacccgtcgggccagaccttctggccgcggttcgtgatcatgtcgaggcgaatcccgaccggcgcggccgccgacaaccgctcggcgagctcgtcgacggtgccggtccactccacgaagacatcgagaccgacctgcaccttcaccgacgcatgccgtgggctgggttcgacgcggatggcctcggcgctcgcggggtagtgcaccacgggcagcgtcgcaggcgaggccccgagccgctcgatgaccgccgccgcgaacccctccgtcgagaccttggcccgagagcgctcggggtggtagacgtcggcggtgtggatgccgtcctcgatggtggcgagccatgcgttgtggacgcgctcggcgacgtccccctgaccgacgtgcacgagcatgagcaccgcagccaacaggagtcccgaggggttggcgatcccccggccggcgatctcgggcgccgagccgtggatggcttcgaacatggcgacctcggcaccgacgttggcgctcgcaccgagccccacggagcccgcgacctcggcgacgacgtcggagacgatgtcgccgtagaggttcggcgtgacgacgacgtcgaagtcctcggggcgtgccgcgaggcgggcggtgccgatgtcgacgatcaaggtctccgtctcgaggttcggatactccctcgccacctcctcgaacacctgacggaacaggccgtcggtgagcttcatgatgttgtccttgacgaggcaggtcaccttgtgacgaccgtggcgctcggcataggcgaaggcgtagcgcacgagtcgctcggtacccggtcggctgatgagcttcaggcactgcaccacgtcctcggtctggcgatgctcgatgccgccgtagagatcttcctcgttctcgcggatgacgaccacatccatgcccgggtgcgcagtctggatgaacggggcgtacgtcgggcaggggcggacgttggcgaacaggccgagtgccttgcgaatcgtgacgttcaggctcttcatgccgccgccgcgcggggtggtgatcggggccttcaggaacaccttggtacgccgcagcgactcccaggccgacggctcgatccccgacgtgatcccccgacgccagagcgcctcgccgacctcgatggtctcgatcgcgagccgggcgccggccttctcgagcacctccagcaccgcgctcatgatctcaggtccgataccgtcgccgtaggcgacggtgatgggggtcggctggtcgcttcctcgtgccatcggcgacggcctccttcgcggttcgcacgcgctggccgaccacggccccccacgccgatgaccggccaggcgttctcatcgtgagggcgctcccccagcgcgcctcggccctcacgctagcggcacatcctcgccggctccaatcgacactcacgccgatcacgcccgcgttcccccgaccggtggcgagcacccgcgcacgagctcacctgactaggatcgccgccgtggtcgccgaggatgccgagcacgccgctctcgacacgggcatcgagtcgcgcacgtcccggcagccctccgcacccacctggaccttcctgacgaaccacggtcatgtgctcgtgtgcatcgcgcgcgatcccggcatcagaatccgcgacatcgccgagcgggtcggcatcaccgaacgagcagcccagggcatcgtcgcggacctcattcgagcgggctacgtcgttcgcacccgcatcggccgtcgcaaccactacgagatcgaccccacgcgcccggtgaggcacccggtcgagcagccgcacctggtcggtgacctcctcggcgccctcgctgcgctcagcgaccacgacaccctgggcagccgccccggcaccgagaccctcacggggtcgtcgacgtctggacgctgaaggtggtcccgcccgacgacgaaccgagcgggctcgtgatgtcgccctgggtagcgatcgagctcgccgtggggaactgacagaccgggttgatcgacgacgccgtcgagtcgctgaaggcgagtggcgcgagcgtgaaggtggtcccgggggttgcgaccgcgagcggatcgaggaacgacgtcaccgacggctccgccggcaactcacacgtccccgtcgacgtggcgaccgtcggggcctcggcgatccactccgccgagttcgcgggccccccgtagctgatcggcgtcgcggcaccgatcgtgacctgctgcgccgtcgtgagatcggcgatcgtgatcgtccactgatcggccccgacctcggtgatcgtcacctccatggtgtcgccgggactcaccgacagggccgagggcgagatgggcacggccggttgttcgttcgacggcgtgatctcctcccaccacgcacactccgccgcggccccagagccacagaatccctcgcccgcgaacgcctggttcccgacggcgacgcccgcttggagcaggtacgaattcgtcgcaccgtccaccccgatccacacactggtatcacagggcacgctgctctcgcaggtcgtcgacgttgtctgcggcgtcggcacgacgaagcgcgtcgacacgctcgtcaccgaaccccgggccgcgccctcgagcgcataccccgaccaattctgcgagacctgctgcgacgtctgcgagccgatcgccacggtccaggcctgactgagggtcgcggtctcgcccgccgagtccgtgacgctgaaggtggccgtcccggaccctgcagcgaggggcacaccgacaagctcgccagcgctcgtcagcgagagcccagctggcaaaccgctcgccgaccaccggtagccgggcacaccaccggtcggactgagggtcgccgagacggcgctcgcgacggcgagctgcgagagtgcctggctcgcactctgggcatcgatcgcgagcggtggcggtggcgcgagatcggggacgatcccgaccacgggggcggcgagggggcgggagccggacaggcccgtcagtcccagggtgtaggtgttgccgtagaagccggcgtcaccgaaactgaacaccccaccgtcggctgccaccagccagtagcccttgccgtcgggggtcggggccatggcgacgatcggggcggcgagggggcgcgatcctccaaggcctgtgagtcccagggtgtaggtgttgccgtagaagccggcgtcaccgaagctgaacaccccaccatcggccgccaccagccagtagccgttgccgtcgggggtcggggccatggcgacgatcggggcggcgagggggcgggagccggacaggcccgtgagtcccagggtgtaggtgttgccgtagaagccggcgtcaccgaaactgaacaccccaccgtcggctgccaccagccagtagcccttgccgtcgggggtcggggccatggcgacgatcggggcggcgagggggcgcgatcctccaaggcctgtgagtcccagggtgtaggtgttgccgtagaagccggcgtcaccgaaactgaacaccccaccatcggccgccaccaagtcatacccggggctgatcgtcgccgaggcgagcgcgctccggcccggggccaacgcgtcggaggacgacgagcccgggcgaagggtaatgaaggcgcttgcgaaggcggcagcgagcacgacgaggagcagcgtccgcagcagcggacgagccccccatgccagcgtgcgaccgcccacaccgcctcccgtcatcagggtatcgactcgatctcggaccggctcaagccagaaccgaccataccgaggcaggaaggctcagctcactgtcaacttagacggcgagcgcgcgcgtcgagggctcgatcggccgtggcaagtcgcttgcgcccatcagccacgcatcgacgtcgtgcgcgaccgaacgtccctcggcgatggcccacaccacgagcgactgcccgcgcctcgcatcgccagctgcgaacacccccggaatcgaggtcgcgaagcggtcgtcggtcgcgatggtcccctgaggcgtccgagcgagcgcgcgctcggggtcgatgcggtcgagttccggaccgacgaagcccatggcgagcagcacgaggtcggcctcgatgagctcgtcggtcccggggaccgccaccaggttgccgtcgacgagctggacggcttcggtcgtgagcccgaggactcgtccgtcctcgccgcgctcgatgcgcaccgtgcgacgcgcccagcggcgatcgccgccctcctcgtgcgcgctcgaggtccgcagcagcaccgggtacgtcggccaggggtgtcgagacgaacgctctcgcggcggcgctggcaggatctcgagctgcaggacgtgcgctgccccttggcggtgcgccgtgcccaaacaatccgccccggtatcgccgccgccgacgatcaccacacgcgcgtcacgcgcgctcggtgcgccgacgatcggggtcccgagcgcctcgaggttggccgcgcgcaggtagtccatcgcgaagtgcaccccggctcccgcgcgtccctcgaccacgagatcgcgaggacgggtggagccgagcgcgagcacgacagcgtcggcctcggcgacgagctcgctcaaggtgacgtcggtaccgacgcccacgccggtgcgtaccgtgacgccttcggtgacgagctgctcgagacgccgatcgacgaggtgcttctcgagcttgaactctgggatgccatagcgcagcagaccgcctgcacgatcgtggcgctcgagcagctcgacctcgtgcccggcgcgcgcgagctgctgcgcggctgcgagaccagcagggcccgaacccaccacgaccacccgacgaccgctgcgacgctgggccacgatcggtcgatcgacgccgcgctctgcggcctcgtcggccagggttcgctcgatggcctcgatcgagaccggatcccgattgatcccgagcacacacgccgcctcgcacggcgccgggcagagccgaccagtgaactcggggaagttgttcgtcgcgagcagtcgctctgccgcgcgctcgagctgcccgcggccggcgagctcgttgaactcggggatcacgttcccgagtgggcacccatggtgacagaacgggatgccacagtccatgcatcggcgcgcctggcgctcgagggttgcggggtcgaaccggtcggtcacctcgtgccagtcgcggatccgaagcgctacgggtcgcttgggcggaccctctcgctcgaaggtgagaaatccctgcggatcagcggccatggcgtcgcctccttggctggctcgcgcctcgtcgggtcgtggtgcgcctcgtcatgcgggcatcctcatgacgcggtcggggtgcgctgacgcagggcggcgcgtcccatctcgctccgaacgcgcttgaagtcgcgcgggtagacgcagaggaagcgatcgagagcacccggaccctcggccacgatctggcgcgctcggtgcgatccggtcagctctgcgtgccgagcgacgaggttccagagtcgatcacgctcctcatcgggaacgggatcgaggtcgacgagactctggttcacgcgcgccagcaaccgctcgtcgggatcccacaagaacgcgagcccgcccgacatgcccgccgcaaagttgcgtccgaaccgccccagcaccaccacgagaccaccggtcatgtactcgcacccgtgatcaccgacgccctcgaccaccgcgacggcgcccgagttgcgaacggcaaagcgctccccagccacaccgcgaacgaagcactccccgctcgtcgcgccgaagagggcgacgttgccgacgatgatggtgtcgtccgtcgaccaggcggcctgggccggaggacgaacgatgagccgcccaccggagagccccttgccgacgtagtcgttggcctcgccgacgagctccaccgtgaccccgcgcggcacgaacgccccgagcgattggccggcggctccgctgaggcgcagcacgatggtgtcgtcggcgagccccgcctccccccaccgtcgggtgagttcgtagccgagggtggtcccgaccgcccgatcggtgttggtgacctcggcggcgatggtcaccccctcgccgcgctcgagcgccgcctcggcttgggcgatgatgtcctcgtcgagccgcccggccagcacgtcgggttgggagcgaacccgccggcgcgcctgccccggccacggctccggcgcccacgtcagccgttcgagtccgagctggcgtgcctccggtgcatccacgacctcgagcaggtccgcacgaccgatgatctcgtccaacgaccgggcgccgagcttggccagccacgcgcgcacctcgtcggcgaggaaccagaagaactgctcgacgaactccggccgaccgctgtagcgctcgcgaaggaccggattctgcgtggcgatcccgaccgggcaggtgtcctggtggcacacccgcatcatgatgcaccccgacaccacgagcgcggtggtcgcaaaaccgaactcctcggcaccgaggagcgcggcgacgatcacgtcgcgtgcggtcttgagctggccgtccacctggagggtcacccgatcgcgcagcccgttggcgagcagagtctggtgcgcctcggcgaggccgagctcccagggactccctgcgtgggcgagcgacgtgagtggagccgctcccgtcccgccgtcgccaccggagatcaagatcacatcggcgtgcgccttggcgaccccagcggccaccgtgccgacgccggcctcggcgaccagcttgacgtgcacccgtgcccgcggattggccgccttgaggtcgtagatcagctgggcgaggtcttcgatggagtagatgtcatggtgggggggcggggagatgagccccacaccgggggtcgccatgcgcgtcttcgcgatccaggggtagaccttctggcccgggagctggccaccctcgcctggcttggcgccttgggcgatcttgatctggagatcgtccgccgatgcgaggtagaaactcgtcacgccgaagcggccggaggcgacctgcttgatccgcgatcgacgatcgagaccatccgcgtcagggaacgcacgttcggcgtcctcgccaccctcgcccgagttcgagcgcgctccgatccggttcatcgcgatcgcgagggtctcgtgcgcctccttcgagatcgagccatacgacatcgcaccggtagcaaagcgcgtgacgatggcctcggcgggctcgacctcctcgatcgggaggggatcggccgcctcgcggatcgcgagcaggccccgcagcgtcgcgaaccgccgagcaccctcgtcgacgagctgctcgtagcgacggaacacctcgatgcgcccctcacgcgtggcgtgctgcagcaagaacaccgtctcggggttgaacaggtggtattccccctcacgacgccactggtagaggccgccgacctcgagctcgcgatgggcctctgcctcgggtcgcacctcgaaggcacgccgatggtggtaggcgaccgtctcgtggatctctcggaggccgatgccctcgatcggcgccggtgtcccggggaagtactcgtcgacgaggtctcgcgccagtccgatcgcctcgaagacctgtgcgccggtgtaggaggcgatggtggagatgcccatcttcgacatcaccttcacgacgcccttcgtcgcggccttgacgtagttgcgcatcgcctggcggggcgtcggtccgacgatgagaccggcccgcatgcggtcgacgatggtgtcgaacacgaggtagggattgaccgccgccgcgccgaaaccgatgagggcggcgaagtggtgcacctcgcgcgcgtcaccgcactcgacgacgagccccgcacgggtccgcaagcggtgccgcacgaggtggtggtggaccgccgaggtcgcgagcagggacgggatcggcgcgagctccgcactcgcgtgccgatcggagagcacgatgaccgcggctccgcgctcgatggcctgcaccgcttcgtcccggatccggccgatcgccgcctcgagcccactcggcccctccgccaccgggtagagcatgtcgatggcgtgcgcccgaaggtcggcgtgctcaccgtcctcgtcgatgtagagcagcttggcgagttcgtcgttgtcgaggaccgggtgcgggagaaagatctgtcgcgccgccgtcggctcgggcacgagcaggttctgctcggggccgatggtgcctgcggcgctcgtgacgagctcctcacggatcgcgtcgaggggagggttcgtcacctgtgcgaactgctcgacgaagaagtcccacagtggccgatgggcctccgagcgcaccgccggcgggatgtcggcccccatggatccgatgggctcctccccgcgctcagccatgggggtgacgatgcgacgcacctcttcctcggtgtagccgaagagctgctggcgcgtcacgatcgatccgtgctgtgggatgagcatggtacgtggcgcgaggtcgtccaacgtgacgaggttcgcggcgagccaggctccccacggggccgcgccggccagttcgcgcttcacggcaaggtcgtcgagcacctcgccgcgctcggtgtcgacgaggaacacgcgaccgggctcgagtcgacccttcgcgacgatatggtcgggcgccacgtcgacgatccccgcctcggagccgagcaccaccaggccgtcgtcggtgcgccaccacctggccgggcgcaaaccgttgcggtcgagcaccgcgccgacctcacgaccgttcgtgaaaaccacggcagcagggccgtcccacggctccatgagcgaggaatggaagcggtagaagtcgcgcacgcgcggctccatctcctcgttgtgctcccacgcctcggggatcatcatcaagatggcgtgcgcgaggctcctcccgccccgcacgaggagttcgaagaccgcgtcgaaggaggccgaatcactctcgtccgtgcgcgtgatcggcagcgcctcggcgagccgaggaccgagttccgggtgagcgagcagcgactcgcgagctcgcatccaggcgcggttgccacggatcgtattgatctcaccgttgtgggccaccatccggaagggatgcgcgagacgccacgacggcatggtgttcgtcgagaatcgcgagtgcacgagcgcgagcgcgctggtgagctcctcggcctcgaggtcgcggtagtaggcggccacctgcggcgccgagagcatccccttccagaccatggtccggcccgacagcgatgggaagtacagccacggatgggcatgctcgagccgtcggcgagccaaccacgcatcgatctcgagcgcctcgtcgcgccgtccctgcgtcgacgcgaggaacacctggaccatggtgggctcgctgcgccgcgcggtcgctcccagcacgctcgagtcacgcggcaccgcacgctcggcgatgaggcggagctccggaccgagcccgctcgcgagcgcgtcacgcagctcctcgacgctgcgctcggcgaacgcgatgcccgtcacgtaggcaccctcgtcgggtaggtcgatcccgagggatcgccagtaggcatccgggttctgggtcaagatgccggcgccgtcgccggtgtcgggctcggcgcccttcgccccgcggtgctcgaggttgacgagcgcgccgagggcttgctcgacgagcgcatgcgatcggacgccgtcgagccgagcgagggctgcgataccgcaggcgtcgtgctcggcatcgggtcgatacagcggcggtagcgagcggcctagccggtcgtccatggcgtgggctcctcgtacgtaacgagtcgatgacgatgggacgacgttggcccgtgggcccacgatgctagtggctagccggcgagccacacccccatcacgagagccgcaattgccgagagcgaactcagcgcaccccagagcgcgaggccagctcgcgagctggctcgctggtggagccaggccgcgatgcccgagaacaccgcgacggcgatcttggccaccagcacggcggcgtacgcgccccttggtgcacccaccgcgacgacgttccagaccccggtcgcgagcaacaccacatacgctggccaggcaaggcgaccgaatgccctcgccaccgcgggaatcgcgcccggcgactccttgcgcacggtcgggacgagaccccccagcacgagctgtccaccgacccagatgctcgccgagaggacgtgcagcgagagccgaaccacggtcgaagcactcgcaagcgtgggcgtggcgtgcatacagtctccttcgggcacgtgctgacccaacgttaaccgaggcgccgaggctgcggcatcgtcccctggctgagtccgcgctgtggcactctgccgaggtgacgatcccactcctacactgaactcgtgccccctggtcgcaccaggccacgactggctcaggttcgagcggtggccatccgatgatcgcgagcgtgctcgggttcaacctcgtcgacctcgtgatcttggtcgtggtggggttctcggccgtgcgtgggctccgggtgggtgcaaccatccagctctcctcgtacatcggtttctggctcgggctgctcgcaggcgctgcgatcgcaccgtacctggccgatctcgccccacagggagtcctgcggacgttcatcgccctcgtggcgctcttcggcgtcgcatccatcacctcggcggccgctcgcgccctcggaacgcgcatcgtcggacacgtgcgtcgagcccatctcgccagggtggacgctggagccggatcgatcgtctcggtgatcgcgaccttgctcatcatctgggtcgtggccgcactcgccttgaacgcgccgatcccggcgctcgcctccgaagtctcgagctccgagatcgtgcgcgccctcgacgccacgctccctcctgcgcccagcgtcttcgctcgggtggacgccctcttctccaccgagggcttcccgaccgtcttcgcgtcgatcccgccagcgctcgcgggcccggtcagcctcccgagccaggccgaggtcaaccacgtcgaagcagaggtcgctccgtcgatggtcaaggtggagggactcgcctgcggtgagatccaagagggcagcgccttctcggtgggtccgggctacttcgtcaccaacgcccacgtcgtcgccggcgagcagagcacgttcctcgtgctgccctctggatcacagatcgcggccaccgtcatcctctacgatcctcacctcgacatcgccgtcttgaagacgaccggctacgacgtgcccgccctccacttcgacacgcaggtccaagcgcgcggtacccagggcgtcgtgctcggctaccccgagggcggaccgctgacctacggatccgccggggtgatggcgagcttcaacgcagtcgggcgggacatctacaaccagggactcacgagccgcctcgtgtacgaactcgatgcgatcgtacggccaggcaactccggaggaccactggtgggcctgaacggacaggtcctcggcgtggtcttctcccgatcgaccacgaacccctacgtcggcttcgcactggctgctccggccgtcgcggcagaggtgcacagcgccctctcgggcccgcagaacccggtgtccaccgagggctgcgtcccctagcgcagacggagcccacgacgggggatgtccagcgccgtggtgagcgacgacgaagcccgcgccatcgtcgagccgcggggctcgatacactcgggctatggcaaccccacttgcgccaggcctgctcgagatcgatacccgcctcgggggctggacgcacatcaccgctgggttcgtcgtcgaaggcgcgagccccgtcctcatcgagaccggttcgcagtcgagcgcgcccacgctcatcgccgagctcgccgaactcggcatcagtccaagcgagctcgccgcgatcgtcgtgacccacatccacctcgaccacgccggcggtgtcggcgatctcgcacgagccttcccgaacgccacggtctacgtccatcctgcgggcgcacggcacctcgccgacccgactcggctcgtcgcctcggcccagcaggtctacgggccgctcctcgacgagctctacggccgactggatccgaccccggccgagcggatcgtggcgctcgacgacggccagcgcatcacggtcacggagggactcgagctcgaggtcctccagacgccgggccacgccaagcaccacgtctcgatcttccacgaacccagcggcaccatgttctgcggggacgccgtcggcgtacgcctcccggaggtcggggtgctctggccagccacgcctccgcccgacttcgacctcgacaaggcgctcgcgagcctggaggccatgcgctcgcgacgaccgtcgcacctcgcctttgcgcactatggccgcttcgagcacgctgacgacctgctcaccgaggcggccgaccagctccgagcctggtgcgacgtgggcgagcgcgcacttcgagaggggcgcgacctcgagcaggccctcgccgacgctttcctgccctcgctcgaggtcgtggcacccgaggctcgcgaccgactcctcaccctgagcggtatccacgccaacgcgacggggatcgagcgctggctccgactccgcgacgagggccgcgccggcgacgaggtgcgtcgatgagcgtgcccgagggcctcgtcgaggaggctcgccagctcgcaccggaggtcatcgccctccgacgcgagctccacgccgagcccgaggtcgggctcgccctccccgacacccaggcacgcctcgtcacacggctgcgcgcgctcgggctcgagccggagctcggggcgagcctcggatcgatcgtggcgcgcatcgacggcgcgcggccggggccggtgcggctgctgcgcgccgacatggacgcgctcccgatgacggaggagaccgacctgcccttcgcttcgcgtcggcccggcgcgatgcacgcctgcggccacgatgcgcacatggcgatggcgctcggtgctgccgagctcatcgtgcgccaccgcgacgatctcgccggcgccgtggtgctcatgttccagcccggcgaggagggccacgacggcgcgcgtcggatgctcgccgaggggttcctcgagcgccacggcgtcgacgctgccttcgccatccatatcttctcgaacctcccctcaggcgtgatcgcgacgcgcgggggcgccctgatggcgagcgccgacgagttcgagatccgtctcgtcggcaagggcggtcacgcctccgcgccacaccaggcacgcgacccgatcccagcggccgcagagctcgtgctcgcgctccagagcgcgctcggccgccggatcgatccggtcgagccggcggtgctcacggtcggtcacctggcggctgggaccaccttcaacgtcatcccggaacacgccctcgtgcgcgggacctggcgtgcggtcaccgacgagacgcgcagcgcgatccgatcgctcatcgagcgcgtcgccagcggtgtcgccacggcccacggcctcgaggtcgagctcagctggcccatgaacggctacccggtgacgcgcaacgacccgcgcgaagcagcgcacgtcctcgagctcacccgctcggtcctcggcgccgatcacgcgctcgagctcgagaacccgatcctcggtgccgaggacttctcctacgtgctccagcgcgtgcccggcgccatggcgttcctgggagcagccccacccggggtcgccgagccccatgcgaaccactccaaccgcatggtgctcgacgaggacgccttcgcgatcggcgtagcgatcgaggcagcctgggcgctcgacgaccgatgatcgctgtcctcgccttctgcgtggggctcctcctcggcgcactcaccacggcactcgtgctgcttcgtcgcctcggtgaccaacgagccgcagccgcggatgcgacccgaaccctcgagacccagctcgtcgaagcgaggacgaagctcgcgcagctcgagccgcaacgccttgccgagcagacgaacctcggtccgctcctcgaccaggcccagcgaagcgtcgaggagacggtcaagcgcgtcgtcgccgagcacctcgaccacggctccgagcaagcgatccagaaggccacggcgctcctcgacaaggagttccagccgcggctcgcgtcgctcgaggacggccgcaagctgctcctcgagagcgccgatacgctccgcaagctcgtcgacgagcagcttcgctccgctcgcgagcagatcaccacgacgctgcgtgccagcgggagcgaagccgcgacccagctcagcacgaccctcacggagcggatggaccagctcaagcagctcgcagcctcgatcagcgagcagctcgccaacgaccagcgcctcaccgggaccgtcgaggagagcctgcgcagcttcgtcgccgagaaccaggagctgcgcacgcgggtccacgagctcacccaagccctccagcgaagccccaagcagcgcggcaactggggtgagctcgtgctcgagaacctcctggtcggcgccggcctcacccagcatcgcgacttcgacctccaggtcgcctttcgtgacgacgacgggcgcacggtgatcgccgacgccatcatcaacctgcccggcgaacgccatctcgtcatcgacgccaaggtccagctcgtcgactacctccgcgcggtcgaggacccggcgaacgacaccgccgcacgcgcacacgccgaggcgctgcgccgtcagatcaacgagctcgccgaccatcgctacgaccgcctcgtcgacggcgccctggacgggaccttcctcttcgtgccgatcgagtcggcgctcgcactcgcactcgagaccgacccggcgctcatggagctggccatcggcaaggggatcttcctcgcgaccccgaccaccctcatcccagtcctgaagctggtcggattcctctggcgcggcgccgagcgcgacagccgtgccgaggaggccgagcgcctcgcgagacgcctcgccgacaagatcgcgagcttcgccgagagcttcctccagatcgacaaggggctccaggtcgcacggaacgcctacgaacgggccgagggtcaactgcggagcggccgaggcaacgcgatggcgctcgctcgtcgcctcggcgaagtctccggtcgtagcggcaaggcgctcccggcccccctcgaaccgttcgacgacgctggcgacgacgccagtgacgacgatctcgcgagctctctcgaagagggaggctcgtgagccgcgatcccatcctcgccccgacggacctcagcgccgagctgcagatcctcgacgtgcgctggcgtctcgggaccccggtgagcgagcatcgagcgcgctacgacgcgggacacgtgccaggcgcgatcttcgtcgacctcgaggccgtcggcaccggagcgcatcgccccggagccggccgacacccgctgcccgaacctggccaggtggctcgcgatctcgccgccctcggcgtcgacctcggcgcgccctgcgtggtcgtcgacgacgcccgcggcgcttcggcagcccgtctgtggtggctcctcgacgccctcggagtggaggcctacctcctcgatggcgggctggaggcgctcgagggtccgaggtgccaggatccctgcgatcgccgtgccgccgccaccccacgcgcggtccctgcgacgtggcccggcgagctggtcctcgacgtcgacacactcgcagatcagctcaacgatccgtcgctgtgcgtgctggatgcacgagcgcgcgagcgctacctcggccagagcgagcccatcgacccccgagccggccacatccctggagctcgctcgctcccgatcgacgaggtgctcgcgaccggtcgcttcccagatcccgcgacggcacgccggatcctcggccccgtgggcgatcgcgagatcgtcgcctcctgtggatcgggcatcacggcgtgcgtcctcatcgcactcgcgcgacgcgcgggacgtgacgcccggctgctcgagggttcgtggtcagggtggtgcgaggatcccgcacgcccggtctgccgctcggtctgcggcgatgagctcacgcggggctcgacgcgcacgaactcctgacggactccgccacgatccgtctcgctcgaacgctcctccgtgctcacagtaccggcaatgtccggtcccatcagcgccgcaatgacgtgaaagcatcactcacatgtacggacaagtcacgcagaggtacggacaactctcccacgccaaagccactccctgaggctcacgagtgcgcaaggaactcttccacagcacgccattccctgacgactccttcagcacacgcggccctctcgatcgccttgtcgcgagtttgtaacaatcatcattgcagaacgaccgatgcagctcataccatgtcgcgcatcctttgggctttggaagggggagtgagtgatagcagcgttacttccgtacgcgagttggctgcatcccggcgataattcttggcagttgactgcggccactcttgttgggctgatgtccattcctgggctcgcagtactctatgcgggtcttgcgccgaagaagtgggctgtcaatatcatgaccatggcgttcgtcggtttctctgcagtactcgttgtgtgggtgctctggggattcgacatggccttcgggtctcccattcaccttggcagcggtctctggggttccttcctcggacatcccggcctctcgacgagtgcacacgccgagcagagtcaggcatcgataccactcgtcgacggactcatgccgagctttcggttcccacaatcggccttggtctatttccagttcgtcttcgcagcgatcacaccgctcctctttctcggttcggtctggggccgcatgaacctgaaagcctggctgatcttcgtgccgctgtggtcgaccgtggtctacagcctcgacgccttcctgctctggggcggtgggttctgggctcagaagggagcggtcgacttctctggcggatacgtcatccacctctctgctggcatctcgggctttgtcgccgcggcggtcatcggacctcggctgcaccgtgaccgcgagcatgagcggccccacaaccttgtctatatggccatcggtgccggcatcttgtggcttggttggaatggcttcaacggcggtgatccttactttgctggggctgatgccgcgactgcagttttgaacacgaacatcgccacggcagcggcactattgacgtggctcttcatggatatgtcgtccaagcgcctcaatcgcaagccaacattcggcggagcgatcaatgggatgatcgtcggacttgtggcgattacccctgccgcaggatacgtgaacgggctcggggcgctcgcgcttggcatcatcgcctcattcatcgtgtggtggtcgttcaacgtttggtcgcaaaagggtttgttcaggaaggtagacgatgcattcggcgtcattcacacacatggggtggccgggctcgccggcggtctgctgaccggcatcctcgcagatccacacgtcatcgagtacgtcggcaccggtaagacatcgtcgtcttccgtgaccggcttgctctacggacacccgggccagttgctcttgcagctcggtgctggcctcacggtgatagccatatctgccgtcgggacgttcgtcatcttgaagctcgtgggtctggtggtgccactgcgctacccggatgaggtgctcgctgtcggagacctcgctatccacggcgaggtcgtcaaccctgaggatgctggtgtcgaggtgctcgatgagccaacactcatcgatccagcactccgcgaccatgatccccacggcgagagcgaggagctgcgggacctcgagttggagtagaccagcggactgtcatggcgacagggccggtgagacagtgtggtctcaccggcccatctcctgttcgacgttcaatcgacggcggcttgtccctgcctcctgggcgtcctcacagagtgtcctcggtgagccgatgacggttctcgtcgatgcgtgggcctccgaagccaccgacatcggccgaagtccttgccgcacgagctccgcatgtcccgaggatgcactggtctcggatcgaaccattgtgtggtttgccgtccgtaccgcgcttccaagcttggtcgacaccacatccccgacccgcatgcggtggttggtgccctcgccaccttcggcgttgcccccagcgcgaccgtgcgggcaacaatccccgaccggctcggcagcttgccggtggcgacccctcgacgcacgagcgctacctcggccagagcgagcccatcgacccccgagccggccacatccctggagctcgctcgctcccgatcgacgaggtggccgcgaccggtcgcttcccagatcccgcgacggcacgcaggatcctcggccccgtgggcgatcgcgagatcgtcgcctcctgtggatcgggcatcacggcgtgcgtcctcatcgcactcgcacgacgcgcgggacgtgacgcccggctgctcgagggttcgtggtcagggtggtgcgaggatcccgcacgcccggtctgccgctcggtctgcggcgatgagctcacatcgagccagaggcgcacgacactgagacagcgcggctcgagacaccggaccggtcgctcacggcaccgatcgacgcctggcccgaaggtggcatcgcaatcggcgcatcgagatcgccggccgccacctgcgggggcaaccccgtgagcagtgcctgcacgctgacgtccagccgtaccggcggagcgagtcgtgacgaaggcaggcgagcgccggccgtggcgagcccagcgccatagaccatggtgaggagagcggctgcgaggccgacacccagcgtgcgtcggtgcgcgatcacgacagcacctctcacgccaccacaactcggtccgtgtcgccgctgtcgccgagggcctgctccacgttcgtgggtctagcaccgtggcacgagcaccgcacgagccgtcgctcacgaggtcctcagacgacgaacgacccggtcgtcgcatccccgccttcgccaaccgcacgctcgcagcgccagcgggaggttccggggatcggccggctcgagttcaccgatacgacggccacgagccgacgaccacctggcagggtgtgcgcgaccgggcggctggccgagaacgggggctctgaggcgtggcatcgcgctctgcgaacctctgatgacctcggtatcgtaccgggacgaatccctcgtcgctgggcccaacgggccgagtcacacggtcgacggtccgccctgcaggtgaggtcctgccggactcgtccgcgatcacctcgtacactgcgagggggatggagcgactcacccggctcatgcgccgcctcgaccacctccaacagcgccacaagctcctcgcgatcgcgtttgcgatcgtgcgcaagttcggcgaggacaacgcctccacctgggcgcttctcgtggcctactacggctttgcctcgctggtccccctcctgctcgtggcggtgacggttgcgagcatcgtcttcgcccaccatccgaacctcgtccacgacgtcgcccacagtgccatcgcgtcgattccggtgctcggcgcgcagttcgcaagccgagttcgcgtgcatgcgctcgcgtcgcactcgatcatcggcctcgtcgtcgggatcgccggcctcatctggggagcccagggcgttgcgtccgccgcccagaacgccatggccaacgtgtggaacgttccgctcgtcgatcggcctggctttcttccgaggacgctgcgcaacctcggcatcctcgccgtgctcggcctcggggcgctcgcaacctcggtgatcgccgccctcgcaaccggtctcggccacaccgctgtcatcaccgtcgtcatcgtcgtggccacggtcgctgccaatgctgggctctacgtgctcgggttccgcctgctcacaccggcggcgatcgcgactggcgacctcgtcacgggcgccatcgtggcgagcgtcgtctggagcatcctccaacagatcggcggggtcctcgtcacccacgacctcgcacacgcatcggcgacctacggcgtcttcggcatcgtcctcgggctcatcgcatggttctcgatcgcgaccgaggcgacgctctacgcggccgaactgaacgtggtcctcgtgcgtcgcctctggccgcgctcactggctcctcccccgctcacgacggccgaccagagcgcccttgccgccctcgtccaccagcagcgtgcgcgtcgcgaggagcgcgtcgaggttcacttcgtcgcgggcaacgacgccgtcatcgactcgcaacacgcgccgagcgctgcgcccagcacggccgacgagactggtaccaccgcgacggataccccctgacgcgatgcggggcgccaccacggcgccccgctctccctcatcgagccttgcccgacccatcggcccgagtgctcggatcgatcgacagaagcccggaggcgagggccgcgccattccggcgggtgagggcgagctaccatgaccacgtggcgggtggggcccatcgacgatgaggactcgtcgaccgagcgcaacacgcgtccttagcacgggggcaaggacacgactcctcgccgtggcgaccgcatgcgtgagccttgctcgctgtgcgtcgacggccgatgcccaccacgcgagcgacgccggtcctccgaccgttgcggtgagctcggtcgcgagtccgacccgctcgcgttcgcagcgctcgccagcgcccacagcacctgtccgcctcaccgcctccgataccacgtggctccaagagcccggctcgggcatcggtccctggatgcaagccatcgacggtgctcgccacgtcatcgagttgaacgagtacctgctgacgagccccgaggtgctgggcgcactccgcgacgccgctgctcgaggcgtggccgtctacgtgatcatcgacggtcatccctacgacgacgcagcagcaccgaggatcgccaccaccgccctcgctggcagcggtgtgctcgtgcgcgaggcgcctcgacgcttcgagggcgcctacgcgttcgaccacgccaagtacctcgtcgtcgacccaggcagcgcgcgcgagcgcgcgatcctcggctctcagaacgccaccaccgcagctttcggcaacgaccaggccgaggatgcgatcgagacctcgagcccgagcatcgtcacggccctcgcagcgatctttcgcgccgactggcgtggcgtacccgtcgggcccggtccgcgggcggtgctcgtggtctcgccaggatcgcagccggcgatcgcgtcgttgctctccacaccgggcccatcgccgtcaccgcagaagagctcggcgacgctcctgtgctctctggcgccctcgaacgtgacggccccgaggcacgtctcctcgtcgcgggtcccctcggcgcggcggccgcacggcgagcggccgcgctcgcggcttccggcgtccaagtgcgcacgctcacgcatccctacgtccacgccaagctcatcgtgaccgccgacgcgaccttcgtcggatcgcagaacttctccgtcgtgtcgatgaacgacaaccgcgaggtcggcgtcatcaccgccaacccgacggtgcatgcgctggcgctcgcgtggttcgacgacctctggagccacgcgagcgtggtcgcccccacgtcgactccggcagcccgatctgctccgtcccagtcggctccacccccgcctgctgcgaccacacccgcgccgtcgacaccggccgcaacgagccaagctcccgcacctacgagcgatggcggcgacgctccctggatcccctacggcgcgaccgagtcgcaggtcgaggcgctgtggggcgccccgggctccatcacgaccacggtcgacgacggtgagccagaggtggtgtggaactacgcggccggttcggtcgacttcgagaacggcacggtggttgacgtcgaccgagcgcccgacgacgactgaggcgacgacgtcgtccgcgcccacgatcggacggcggccatcgactgctcgggacaggtggtcggcacctgtcgacgtcgaaagacgagcgggctgtccgcgaccgtcaccgcgagcatccggccccgttccagcgccgctgtcagcgcgagcggctccgaccccgcctcgacacgctgagtcgatcgtatggctcccaccgtcacggcaagcatcccggtccccgtcacacgcccgggtcgcacgctcggcgagcccggacccgacgacggtgcgcgaggtagcgccgtcatcgctggcgaactccgacaccgcgagcacacgcgcgccccgctacgacccttcgacgagccccaccaccgcatcctcgaggacactgcggatcacgtctgggtcctggtgctcacgcagcgccatccaatgactgccgtgggtgccgtcgtcgcacacggactcgatgcggatggccgccgagcgcccccgcctcgaatgctccagccaggcctcgacagtacccatcgtcgtctcgatcgccacgtggccggcctccttcagctcgacggccgcgcgcccgacgaggtcgacgacccacggctcgacccggacgaccggatcggtcggaacagcagggagcgcctcgagatggacctccgcgagcagggcatcgatgagtgcagcgctccctgcgacgtaggtccaaggcagatcgatctccgatgcgacgaaccacgcccgatcgcggggccacgccaggttggcggtctggtatcggccgaggccacgggtggcactgatcgcctcgacaggacccacgtagcagaggtaatcgcgctcgggaaggtgcaggcgaggtccctcgcgcacggctgccgggatcggatcgggcagcggttctggcaccgcgccgggtgctgcaagcagcatgccgccaaagccgtagccgtcccagaggccgaagcagcagtcctccggcgtcgacgtgtgctcgcgcaggagtctggcgagcgcgtccgcgtcgggacgagcgagcctgcctcgcgctggcccctggctgcgccacggtgccggcgcctcaggacgtacccgtgggaacgcgatggagtggaactgggcgtcgggacggagcgtcgtaccggcccaccgagcgacgtccgaccagcgaaccaaccggccatccgcctctggctcctcgacgggatgaaggatccgggcataggccccaaagccagccgggaccaccgaggtgatcgaaccaccgccgaacggcccgagccgacccgcgatccagtcccagtctccgttcggactgacccatctcgctggtgctgtgagctgcctcgccatgagcacatggtagctcgccccgagctgcggcgacggctcatgggcgccccccgtcgccgcgacggtgcccgcggtacagactgaagctcgccttcgcaccttcccacacgtgtgagggcacccggtctcgtgccgggtgccctcgaggtccgcgctacgactgctcgacgggggtggcagcgccgtccgtctggtcgagctcacggctcgccgtggcggccgcgatagagatgtgcggccgggcgatagcaaagtacaccgccccgatcaccacgatgacgaagacgacgagcagcgtgagccagtcgaagttgaacagtgcgccgcgaggtgagttgagcccggtgggggcgacgatgttcacgatcatcgccacgccgtagatcagccccagcaccgccaccgggacggcccagcggccgagctggaacggaccttctggacgccaccctcgcaaccgtgcgatgaggtaagcgagcaccaccatctggaacgagatgtagatgccggacacaccgaagctcacgagcgcagagagggcgttcacgtgtgctggataggtgatgaagccgatgtggatcggcttcgacggggtgaagtgcacgaggaacgacagcagttccgggatgatggccgcgatcaagatggcgcccaccggggtgcgacggcgtggcgagatgcggcggatgaagtgccaccccgggacggcgtggtctcgggcgtaggagaacgcgagacgagctcctgcgccttgcaccgccgtgccgcacgagaagaacgcgaaggtgatcacgagcaagatgagatcctggaagagcttggacgagatcgccgcactcaagatcgcagggacgccccccgtcgccgcgagcgcgaggcccttcggccctgacgggatcgccaggtcgagtgctgcgacgaggatcatcgacacgagccctccgacgacgagcgcgctcaccatcgcgcgcggcacgcgacgctgcgcgtcgacgacctcttcggcgacgtcgcccgcactctcgaacccatagaagatgtagaccggaccgaggatcgcgatcaacgccgcaccggtccaccagtgcccgatgaagttgaccccgagcggattcgttgcgacgtgcgtcgtcccagcgctcgagaacagatacgagaacgagtggtgcgtcgccacggagaacaagatcaccgcgacgcccagggtaccgagcacttcgaaccacgtgccgatccgcgagatcgaaccgaggaagcgaacgccgaagatgttgaaggcggtctggacgacgaggaacccggtcgagatgagcaggatgtcattcggagccgcgccatcccagtgggtgccgaacacgttgttgacgagcgaggcgaagtacccaggcacgccggtgtccacgctcgctaccgtgatgatgagcgcccagccgtacatccatccgacccaccagccgtagccgttgccgagcaggcgcttcgaccactggaacagtgccccggcaatgggataactcgagccgagctcgccgaagacgagcgcgacgaacagctggccgatcaccacgacggggatgagccacaggtaggcaggccctgccgaccccacgctgagcgcgtacaacgagtagaccccgacgaccggtgagaggtagcagaacgcgaccgagaagttctcgaacagcgtcatcacgcggtcgagctcttggcgataaccaagctctgcgagcctcgcggcgtcaggatcgtggtggtgatggtgggaggcgagttcgtcctcccatggtccttcaggcatgctccccccttggcttcgtagtcatcatccgacggatgcgccgccatctgcgcggcgcggattcaagcgacggcgacctctccgtcgcaactcggtgcgtgggcacgatcgcgcacccggctcctcgacatcgtcctggcaatccccctccttcgctccacgctcaccccctgtctgagcgttggcccgatcctactcctccgttgcacctggtgacacggacgtttcgccgagctccgatccgttgacgaccgttcgggcgaagtggcgatgcatccaggccaggtactcgccccgggccgtcacgatacgggtgaggtcccagcgcgggatggcttgttgggggaccgacggggccatgagtcgcggatcgacctcgaacacgtgctcgaagcgttggacgaccacatcggtgatccgccgtggcgtggggaggtcgaactcgtcgcgagagcgaaagctcacagctggcccccttggaacacgttccccttgcggaaatggtacttgccgggattcaagatgccgtgcggatcgagtgcctcctcgatcgcgtccatgatggccaggcttccctcgagctcctcgggaacgacgtcgacatcgccggcgcggcaggcgccgtggcaggcagagatcgaccccccggcgccgacggcaacccgagcgatggctcgcttggcctcgacccacgcgtcccacatcccgtcgtcgagcacctgctcccagataccgacgtcgatctcgacgaggtagtcgacgccggtatcggcgctggtgtaggcgaacgtaccccagtcgtcgaaggcgtcgtagcgacgtcgcagctcctccacgatcgcatgccattgcctggtgacggagacaatctccgggtgattgagggcagcgtcctcgcaatgccaccccatcggcacgacggtgccgtcgagtcggcgcccatggagcggtgttgcgtagcgatcgtggcgtgaggcccagtcgccttgggagatctcgtcgccgaggtagcgtccgccgaggtcggcggcgatgcgccagagccgtcgcccacccgcgcgcacctcgtcctcccagccatacaaggccgtacagaccaccgagcgcaccgaggcgggctgggggatgtaggcctcgtcgtcgcggcgcaggtaggcgaccttggcctcgtcgaagaggacggcgcccgcgaacgttgcgaccccggcgccagcgagggcgtcgacgcactggtgggcatcctcgtagcgtgcaaagccccagaagagggagagctcggcctctggcttcgggtagagcttcagcgtgacctcggtggcgatcccgagcgtgccctgatggcccatgaacagctgcttgagcgagagacccgtggaactcttcgagatcttcggtccgccaccgtcaccgatgcgcaccacgcgcccgtctgccaggacacacaggaaactgaggaccagatcgcgggtgtggccgaagcgggcgccgatcagcgaccagccgctcgtgccgatcctgccgcccaccaggctggtcgggtacgacgccggatcgtcgggatagaacaagccgaacggggcgagcgcctcgttgagcttgagcatgttgacccccaccccgaccgtggcggtgcgacgcaggggatcgatctcgtagatctggccgaagcccttcatgtcgagcaggatgccgccgtgttcggggaccgcaccatcggtgagtccggtgccgccagcgcgcgcgacgaccggcacgcgccgctcgttcgcgagcgcgaggatcgcagatacctcctcggtggtgtgcggcagcacgacgacctgcggaaggtgctcccgccaccgatggaccggaaacggcgccgggacgcgcgtgcgcgcgaggcgcgcccccgcatcggtacgaacgcggtcgggacccacgatcgcgctgagctcggcgacgagcccctcgtcgagacccacggcgaggctcatcggacccaccccggcacctcgatgggcgcaccacacgagatcgcgaccagctcgagcaggtcgatgaccgccatgccccgctcggcgcccgcgttcgagagcggccgctccgcccaggggcaggcggtcacgacggcgttgacctcgaggtccgccgcgcgcgccacccgccgacgcgagagctcggccgtcacctcggggcgtgcgatcgcgagccccccgccgcctcccgagcagtagctccactgggtcacccgatcctcgtcgacgaactcgagacccgggatcgacgcgagcagcgcacggggctcaacccagatccccttgcgcttgttcagtcgacagggatcgtggtaggtcacgcgggtgttgatggggagcgtcggagtgaggcgcccctcgcgcacccaacccgcgacgagatccaacgcgaggaccacctcgacgtcgtagtcgtcgccgaagtaacgggggtagtcctccgtgaaggagatgtagtcgtgtggatcgagcaccacgatgcgtcgcgcacccgctcgccgccaatcggccacgttgtgctcggcgaaccgccgcgcctgatccgcatagcccatctcagctgcgggtccgccgcagcaccagggctctggctggagcccgatcggctccccggcggccttgaagagccacgcgacggcctgtgggaggctcgtgcggtagaaggcggcctcgcagtcgacgaagagcaccgtgtcacctccgaacggaaggtcgaacgaactcgcccacgccctggagagctccacgccgacctcggcaaccacgggctcgtggcgatcgcgatcggttgccgcgttccacgccgaccacgcaggttcctcgacacctcgatcgacggcgagcgtgcgcgctgcacgaacgacgtcgaccgtgcgcgtgcggaagcggtagaagtcgccgacgaacagcgtgttcggacaccggagctcgcaggcaccgcacatggtgcagttgacgtagtcgcgagcgacgtcctcgaactcgaccaggccctgctccatcgcgacgatgttcgcgtggaacgccgtgggaaggtacgtctcgtcgcgcgtgacctggtagacggggcacacctcccgacagaacttgtgcccggacgagtagcagttgtaggccgcattgcgccacgactcgacgaaggcttcgtccgtggctggcctcgcggcgtcgtcgctgcgatgctggatgtccatcggttccctccctaaaacacctgaaatcagatgttagatcctttccagtgtgctgtcaagcactctcgaggtgcactcacacgacgatttggtagggtcatctcgatgcctcgagccgccgagcacgtgctcacgcacgtgccgttctcatcgctgcacgagaccgacaaggtcgaccaggtggtccagcggctcgaccacgccatcgcggccggactccttccgacgggctcacgcctgccacccgaagcgctccttgcccgcatgctcggcatctcgctcaccacgctgcgggctgcgctcggcatcctccggctccgcggcacgatcacgacgcgccgaggccgccaaggcggatcggtcgtcaccgccgacccagaggccgtgcgcgccgccgcgatcgcacggcttcgcacactcggtccctccgaggttcgcgacgagggcgacctccatgcagcgatcctcacgaggagcgcaaccctcgcggccgagcgcgccaccgacggcgaacgcttggcgctctcgctggctgcgaccatgctcgacgaactctctctgatgcatgagctccaactccatctcgaactggttgcactggcacagtcgacgaagctcctcgaggtcgaactcgactgtctcctctggttcggaggcttccttcagctccgctccgacaccgagaggagcgccatgctggcgtcactcggcagcctcgtggcggcggtcgccgagggaaccagcgaggaagccggtcgacgcgcgcagcgacacgcagagcgcatgacgcgatgggtgcatgccaccctcatcgccacgacgcatgaggacggccagcgatgagcccaccagacgtgctcgacgagctcatcggcacgctcgcgactgcgatgagcgacgttcgagcgctgctcgacgatctcgctcacgaggcagcgacccacgacgccgtcgaagtgctcgtgcgccgcgagctatcgcgaccgggctccatcgtgctcggggcaggcgtcattcgagcgggcggacgcgccgacagcctctggtggtggtggcgacgtggaaccgtcacgagcgagctactcgtcgccctcgagccgacgtcgctcacgttctacgacgtcgagcaccagccatggttcctcgagcccctccaatcaggcacactgaacctggtcgggccctacctcgatcgctcggggacgaacctgatggtcgtgaccgtctcgaggccagcccccggcgcgccggccggcatcgtcggcgccgacctcagcctcgacgccatcttccgactcctcgtggcgacaccggcaggacgccagctcccctgggttctcgagaatctcgagggccgggtgatcgcctcggccgaccccgcgatcaccgtcggtgagcgcgacgtcggaccgtggcgaatccaacgcgcctgtccgatgctgccgtggcgcgtcgtcgtgcgagcgtccgcggcagcatcggattccttcgcgtcgggctaggcgctgacgctgaccgtcgtcggcagcgtcgcagacttcgccgatgactggatggtgaagcccacctggatgctcgcgcccggctcgatggtgccgttccagctcgccggcgtcacggtgacggtgccggtcgaaccggagaccgtgccgttccagaggctcccgatgctctcacccgagggcaccgtgaacccgagggtccatcccgacaccggcgccgtgccggtgttcttgatggtcacgtccacctgaccaccaccccaccaggtcgaggtcaccgtcgcggtggcggtgagctggccggacgaggtcggcgtcggtgtcggcgtcgtcggcgcagggtcactcgcggtcgacgacccactgagttcatagctcgaggggaacacgccgttctcgggcccaccgttgagcgtgaagcccacctggatgctcgcgcccggctcgatggtgccgttccagctcgccggcgtcacggtgacggtgccggtcgaaccggagaccgtgccgttccagaggctcccgatgctctcacccgagggcaccgtgaacccgagggtccatcccgagaccggagccgtgccggtgttcttgatggtcacgtccacctgaccaccaccccaccacgtggaggtcaccgtcgcggtgcccgccaaggagcccgaggagaacgagatcgggccaggcgtcgtcgggctggtgggagcgggcgtcgggttagacggcggtggcgtgggatccgacggcggtggcgtgggatccgacggagcgggcagtgacccaccggcggcctgctcgaagatctgcgagaactgccacggggtctcggtcgtgccggagcagtagttcgagtcctcgtcggcgttgttcgcgcactcgacgtcgcggtggatctcccacatcgagagcctgccgaggccaacctgctcggcgaaggccccgagctgctgggcgtcttgggtggtgaagatctcacccgagaggtcgttctgccctatcatcggggtcacgccgaccatctgccagagctgggcggtggacaggttcgaccagatcgaggcgagctgttgctcggtggcctgggcggcctcgatcgccatcgtgcccatcgcaccttgggcctgggggatgccgtagtccatcgccatgacgttgacgttggacacgtcgacaccgtaggtcttcgccgagttcagcagatacagcgagttcgcgagcagaccccacggcataaccggcagcgtgtaggagacgctcactgggtggccttgcgctgcttcttgttgctggaccagggcgagggcctggttgcgcaggttcacagcggcctggtcgttcaggtccgaaccctcgatatcgaagtcgaggttgtagacgtggtaggtgttgatgacggtctcgtaggcttgggcgagcgcctggggcgaggagcacacctgggcgagctcctggttgatctcaccgccgaaggagacgatgggcgtgccaccctcggcttggtaggcagcgatctcgttgcggaagaggccgttgttctggcccaccgggaagtagttgccccagctcggatagcaggtgcccttcgagctcacaatgaacgccagcgtgagcgccttggcgccggactcggagccgagctgggcgagggtgccggtcggcggcagggtcatgtccacgtagggcgcgaaggccgtcgaggtcgacgaagtcgtcgaggtggacgaggagaccgtgcttgcctgcatcgtcgaggctgccacggtggtcgtcggggcccaaccggtcaggttcgagatcacgatggtctcgggactggtagccgcatcgagctggagaccgaggacgggcgaggttccgacccccggaccgagcgcgagggtcgtggcctgctggcccacggttgcgtcaggcaggaacgaggcgtggtacgaggaggacagtgcgaacggcgtcacctgcgcatccccggtgggtgagctcaccgacacggtgtagccgtcggcaccgctcagcgcacagctcggccccacgagctcgacagccggatagccgctcgttgcggtgacgctgataccggcactcgtctgcgtgatcgtggcgttcccccatcgcacctggggcgtgcaggccgcagcacccgacgtgcccgccatggcgatgggcgtcgcgacgccgctgatcgaaggctcgtcgatcacacccgtgagggttgcaccctgaggcacggtgagcgccacgggggtgctcgtctcgacggccgagcccggttggacgagcggcacgaggttctgccccgtactcagtgcgatcgtctccggggacgcggcccccacgggcgtgagagcgagcgacccggagcccgccgtctcgtcgacgaccgcataggcctgaccgagcgctccgagcgcgggcaccgagaccgtcgagcccgacgccgtcgtcaccgagggcgcggcgggctcgttcgcctgcaccgcaccactggcaaggcccaggctctgctgctggaccacgacccctccgtcgaagggggttccctgctcgttggcgatcagcgacggaaaactgcagctgccgccgttgggtccggcgaaccagccccacgcggtccaaccgatgccgtgctgctcgaggtagtcgacgatcgactgctcggtggaggtcggatacggggtcgcacaccccagcacgccgaactccgtcgcgacgaccggggcgagcgacggcacggttccgagcgatgcgctccattgcgacggggtggtgggcgtgctctcgtgcacgtagagatggaagccataggcgacattcgcaccagcgaggccccactcggcgatcggcgcgaggttgcctgcccagtgattgccgtcgacgatcaccacgttctcggcgccggtcgcgcgcacgatatcgaggagctgctgctcgccaacggccgtgtaggactggccggtatcggcacaggtgatggccccgccgttgcgccacacggaccatgggatgtcgtggggctcgttgtagagctcgaacatgacgttcggatcacccttgaagatcgaggcggcctgctgccagaaggtctcactgggcacgtccggggcgcacgcggggttggccgagggtgtcgcggtcaccgagtcggccccgatcacccggtgaagatcgatgatcgggatcatgccgttgtgctcgacgagcgacacgaccgactcgacggttgcgatgtagccaggggcgtactccggcgaacccttcagccagaaggcttcgttaaccgggatacggacggcgttcgcaccccactgcttggccatcgcgacgaactcattcggattgacccccgactggctcgcgttggcccactggccatccggattccacacgaggctcggccagtccacgccgtggagatacacgggcgctccggctgcgtcgacgatgacgttgccacggacctggaacggaccgctcaccgcgccaggaggtgtcgccgggaacgcggtcgcggctgccgtcagcgctgtctgtgctcccaacacgctcgcgatgccaccggcaacgaggccaagagcaagagccacgcgcgttgccctcgacaacctcgctgcatgacgtgcaaatgaaaccatgccgtggccatcggcatcgcaaacctcgaacctgaaccggccgcgacgatctcgccgaacgggcagttcagcgtgtcaacggtcgttgagcaccgcagcagctgggctcggcctacgcccgacgcgacgcacgatctccggatcgacctggcgggcatcgatgctgatccggtagcggcgaggcgacctccctgccgagaagaggctgatggggatcacaccgtgacgcgcgtgctcgttcaactccgaattcaacctcgacaaacgggggcgcagccacgcggtatcgacgcccgacctcgtggcccgaatggtccgacggtcgatccgaacatcgatggctcgagcaagctcgatgagctccgcaccgagcgcctggtcgcgctggcgctcgcggggagcggcgagccagccatcgccctcgacgacgcgacgaaccagcaagctcaggagcagggtcgacgacggacggaggtcgaggggaacgcctccccagacgaatcgcgacatcgacccgacggtctcgagcgtgaggatcggattgagcgcatcgttgaccgcgcgaacactcagggcaagctcggcgccgacgccgaggagttggcgaaacgcgctcaggcgaacataggggacgtcgatgagcgtgaccacgcgcgcggcagcatcgaggcgcacgccgtcgaggttcacgatcgtgccctgctcgcgactcgggtagtagaacgagggagcccgctcgtaggcgggagggacgatgacgtgcaggagtcgatcgcccgcccgcgcatacagcgagaacgccaaccccacgtgataggccatggtcttacgaccgccagagagcagggcgaggatcccttggctgtcgtccttggccagttcggcgagctgcgcgaacaccgcctcacccgaggcgagggccgcctcgttggagtcgacgtcctcggcgggaatcgcgacggacgacgcctcgatggtcgacagcgacacacgcggtggtttcacgccgggggcccattcctggtagaggcgagccagccgcccggattcgccgaggagccgctgcgccagatcggcaccgacacgcgtggcgagtaggacgatctcgtccggaacgatcggctccggctgtgtcgccagcagcgcccagcaggcctcagtcacgacctgcggtgcaagtcctatcgttgcgaacagcgaccaggaacgttgtccttcgccgttgttcacacaacgaaatgtagcgccaccaccaccccctgatgacccaggaccagcgtttgcaatgttgcaacttggccgacggacatcaccaaatgatgaacattgcaatcttggttaattggtacggggagtcagggcactgcatcgtgcatgctggagggcatcatgcacgttggacgtcgcgagtcgccctgagcgcctcacggaagcagcaacgctcatgcgccgaccgacctcgcccgaacggctaggcccggctcgcaacccagacgtcagcgctccgtggtcacgcaccgcccagtggtctttgtcacgaccgactaggacgtcgtcgcgctctgtgcggtgtctacctcggtcgtcggaacggcgcgcgcgaccacgaggtgacacacctcgcgttcggggcagtcttccggtcgcagggacgcagctcgcccgaggaccatctccagctcgtcacggagcatcacgagaccggcgatctgttgctcgacccgcgcacggtgacgctcgagcagcgtcgccacatgacggcacggaacctcgccatggtcccgcaccgccaggatctcgcggatctcccctagcgaaagacccagcgtctgcgccgcacgaacgaactcgatgcggccgatcgcgagatcgtcgtacacgcggtagcccgacgcatcgcgaggaggctcggccaagaccccgatcgactcccagaatcgcagcgtcttcgagggcacgccggttcgttctgcgagctcgccgatcctcatggctgaagcatagctgaatccgcgggtacaagattccagctagctggaaggcgcagactgatgtccagacacaccgagtgtaggaggaggacatggtcatgagcacccttcacgcatccgctccctgggatctcggcatcatcggctctggctcagccgcctttgccgccgcgctcgaggctcgcgcacgcggcgcctcggtcgtcctgatcgaacgcgatgcgctgggcggcacctgcgtgaacgtgggttgcgtgccctcgaaggcactgctcgtcgcggcacaccgccgaagcctcgccgcatcggcgtacccgggcctcggagccgagacactccccatcgaccacgacgaactcgctgccggggttcgcggcgtggtttcgagcctcgtcaagcggaagtaccgcgatctcgctgagcggatggggatcgacgtacgctacggtactgcgcgcttcgtgtccgacgagacggtgagcgtcggcggtgacgagctcaccgcgcgccgctggatcatcgcaaccggtgcccatgcggtactgccatcggtcgacggtctcgacccagcggagctctggacctccaccgacgctctcacggcgctcgagattcccgctcgcgtcgcgatcatcggcgccggctcgatcggtctcgaactcgcgaccgcctacagcgggctcggagcccgggtccacctgatcgagagcactccccaggctgtcgcgagtgcgccgctcgaactgacaggagccctggtcgagcacctccgcgcatccggtgtcgccgtggcgctcacgaccacggtcggttctgcacaggcgacgacctcagggtggctcctccagctgcaaggaccagaaggtgcgacgcaggtggaggtcgatcgggtgatcgcggccgtgggtcggcgccccaccaccgagaatctggggctggagacggtcggcgtcgaactcggggcccgcggggaagtcgtcgtcgacgccaccatgcgtacgtcgaatcgaggcatctgggcggccggcgacgtgaccggcggaccccagtacgtctacgtcgctgccgcccagggcgcgctcgcagcccgcaacgccctctccgacggtgacgagcacttcgacgaccgcgcgattcccgccgtcgtcttcaccgatccgcccctggcccaggtcggtctgacgctcgacgaggcacaacaccagggctacgacgccgagtcgaccaccttctcgttcgccgatctcccacgtgcaatcgtcgagcacgcgaccgagggcctggccgtcatggtcgcagaacgcacgagtgggcgcctcctcggcgtgcacctctggggcgtgaacgcagccgaagtcatccagagcgccgtgctcgcactccgcaccaatctcacgatcagcgacctcgcgacaacgtgggcaccctacctcacggcctccgaggcgcttcggctcgcagcacagagcttcacaacggacgtcgcgaacctgtcctgctgcgcctaggtcgcctcacgagcgacgatggactgcggaccgcggacgtcgctccgccgatggtcagggcctgagctgccccgacgagcacgcgggacgctcgcgtcgcggaggcgaccgctcggccgcatccacggacgggtgtcgggcccgatcagctgagccttcgcgaaaccgacggaaacctggtcgcctggagccgtaccgcgaggcaggtgcgttcctgcggtgggcgctcaaggccttgagcgatcacgcctccggaggtggggcctgctgggtgctcaaccggatcctgatcggaccacgcgccgtcgcggggtcgaccggccgaccgtgctgcgtgatctcgacgacgttgcgagtcgccagacgtcgagccgctgcacgggccggctccacgagttcgcgccaccggtcgcctccgactgcccgagcggcctcggaagggcagatggagccacctggacgccgcccgacaagcaggtcgcagatcgcaccctcgagcgcgacgtcgatggcacgggattttgctcgccgacacgcatcggagcagtagcggacctcatcccaggtccgctcccaccggcgtcgccaagtcatgactcgaccacacgtcgcgcagaccttggcgggtacggcacctttggttgggctgcgacgtgaacgagccacgacgaccgatccccgagggatcgatccggatcgagaccgcgccacgttgcacagcctacgaacctctcacacgactgtcgcgctcacgacgcacgaccgtcgcaacgccacgatcggcgtaacggcgcgggccgcccgacacgagtccctggatgcagcggtgaggatggcgttcgtgcgacgctcttgcggcgtcgcctggcccactcccacgggtcggtagaccctccgcagcgaaacgaatcgcgctggtcctcggcggttcacaccggttcgcaccacaggtccctccttccctctactggccctcgggaacgagggcagccgcaccactgcagagctgcgatgccagcgacgatgtccatggacgacccgccgacgggttcggccgggaccttgctcgacgttctcgcgctgcgccgtgctcggtcggcgcgcacccccacaccaccacgcgcgctgatgccggattttcaccagctgcgggcccctcgatgccccacgaccatcggcctagtctgcctcatcggcgcaccagaacgcggggtggcggcctctggacaaccagcgcttcttcgagccacggagatcgcaccaccaagcaccgaggccgccatcgttgcggccgcgcatggctcgtagtcggcgtgcggcgcatgtgacgctcgaggcggcggggccgccgccggccaccagactgaggacgtgggaacacggccaaccaccgtctggatcctcggcgaccaactcaaccgatcgatctcgtcactcgagggggcagacccgtcgtcgacggtcgtgctgttcgtcgtcagccgagccaagctggccgcccgcccatggcatcgccagcgtctgcacgccatcctcgcggggatggcgcggttcgcagccgagctgagagccgagggattccgtgtcgacgagcgagaggccgacacgttcaccgagggtctcgcggcccaccgcgcctcctatcgacctgagaccgtgcgcatgatggcgccggagtcgttcgctggcgaggcgctggctcgccggcttggggtcgaactcgttgcatccaacctcttcctgacgacgcgcgaggagttcggcgagtggatcgctcagacccttgagcgtgggcgtcgcccacgcatggaggagttctaccgctggcagcgtcggcgcctcggcatcctcatggacgaagacggacccgccggaggccgctggaacttcgactcggagaaccgactgcctccgccacgagccccggttgcatggcccacggtgatcgtcgatcagctcgatcagctcgatgtgcgtatcgtggcctcactgccggatcaagctgtcggagacccaccccagggttggtggccgaccaatcgggtcggagcactgcgacgcctgcgcgccttcatcgacgagggacttagtcgcttcggaccgtacgaggacgccatgttggctgacgaaccgcgcctcgcgcactccatgctctccgtcgccctgaatctcggcctcctccacccgcacgaggttgtcgaggctgtcgaacgcgcctttcgggacggtcgcgtcggactctcgtccgccgagggcttcctgcgccaggtgatcgggtggcgtgagtacgtgcgtgggttctattggtggcagggccccacgtatcggagtcagaacgcactcggtgctgagcgaccattgccgccagcgctggccaccggacgaaccaggatgcgctgcgtgcgaacgacgctcgaaggggtcgagcgccatggctgggtccaccacatccaacgactcatggtgctggcgaacctcggcaccctcaccggcgtccagccggccgcgatgctcgactggatgtgggagcgcttcgtcgacggagcggagtgggtcatggtgccgaacgtgatcggaatgggcctctgggccgacggcggcgtcatggcaacgaagccctacgtcgcgggaggtgcgtacctgcgacgtatgagcgactactgccgatcctgtgagtacgaccctcgtcagcgcacgggagatcgcgcatgccccttcacgacgctgtattggtggtttctcgaccgacaccgtgaacgctttgctcaccatccgcgcatggccccgctcctgcacaacctcgatcgactcggtgacctcactgcgatccgagagcgtgcccggcagatcctcgaactcctcgacgcgggcctcgcctgatgtgcccgagcccgactggttcttcgagtcgatcgtcaacgtacgaccgtcacgggcgatgtgactccggacattggatgagaacaccgatgccggagacgtgtcgccaccctcgatggcatcctcgccgagcgaggagccccaggcttccgccgagtcggcaacggcccggagtccgtggcagcttccgtggccagctgggcagccgaactcgcggtgacctcgtgattcacggatccgggctccccgcggcggtaacggtccgggttcaaccggtcgttgcaacacccccgatgacgcaggtgcatgtgcaaccaaacaggaaccaggctcctccgggagcgaggcgacagtgggcggccgatcgtgccctgcggccgccgatgcgctccccagggcggccagacccaccacggatgctccagtaggccttctggcagctcatcgccacggggatctcgaccgcggacgcctgcgagcgcgtgggctcgcgcgtgctacgccaacctgtgctcccatgcccgctacggagcctcccgagcggtcatcaccaccgtccacaacgaccgctggcggagagacggccgaccccgagcctcgtcggctcgaccggcggcagaagttcgagtctcacaccgagacttgatccagacacgcgacatccgtcgtcaatggagctgacgacttctcactcgaacctgcctgaactgcgggaacggatcaatgcgttcgcccgcaccgacaggagccaccatcagacccggatcacctcgaggcccggaacggcgtcgtagtcgcggtcttgagtgacgaccgggattgaggggaccccaagagttgagccacccgctttgcgagttgatgtgcttgtcggtggagccaggcctcgacgaactcgaccggagtgagccagccgtgtgcgctgtggggcctgttcatgttgtagtcgatcctccagtcctcggttaggacctgggcttcgaggaggctgtcgaactgctggccgttgaggtgctcgtcgcgcatccggccgttgaagctctcgatccaggcgttctgccaggggctgccgggatcgatgaagacggtcccggtaccgttgaaccggcaccagtcagccacggcgtgggcgatgaactccgggccgttgtcgaagcggacgtagactggggcgctgcgacctgcggccaggcggtccaggcatctgaccaccccgtcggcgtcgatcgaacgctcgacgtcacaggcgagggcttcgcgggtgaactcgtccacgacgttcaagaagttcaagaacttgagcatcctcccgtccgacgtctggtcgaactggaagtccatggcccagatcacgttgggccggatcgggcacatcgccccgacgggcttgccgatcccccgcaggggcttcttgcgctttctgtagggcacacgcaggccttcggcgatccagaggcggtggatgcgcttgtggttggcccgccagcccgccttcttcgcctcgacggcggcccgccgccagccccagcgcggacggcgccgggcaaagtcacgcagccacgcccgcagtgccagctcgtcgtcggaggggatggggggcttgaggcgctgagtcgagcggggctggccgacgacccggcacgcccggcgttcggtcaccccgaactactctcggagggccaccacggcccgccagcggcagtccggggtcagaagtttccccggttcagctccttcaacatgtcgatgtcgagggcctggtcggccacgatcttcttgagacgcgtgttctccttctcgagctccttcagccgcttgacgtcatccgccttcatgccgccgtactggttgcgccaacggtgccaggtcgactcggtgatctccaggtggcgggccacctcctcgatcgactggccctggccgaggagcttctcgccctcagccagcttccggatgatctgctcggtcgtgtgccggcgtctcttcatcgtgtgctgtcctccttccccacatcgtggggcttggactcgcacaacgggtggagcagcctacggggacccggccaggatcccttcgaccatcgcggttgccgcaacaagcacgtcgagtatcgggacccggcggcgctcagcgtgcagcacggcggccacacgggcaaactgacgcgccacctcggcgtccaccggtagcggatcccacgtcgactccacggctgaaagcgtcgccactcgcgccggtcgatcatcgtcattcgccatgagcacgccgagcgtcagttcggccaccgtcaccaccgacacctctgtgtcggtcaccccttccatcgcgcccaggggtcgacccgactcagtggcgacgaagaacgaggtgtcgagcagtgccctcatagatcgtcggtcgtgtcggacagcagactccgcacctccctcaggagcccgcggtcggccgggtggcgagacgcaattgcgaccgcctcggtcgccgacaccgtccggcgacggcgcaagggcacgatctcggcgaccggtcgccggtcaaccgtgaccgtcaacctctcgccgctctcgacccggcggatcacctcgctgaccgtgttccccaggtcccgcaccgaaatagaaccactcacgtcgctacatgtagcacatgtagccacaagtgacccgcgtggagacgaggggactcgaacccctgacctcctgcgtgcaaagcaggcgctcttccagctgagctacgcccccaaggcttcgctcatgctaatggatcgtgctcggaccaccagtggtccaggcccttctgcaccatcagcgacgtcccggaccaagcaaccgcaggctcacaggctgcacggctggaccacgactggtcaccagtcggacgcgctcgaaaacgtgtaagaccacggcattcgccgccgcaccatcgagactctacgtctgtgccagccccgagcggggccggcacagacgccacgcggagggagtgggattcgaacccacggtacccttgcgggtacagcggttttcgagaccgcccgattcggccactctcgcatccctccccgcccaacgaccgaagtcgccgaacgcaagcagagtctacggcacgacgcctgggcgccgctccgagaagaaacggcgaaggagcaaagcagctcgttcggcatcgaccccgccgacgatctcgagctcgtggttcagccgcggatcggcggcgatgttcatgagcgacccgcatgcacccgcctttggatcccaagccgcaaagacgacgcgtcgggcacgggcgagcaccagcgccccggcacacatcgcacacggctccagagtgacgtacacgtccgcaccgaggacatagccgtcgccggcatcggcgagcgcatccgacagcgcaagcagttccgcgtgcgcaaggctggagcgccgctcgatcgtctcgttgtgacgcgcgccgagcacgcgaccactgcggaccaccacggcccccaccggaacctcagccgtccgcgcagcatcctcggccagaccgaaggcgacgtcaagccaccgacggtcgtcagcgctgagcatcgacgtcagggggtgcgacgcgcttggacgcgtcgaccggtcgagtctgtcgcttggcgatggtcgtgaccacccattcggcatacggatcgtgcgggagcgcgacagagcgaaccagcacctccgggacgtcgtacgggtgggcagacgcgatgagcttcgtcagacggagcacatgctcagggagtgacaaggcccgcacctcgacctcgtcctcggtgtgccagtcgccctgccagtagtaggtcgagcggaccccatcggtacgcttgacgcaggcacacaggccggattcgacgagcgcgtccaccagcgccgctgcgtgctcgtcacttgcgagggtggtgacaatctcgactgcgtcgatcactagcccctccgctcggtccccgccactatagtgatctgcgcttgtgcgctcgtagctcaacggatagagcatctgactacggatcagaaggttgggggttcgaatccctccgagcgcgccacaaagctcctggtaagagggttgacggcacgtggactgggcgtggttcccgctcgcgaagtcaacggcaggcccaggcatcgtgacaccggtcggcgcactccgctctgactcggcgtcctaccaccgaagggtgcttctgtcaggtcgccgcgccggaacatcggcatctggtcctggaacaggtgcagattgctctggaacgtcgttcctagcttgatcctcgaaggttgatcgcgacgtggtcggcttgtgggagtgtggttactccctcggcgtccagggccattggtcgatgtaggtggggatctcgatcgagctgcgcccatagcgcgaactctcgaggatcgcgcagctacgatccgctgtcattgtgagcgacgtccgaagggcttggctgatcaatcggcgcccggtcgagcatctcggtgtcgagctttcgggcccgactgcgacggatcgttgctgcagatctgctcctgaagcctgattcaccggacagacggaggacgacgggcacgatcgctcggcacccggagcggccgccgtggagctcggcggactccctagacggtcgggatgcgacgacggattcgaaggttgggggttcagattcctccgaactcgcatcgccgtccagctgagggggcttagaacctgcaggcaccctgccgatcacgtgcctcgtacgcttgcttcgttcgcctggccaagcgagaacacgggctccggccgatgccggagtccgcaccagtggcctcctcccttcgaatggcactggtgcgaccccgcgtcactcgagcccgaagagtgaaccggtgagcgttgcggcccgccgcgcgcgtcatcagcgaccagcctcaccatgccggtcggcaggtttggagcaggtcccagtgtgagagaccatgcccgccccggtgccaccgtactacgtcgaaatatcgggatagggaagccggacgtgcgagaggcgccgtgcgtactctcgctggaaaccgagaggctcctcgtagtcgtgctcgaacagggcgatgaacagggtcaaggtgaggaagtggtgggcacccaattcgaagagccgcacgtagtcgtgcgtggccagggcctctcgctcctcatcactgaagcccagccaggtggtcgcctccccactgtggaggttgaggacgcgattggcccgctcgcgctcccaccactcgaccgttccccgcggatccacgcgatagcgcgcgacgagttcgggatcgcgatcgaccgtgtagagaaacttgtctacgagatagcggctcacgcctcccccctcctcggataccaggtgaaatatgcctccatcgtgtggaacaggtcgaggttgtcgacgtaatcggctcgcacaccctgaccgacgacgcccatcatgagcaggaagtccatgaatccgtgcgtggcgttgcccggcagccagagactctcgagactgacctctgccagagccccatcgatgtcagcgttcgcgatccactggatcgccttctgatcgaaatctgggtccggcccgtgcggaccgaactgacgcggtccgcccaactccagcgagagatgtccagttccgatgatggcgacgcgctggttgctcggccactgctcgacgatgcgccggagcgccgctcccagctcgacgaaccgtttgggctggggcatcggcggcgcgaagatgttcgtgtagacgggcacgatgggcaggtcgacctgcggtcgcagcgtgatgagcgcacacgtgatcgagtggtcgatgcggagctcgttcgagaacgcaagatcaaagccctcgtcgagtccctgtcgaaggatgtacgcggcgagttcctcctggccggacacccgcatacgtgggagtccgaactcccgctcctcgttgtagtagttcgcgtcgaacaccggcgccttgccgaccaggaactgtggcatgttgtcgagccacagttggtgaaagtggtcagagccgaccatcacgagcacgtccggctcggcgcgggtcaacgtctctcggaacgcctcgatcttggcgacccagacgtcggcgaagtcggggcgatcggctccggtactcgtgctcgccctgtagtagaacgggtggtgcgtcgacgcgatgatcgcacacacatcggccatcatgccccccttcgtgtcatgctaggcagtcggatcgcttgcgcctggggcgacgtagcgcgcccctcgatccaccgtgaggtacacatccatcgcgatgggccgccgacgctcctcggcaagatggccaaggatcccggcggtacgcgcgagcaggaccacgcctcgcgcgagttctccctcgatgccaaggtcccagagaacggccccggctgcaccagcgccgttcagcggcagccggcgaccgagtatgtcggcgtgcactcgtccgatcgcctcgaagagtgccacgtgcggacccgcggcgccctcgcgtcgcgccagttccatgagcacgcccgtgcgcgggtcgcgctccttgtgaaccgggtggcccaaccccgggacgtagcgcccatcacggtgggcgctcgcgactgcgtcccgagcgatcgcatcgaagtccgacgcggtctgcggtgtctgctcggcacgggccaatgcgtcggcgagaaagcgaccggtatcctcggtgactccgaggaacctggagcccccaccgaggattcccgcagcaagcgccccctggatcgactccggcgcgctcaggagcgtcaaccgagctgcgatcgcggtgggggtgaagccgtggtcagcgagcgagaccaagcacgcctcgaacacgcggacctcgccagcgctgggtcgcctgccggtcacgagccagaaggccagctctccgaagctcaccgaacccatgagctcgcccgcgaggtcagccccgagcagggtgatcgcctcgggcgtggatacgccaatactggtcgggaactcgggcgtgctcaacggtcctcctccatcgggcgctggagccagtcccggatctcgtcgccgtgctcgtcatgggccggcggaggaaggtcatagcgtggcgccgtcttcgaatagatcaccgggtggcgcgtctggcgtacggcgcgcgacccctcccccaccacgatgacaggctcgagtccgatgcgctcggcgaaggcaacgccctcggccacggtgttgatcggtccgcacgggacgccgacggcggtgagccgctcaaaccacgcgtccgcactgtcgtgacggagttggtgctcaagcagtggccgcagctgttctcgatgagcggtgcggtcgtcggggtgggcaaagcgcggatcctgggcaagttcaggcacgccaaggacgtcacagagacgagcgaactggacgtcgttgccgatcgtgacgacgagttcaccctcagccgtcgggaacggctcataggggaacagactcggatgcgcgttgcccatgcggctcggcaccacgccgcccgcgacgtaggcgctggtctggttcaccatgccggacaacgccgaggcgaagaggctcgcctcgaggtgctggccctcgccggtcaacgtacggtgatggagggcggccagtatcgcgatcgccgtgtgcagtcctgtcatgacgtcgaacaccgaaatgcccgaacgcagcgctgggccgtcaggctctcccgtcaagctcatcaacccagacatcgcctggaccaccaggtcatagccgggcagttcccgcccaccctgactcgtgccaaagccgctgatcgacgcgtagacgaccgcggggttctcggccgcgacgtcctcgtaggcgaggccgaagcgtgccaatccaccaggcttgaagttctcgacgacgacatcagcacgacgtgcgagttcctgtgcgagggcacgatcgtcatcgtccttgaggtcgagaacgaccgaccgcttgttgcggttgatcgcaaggtagtacgtggacgtcccgtcggcggtgaccggaggcttccaaaaacgagtctcgtcgccggtcgggctctccaccttgatcaccgtggcaccgaggtcgccgaggagcatcgtgcagtagggaccggcgagcacccgcgagaagtcggcgaccaggaggccagcaagtggcccacgcccttggtcctggttgcgatcgtccacgcgaactcacctcgttgccacgcaccgcacgacgtcacgaacccgccgaactcggagtcgaccccgacgtgtccgtagatcggacgcctgtccgtctttgcgtggatactaaaggttcccggcggtgctgtcaagcgtccgggccgaatgcaagccgtcacgcaccgccaatggcgctgccgcgatccgagcgacgtcggcgtcgatggccttggcggtctcgatcagtctcgggagatggtgctcgagcaactcgtccagactggtctcggcagcatgcacgttcacgttgacagccgctaccaccttgccgtctggatcatggagtgcgacggcgatggagcgaatacccacggcgagctcctcgtcggtgagagcccagccccgctcgcgcacgttggcgagcacgcgccgcagctcctcgagggcaggggcacgacgcggcgtcaccggagagcgcgacggcacggccagggtgcgctccagttcgtcgtggtcgagatcggccagcagcaccttgccgagtgacgtcacggaagccggaaagcgcgtccccacggtcaccgcgattgccacgatctttggcaccgcaacccgggcaacgtagagcacgtccgaaccatccaagacagcgatcgaggacgattccctggtctcggccaccaactgctcgaggtgaggtcgcgcgacctcccaacgactcctcgcgagcaccgacgccgtgccgagatccagcaccctcggggtcagctcataacgcccgtcgtctcgttgccgaacgtaaccgagttcggccaacgtcgccaggatgcggtgggcggtcggacgcgcgagatgagctcgggtcgcgagctcgacgaggctggctggctcgccgcgaccgaacgcgagaaggacgtcgagaccccgggcgagcgactcgacgaagtcggggttctcgctgcgtctgaccaccgtgctccctctcgtccgagcccagagggagcctactcggtgcgcgcctgcacgatcgatgcgaggtccttgacgacagacgagcgatggtgcatacttgcgcatcaccatacggacacatgtccgaaactgcggaccagcagcgaccggtccagtgccgacgaagggagcgagcatgcgaaccagcgaagtcgtccgcgagccgatggtgctgcgcgagggactcgtcctcacgatgaatcgggcccacgacgtgctcgcctcgaccgacgtgctcgtccggaacggacggatcgaggcgatcggcccgcgcctcgaagtgcccgagggcacccgagagatcgacgctcgcggcggcatcatcatgcccgggatgatcgacacccaccggcacatgtggcagaccgcaatgcgtggctacggagcagactggaccttaacgcaatacttcgtgtggtactacctcacctggggcaagcggttccgtcctgaggacatctgggcagggaacttcctcagcgccctcgaggcgctcgacgccggtgtgacgaccacggtggattggtcccatggactccagaccgtcgagcacgccgaggccgccgcggacgccctcgaggaggctcccggacggttcgtccttgcctacggcaacattcaacaggggccatgggagtggacgaccgaccacgcgttccgcgccttcgtcgagcgacgtttcgggggcggaggcaccgagctcctcgggttccagctcgcgttcgacgtcaccggcgatccggcgttccccgagcgagccgccttcgaggttgctcgagatctcgacgtcccggtcaccacacacgctggggtctggggtgccaccaacgacgacggaatccgtctgatgcacgagcacgggttcatgacaccgcggaccatctacgtccacgccgccaccctgtcgccggactcctaccaccgcatcagtgcaaccggcggctgggcatcggtatcgaccgagagcgaacagagcgccggtcagggttacccgcccacctggcagctgcgacgctacggtatcggcgtctcgctctcgatggacaccagtgtgtggtggagtgccgacctcttcagcgcgatgcgagccactctcggcgccgaccgcgcgcgcgagcacctcgaggcgcacgcccgcaacgaaaccgtcaccaatcaccacctgcgtgccgagcacgtggtcgaatgggcaaccataggtggagctcgcgcactgggcctcgaccacctcatcggcagcatcgagatcggcaagcgcgccgacctcgtcgtcctcaagaatgaccactcgccagcgatgacgccgatcttgcacccctacggccacgtagcgttccaggcccagcgagccgacgttcacaccgtcatcgtcgacggggttctcgtcaaggacgaccatcggctcgtcggtgaccatctcgcccgagcgcgacgcggcgtcgacgagaccgtggcctacctcatgcaagagcttggtgacgaggcatggctcgaagggatgcatccggcgatcccggagctctcggtcctcgagaacccctatacctacaccgagtggcgcagcgagagcgcacgttggcgggaccgcggcggcccggacacctccgagcagaacgccgatggcggcacgcccaagccgccgtctgcctgacagagcccgatagctctgcccactgaggtgggcacttggccttcgaccgagaccaccggcttgggcgcaccagcaggtgcccatgggtcccccgtcgtctgctccagagtgcccacccggtggaccactgaccagagctgcgacgacaatggtccgcaagacctgcctgcaccgcgcagctccagacgtcatcgattgatgagcttgcaggaaacccgcggctggtatcgacggcctcgaggccgacggaacgacctcaccctccgcacgcggcagcccgctcgctccgacgagaggccgaccacccagcgccctgccatgaccgggagtctgcctgtcctcgctcggggcgaggtctttgtactctaccactatttcgaagctggagatacactgaggagcagcacaagcagaagggagacggtcatgctcacgatgcatcgtgttgcgctcgcagcgctcatggtcgcagcgggaggagcttcgctcaccgcctgcggatcgacgacgacctcctcgaagccgacgaccaccagtcccaccgcagcgatcaagaagagctacaccgacttcttcgccggcacgacgtccgccgcaacgaagatctcgctcctccagaacggcagagagttcgccgacatcatcgacggccaggcttcgtcgtcgctcgccaagagcgtgcaagcaaccgtccagaaggtgacgctcacctccgggacgaccgcacgcgtcgtctacaccctggacgtcggcggacagcccgcactgaagaaccagaccggcgaggcggtcaaggtcggtggccactggctcgtgggtgatgggagcttctgtggcctcttggcgctcgagggcgtgaagaacgtacctgggtgcacgagcaccgctggctaagaccgtgcatccgtcggcccgcgcacgagcgctggtggtgctctgtgcggtcatgtccctgacgttcctcgacaccacgatcgtcgcggttgcgctcgccagcgtgcagaccagcctgcacgctggcgtggcccagttgcaatgggtgatcggtggctatgcgctcgccttcggcgcgctgatgctgcccttcggagcgctcggggatcgcttcggtcggcggcgcgcgatgctcgtcggtctggcactctttgctgttggatctgcgaccgctgcgcttgcccactcacccgctcagttgatcgccgctcgcgtggtcatgggtgtcggcgctgccgccagcgagcctgggacgctctcgatcattcggcagctctacaccgagcccggcagccgcgcacgagcactcggcgtgtggtccgcagtagcggcactcgcgctcgccgtcggaccggtcatcgggggagtactcgtcgggattggaggctggccagcgatcttctggttcaatgtcgccgcgagcgtcgtcgtcatcgtggtcacggccatcgtcatccccgagagtacggaccccggtgtcgggcgcatcgactggggtggagcagcactcggcctgatcgccatcggtggggcgctcttcggcgtcatccagggcgaggcacgcggctatggcaaccctctcatcgtggcggtcttcgtcgtggccgccgtcggtttggccgtcttcagcgtccttgaggcacacgtgccgaacccgatgctcgacctgcactaccttcgtcgaccaggcttctccgggtcgctggtgctggcgttcagcgtgtacttctcgatcttcgcgatcttcttcttcactgccctgtatctgcagatcgtcgagggctacagcggctaccgcatcgcgtcggtgttcctcccgatggcgctcgccatgatcctgacctcgctggccaccggacggtgggtagcgcgcattggcgtcggcatgcccatcgcactgggatcactgctcgccggcctcggcgtgctcggtgccgacgtcggcctcagcggcagcacgcatccattggtgctcgccctctccctcaccgtggctggactcggcttcggcaccaccgtcgttccggtcacgagtatcgcgctcgccgtcgtaccgcagcagcactcaggcatggccgctgcgtccacaaacaccgcacgagccctcggcgtgatcgcgagcgtctcggttctcggctcgtacctcaatgcccagctcaccagtggccttggtaccaagctcgcccgactcggggtcccaccggtcttccgccacgtggtgatcagcgcggtcgagacgggcggcgtccccggtggctcgagcattgcggccgacaccaaaacgttcgggcctctcgtcgccaaggtcgtcacagctgcctacggagcatttcatcgaggtctcaccatctcattgatcatcgctggcgcgctcatcatcgtctcgggcgtcttgagcgccgtcgcggtgcgaggtgcgcggacgcgccccgacggcgagacgtcccaggcgtagtcgaggcccaaccaccgggcgaccccgagctgtgctcgaggccgcccgaagtgcgagctcaggccgtggtcgccgacgacgtcgtcgccgacgttccggtatgagccgggcacgggttggtggtcgtggatggcgtggtcgtggtggtcgtcggcgtcgtcgacgaactcagctggacgactgttccggtcgtcggtgcggccatcgactgcgcgatggcgaaaccgacaccgccaccagcgatcgccgctcccgcgacgccgagacggatcaggactctccgagacagggtcacgctccctctacctccttcattgtgtctgttgctggtgcccgcaggcacgccgatgggtcatcggcacccccatcctcgcgtatgggcctgggagcgagtccagctcgaccatggaagcaggcaagaggccacgcgcgactcgcgctgccttcgatcactctccgaccgctcgacgatgaagctcagccatggccgcggtagctcgctgcgcctgtgcataccatccgccccgtcgaagcagttcgtcgtgggtgccgtcctccaggatgcttccggcacccacgacgacgatccgatccatgcgctcggcactgtggaggcgatgcgcgatcatgaccgtcgtgcggccggcgccggcacgctcgatgccagcgtgcacgcgagcgtcgagctcgggatcgaggttcgacgtcgcttcatcgaggagcaagatcgcgggatcgatgaggacggctctcgcaagacacacgagttggcgctcccccgccgccagcgcgcgaccacgctcgcccacgacctggtcgtagccgtccggcagtgcagcgatgacgtcatgggcaccgacggctcgcgctgcggcctcgacgtcgtcgtcgctggcccagggtgcaccgaacgtgatgttgtcccgaatcgtgcctgagaagaggaacggctcctgggggacgtagccgacccggctgcggaaccacgcaaggtccaaggctcgcagatccgtgccgtcgaggcgcaccgcgccttgcgagggatcgacgaagcgaaccagcagcttcatgagggtcgacttaccggcgcctgtctcacccaccaccgcgacgtgctggcccgctgggatcgcgagcgagcagtcacgaagcgcggggcgctgaacccccgggtaggcgaaccacacccgatcgagttcgatgctccctcggatccgggtgggtcgactcgcgttcgggctggagcggatgctcggttgctcgtcgaggagcgagttgatcttgcgcagtccggccctcgctcgctggtacgcgtcgaaggtttgtgcgagctgttggacgggcgcgaacagctgcgtgatgtagagcaagaacgcgaccagcacgccgacttcgatcacatggccacgcaccagcccactccccacccagaggacaccggcggtcaccaccacactggtaaggtccgcgagggccacgtagatcgcctggacaccaagagcggtcaagctggcgttgcgataggcaatccccagccgtcgaaacgtcgcgagaccagcctcctcctgaccgagggcctggacgacttgcacgccagcgatgctctcttggaaatgcgcgttcaccgcggccacgtgttcgcgctgccggtcgtaggcgcgctgagcgatggctcgatacaccacggtcgcgaccacgagcaccggcacggcgaccagtgcgaccaacgcgagacgcggctcgagtgcgacgagcacgaccgcaatcaccacgaccgtcgcgatccccacgatggcactgaccaagccgttctggagcagctgcgacatggtctcgacgtcgctggtcagccgggtgacgagccgaccgctcggctcccgttcgaagacgtcgataccgagccgctgtaggtgcgagaacagtcggagccgcagctcgaagagcatcgactcccccacacggcccgtctggacagtctcggcccactgatcgatccaaccgatcaacgcgaccgcgaggagtccgagcgcggcgagcacaaccgtgatgccactgtgggcgagcatgcctccgtcgataccacttcgcacgatgagggggccgatgacccccgaagcggtgtcgatggcgacgagtgccaacgcgagcacgaggccgaagcgccagccggagagaaacgtgccgagtcggatgcgaccctcgccaggtggctgtgtccaccggggccgctgcggctcatcacgagtcggggggaggtgcgcgatgagctcgccgacccaaggcggcacgtcacccaggctccgagcagctgcgaggcgacgccgaccagaaccactcgcctcgacgatctgtcgcttgggggacaccgcctcgatctcgacatcagagccatccccaccatcgagaaatcggcgcacccacgacgacatcgcggcgacacgggcaaccgaaccgtcagcgacgacacagccctgctccaacaccaccacacgatcgaccaaggagacgacagaggcacggtgcgacacgacgatcaccgtcgggcgctctggcagcgcccggatcgacgcgatgatgcgctcctcggtcgtcggatcgatggccgaggtcgcgtcgtcgagcacgagcacgtgcgggcgcatgacgagtgcacgcgcaagcgcgaggcgttggcgctgacctcctgagagtgtcactccgccttcgccgatctgggtgtcgaacccgtcaggcaaggcctcgatgaactccagggcgcccgcccgtccacaggcctcacgaacctcggcctccgacgcatccgggcaaccgaaacgaacgttgtcgaccaccgtgccggccagcaggacgctctcctcgaagaccatgctcacgcggcgccgtagctcggcgagcgacaccgagcggacgtcgacgccgccaacgagcaccgcgccccccgagacctcggccaaccgcggcaacaacgtgcagagcgtggtcttcccggatcccgacgggccgaggatcgcgaccatctcaccagccgcgatctcgagatcgacccctgcgagcacttcgtgcgtccccccacgtagcgccgtgacgccccgtacgctgacacggcgagcgtcgcgtggaagtggcagtgggtgcggcacctcggtgatgccaggttcgatcgagaggagttggtcaatccgttcgaagcctgctcgcgcctgctggccgacgacgaggatgccggccaccatgcgcgcgggcgccgcgagctgcgtcaggtagctcgcgaaggcgacgaacgtcccgatcgtgacgtcgccgttcaacgcaagcagaccgccgagggcgagaatgcctgcctgcacgagctgcggtatcgcctggagctcagcggtgacccaggcgcgcagcctgatgttgcgaagcctcgacgcgtagagcgcacgcgcgccatcgacgaaccggcgtatctgcgacgcttcctgcccgaaggcgcgcaccacacgagctccgatgatcgactcggtcaccacggtcgtgagttcgccctcccgctgctgtgcgtcccagctcgacgggaagaccgtggagcgcagggttcgcgacgctaggaaggtggcaaccgggacgatcagtgcgagcagcatgagccagacgttcagcacgctcatgatgacgatcgacacgatcgcttggagaaccgcgccaagaaccatcggagcccacgccaggacttgttgaacgagaccgagatccgtcgtcacacgtgagagcagctggccgatctcgagaccttcgtgggtggcgagatcgagcgagacgaggtgcgcgtacacctcgttccggatgtcgagttgcacgtcgtaggccactcggccaccgatgaaccgtcgcaccagggtcgtgccaaaacgcacgataccgatccccactaagccgagcaccagcgcctcgatggcggcccgtcggcctccaagcccgtcgatcacggctcgttgcaccacgggaaccaacgccagcgaccccatcgacacggccgatgcaagcagggtcacggcaagcttgccacggtgccggcgaagccatggcgcaaccgctgcccacgagccttcggtcaccgacgtcgcgatcggacgggaccgctccccgcccttggtcatcctcaccgctctcgtgctccccgccgctgcgccccacgtgctggctcacatacttgtattctcccaccaccctagagcgatagcagcgcgatcacacctctccagggacctcatccgctaccacgagtccacccacgtggcctccgttgtgcgccgcgaccctcctctgtctcgggcgcggaccgcacggcccaaccaccgaactgccccaacgatacgagcaacgcccttggcggctgacgcgaccggtctccttggctcacaatccacagggttgtgcacacctgtgcacaaccctcttgttcaccttccgataaccctacgcctcgacttgagggtgggggtcgacgatgcccgacgcgatgcgatggagatcggcaagatcgacgaaccgaactcggatgtaccctgcgccactcttgctcacgtcgatctgcacatccgactccatgacgtccgcgagcaaccgctcgagctcgacgacgatggccggacgcagccgtgcctcgggcaccgcctccttggggccctgcgcatgctccgattcgccagcctcgaccctcgtcgcctcggccgcggggttcgagatcgcccgcaccgcctcctcgacgtctcggacggacaggccttcctcgaccgttctcctggccaactcctcctgcagacgacgatccgggcaaccgagcaaggccctcgcatgccccgccgacaacaccccatcgagcagcatccgctgcagcgcagcggggagctgcaggagtcgcagcgtattcgagacagccgcccgactcttgccgacaccacgagcaacctcgtcgtgcgtcagctggaaatcgtcgatcaactgccggtacgcagctgcctcttccagcgggttcaagtcacgacggtgcaggttctcgatgacggccacctggagcgacccgcggtcgtctcgatcttgcacgatggcggggatgcgatccaggccagctcgctgcgccgcgcgccaccgccgttcgccagcgatcagctcgtagccgtccgcgacccgccgcacgaggatcggttggagaacgccgacctcggcgatcgatgcggcaaggccactcagcgcctcctcgtcgaagatcgtccgcggctgcagaggattcggacgaatcgcccctactggaatctcgacgaggccatgctgctcctgctgaacgcctgttggaatcagcgcaccaagtccgcgccccaaaccggtctgcctagccatccttgcgcagctccgtcgccaggtcgcgataggcaatggcgcctcgcgagctcggatcgaacgtcgtaattggctgcccaaacgagggggcctcggagagtcgtatgttgcgagggatcactgtctcacacaccaagtcaccgcagaactccttcacgttggctaccacctgctcggagaggttcgtccgggcatcgaacatcgtcatgaccacgtgcgaaacacggagcgtcgggttcaggctctgctgcaccaatgtcacgttccgaaacagctgcgacaatccctcgagggcgtagtactcgcactggatcggcacgagcacctcatctgcggcagccaacgcattgaccgtcagcagtccgagcgacggcggacaatcaatgaagatgtagtcgtagtcgcctcggaccggctccaacgccctgcgcaaccgagtctcacgcgacagcaccgacaccagctcgatctccgcaccagcgaggtcgatggttgcacccgcgacgaacacattgcggaccccagtcgcctcgatgacgtcttccaacggcgtctcgtgcacgaccgcgtcatagatcgaccccgcaagatcccgagggttcaccccgaggcccgtcgtcgcgttgccttgcggatcgaagtcgaccagcaagaccctcgccccctgctcagccaacgctgcagcgaggttcacggctgtcgtggtcttaccgaccccacccttctgattggcgaccgcaatgaccctacccatggctactcccgcggacgtgttcgcctgcagttccacgtggaacttgacgcttcacggcaggctactcgatcacggctccaccccgcgccacagaccctccctccaccgtcacgttccacgtgaaactggagctgcagaccaaccacccacgccacgtcttccgtccgcaccatcagaccaaccctcccgggtctccaagcgcgcaacacgcataccaccccgccgccgctcgataccacatgaccgacggatcgaccatcgagcaccttcgaactccatgagcctgcctccgcctcacccgcgcccacccaaacccctcaacctggagcccccgtcgcagccggaaccacccgtaccatcgactccccgtgcgaccacagcttccacctggcggaccaacgccaacggccatcgacgacccccaccaaccagtacgtgcgactaccccaaacgcatgcacgtccggagcccagcgatcgatcacgcgagaacggtcaccccacagaagggcgagaggggagtgacaagggaacgagaggggagcgagtcctaggagccttctgaacaagcccctccctggtagcgactgatgccagccacccagcccgggaacgagctcagctgacccgtgctcgcccagctcctcaccctctcctcttcgtcccctcctcgtgggtgcggaggagagggcccgagcgtctctcaggtggcaagcacccagccaccacccactcgggtgagccccaggcgtagcagcaccttcaggttccaggtcgcacagagcagctcgaagtgcaggcggttgcgcacgagtccccggtagcgcagcctcgccccggagagcttgcgcttgagctgtgcgtggatccgctcgacgttcggtcgggtgcgctggtagtcgagacggacagccgggtccccaaagtgcgcccgctggctgatgccgtgccaggtggcaggggtgaaggtgaggacccgtccgcgcttcgatcgtgtgcagcgctcccggagcggacagccatcgcagtgcttggcgaaggaggcacggcccttcgcggaaatggggactcggtgccccgcaggacagctaacccatccctcctcgacgacgaagtcgtcgatcgtgaagccaccagggaccgccatagaaaggggccgaggcttgatcacctcgtcgtggccatgagcggcaagctcgttgaagacctcgctcgtggcgtaggcgctgtcgccatagaccgtgcgtgggccgtcctcgtcaccaaggagctcgggcacgacctgtgcatcaggcacgctacccgtcgtgatggtcgaggcggtgacgatgccgctgtctggctcgacggccacgtggcccttgtagccatcgatggcacgggcacgggacttgtgcacatggcgagcgtcggggtccacggtggagatgaccctgtcgcgggccactcgcctcgcgatgcgccagcggcctgcggtggcatctgtgcactcgacgtcctggcccgccacgagcccaaggaggcccagggcctcgcgctggggctcggtgagagacgcgagcttctcggcctcggcgaggtgggcggtggcatcggcgacgagggcgctcaccgtgcgcaccactgcttcttcgtctcggtagtcgatggcaggctttggacgggtgtagtcgatcgctggtgacagaggaacttcgcggagctcggggatcagcctgcgtacccggttgatctgagcgacgagttgggtcatggtgtcttgggtcgcgaccgcatcggcgagcacggtggagtcgacgacgcgcttcgtcgtgcccttgagcacccccgtggcaccgatcacctcggccacgagctcggtgatgagtcttggggtctcggaggtggcgatgcgcctgcgccagtaggtgagcaccgtggggtgaaaacctgggtcctcgaggtcgagaccgagggcgtacttccagcgcaggttgtagcggacctgctctgtcgcctcggtgtccgagagcccctcgagcacctggagcaccatgaccgcgagcaccctcgaggcggggatggagggtctgccggtcgtggagggatagaggtggcggaagcgctcgtcggggaagagctccctgcggtgctcggcgaggaaggcgtagatggaccctggctcgatgagcgaggagcagaaggcctccgtcgcggtgaggtgtgcctggtctgattcggtgcccaacatgcaaaaagtctagctgagctgggcaaatggcgctgggcaggaggggaggagcgccgtgcgtcgccgcgctacgtggaggagttgttcaggaggctcctagaggcctacggccacctcgcacaccgatcacgggtggaccacagccgcgacgctcccagacgcctctcgatccatgcacggctgctcgtcggtgcccatcgccacaggacgggcggaccgccgccatcacgtcacacggaatcgcgccgaaccacgcgcagctcgtcccggaatgccgtcgtccgacatcggccgcacacgccgctcgcgatgaccctcacgatccgactccctgcgcagagctgccaacgccgagcccaggcatcactgacctggcggaccaccccaacggccacggtcgagaacgccagccacgacactacggacaccaccagcgccaactccagcgaccaagcacgcgcctacgccacgacgccgatgcgaccacgtgcgatcggtgcgtgccgacctcgagttcacccacctcaccgaatgcccacagcagctgatcgcccgcaggagctggccacaccaccacgtgctgccggagccagtgtgacttgccgacgagaccaacccaccgttcctcaccgaccgtcgccccgcgctccagcaagcaggcacgccacagctcgcgaggccgctctctcggcacgcaccacccgcacgtcagcgcacgacccccgaggcaatcccgtgggcggctctcgtcgacgatcgagtgccagcatcgaggcacaccgaggcaatccacacaggtccccaaccagccgcccactcatacgtcgtcgcgcccgacccgcagtgtcgtcgaggaacgctcctcgctccacaacggtcgacgctccggtatcccggagcgtcgaggatactgtcccgcgagcggtgctaccttgcgcagcacagtgaagtgtggggggcccaccaccacttcagccacgacgagaccgagcctcgcgagctgctcgctggccgaccaacgccgtccagccccctcaggtggatcggagaccacgatgacgcctccaacgcgaacgaatccgctaccgatctcggcggtgaccggcggagctccgaatccacgagcgaccacggcgtcagcccgttcacgaatctccttcgaccttgcgagcacctcgccccgctcagcggcgattcgcacccgagccgaccagttcaaggctcgaaccgcctcggtgaggaacgccgcacgccgctggcgagcatcgaccagcagtccttccgatgcgggtagctcgagcgcgacgatcaggcccggtatgcctccgcccgatccaagatcgacccatcgctcggcaccgtagcgacgcacgagcgcagagaaggccctcgaatgttcgagggccttctctgtgggctcgcctacgagaccgagctcgtgggcccgatcaatccactgctcgaccggcagcatcgacggactcggcggccgatggtgctaccccgacacggaagatcacaacgtagcgatccggttcctcaccctctgaacgcgtcccgacaccgtcgatctcggccaccacgtcatggatcaccttccgatctgcggcgctcatcggctcgagcacgcgctcttcgccagtcgtcagtgcgacctctgcctgctctcgcgcgaagcgctcgagcgcgacccgccgtcgctcgcgatagccggcgacgtcgaccgccacccgtcccacaccctcgccggcgatggcctgcaacacactgcgcgtcagctcttgaatcgcgttcaggacactcgcccgtggccccacgaggaccccgagcccatcgccctcgatgtcgagactcatctcttcgtcatcgaggttgctgacgcgaacctcgcccgtcagcccgaactcctgcatgagcccggccaagaaggcctgtgctcgcgcggcaagctccacacgcgagaggggaggagttccctctgccgccggggcttcggccgtctgttgttcgtcgttcatcggagcatcctctgtttcgtctcgcctggtaccagccccgggccgcgcgtcaacggcccgatttcgtcgtccacgacgccgatcacgctttggcatcggaagcttcggccgaagacgagctcgaacccgtgcctctctccgtccgaacccgagaaaacttgctcgcccttcgtcgaggacctcgaactcgacctcggcgtcttccacgccgagcacatccagtgcttgctcacgtgcctcttcgacagttcgtcctgtcgtctcgatccaatccatgctctgactcctagcgattcgccggtcgccgttagcgacgacgccgaccacggcgacggcgatagctgttcttcgaaccctgctgcttgttcttcgctggccccggtggggtcgctggaccgtcggacccgccctcgaccgccgacggcaaccccttcttgccgccaaggaagccaaagataccgccacctgcgggagctgtcggactcgccgcaccgttaccgcgctgctctgcgacccgacgtctcgcctcgaccgagtgcgcacgaaggaccggatcacggcgccacatcacctcctgctgggcgacgcggaacaacccggaaaccaggaagtacacggcaacaccggcagggacatcgaggtagatgacaccgaagacgaccgttgtgagctgttgggtcagcagcgccgatcggttcgccgcggccgccgtgggattcttcgacgcaatctgctgaatctgcaggtactggataccgaccgcgatcagcaccagcacgtagtaggggagtgcgtgcacgaaaccgacgtgcagatgcaagggggtcagggccaggttgatccccacaaagtccatgtgcccgcggtcggccaccagattcttgtagagcttgctggcgtgtgagatgtacaacggcgctgcgacgatggcatgatgactcgtcaccgtgtgtgtcaggccacggatgacgtcgtacatcacgaacagcagcgggaactgcaacagcatcggcaagcaaccgccgagcggcgaaacgccctcctccttgaagagtcgctgctgcgcttcggcgagccccgcacggtccttgccgtactggcgctgcaactccttgagcttcggctgaatcgcttgcatctgcagcatcgaccgcgtggagcggatggtcagcggcgacagcgcgaccatcacggtcaccgtcagcagcgcgatcgcgatgccgtagctcgggatgatggcgtaccagaaggtcacgatccccgcgaggagctcgaacaacgggcggaagatctcgcccagaacacttgcgacgatcatgcgtgcgttacctttccggaccgtcgaggtggaacgggatcgtaccctgagcccccgaacgggttacagcgacccactcgtttagccgccaaccagcttcccctcgccaagccgtgcaactcgactgcctcgtacgcgtactgagagcagctcggcacgtagcgacacggcgatggacgaccacgccgtgcgacctggtaggcgcgaatgaggcccatgccggcccgacggggaagcgcacgtacgcgcgccacaaggctcacgggtcctcccgggggaactcgcctaggtgctccagcctagtgacatccgcacgaatggcggcaaaggaggcgtcgagcttcccttctctcggcccgatcaggtagctgccgggtgcgacagcgctgacgcgcaaggcctcgcgaacccggcgccgaaatcgattgcgctcgaccgccgtacctgctcggcgcggtatggcaaacgcgacacgaactgcggcgctctgctcgtcgcctgacacggtctccgtcggcgcgaccacgacccacatggtgccgagctgatagcgccgacccacgcgccggagacgatggaagtcctgccggcgggcaagccttccgagccgcacctacgccgacagccggtgacgccccttgaggcgccgagccttgagcaccgcacgaccggctctcgtcgacatccgcgcgcgaaaaccatgggtgcgcgcacgacgccgattgttgggctggaacgtccgcttcatcgcctgatcaccttccttgtcgagccccgcagtctaggagttcgaggagtcgaggccaacaccctgcgaggcgagcgaacgtgccctatgat

SEQ ID NO: 2 - DNA, 17 bp, Artificial Sequence
  Synthetic construct, Bact-338F1 primer
cctacgggrggcagcag

SEQ ID NO: 3 - DNA, 18 bp, Artificial Sequence
  Synthetic construct, 909R primer
ccgtcaattyhtttragt

SEQ ID NO: 4 - DNA, 20 bp, Artificial Sequence
  Synthetic  construct, acd320f primer
cggtccagactcctacggga

SEQ ID NO: 5 - DNA, 23 bp, Artificial Sequence
  Synthetic construct, 423r primer
gacagggttttacagtccgaaga

SEQ ID NO: 6 - DNA, 20 bp, Artificial Sequence
  Synthetic construct, acm342f primer
gcaatgggggaaaccctgac

SEQ ID NO: 7 - DNA, 20 bp, Artificial Sequence
  Synthetic construct, 439r primer
accgtcaatttcgtccctgc

SEQ ID NO: 8 - DNA, 507 bp, Acidimicrobiaceae bacterium A6
  misc_feature (1)..(507): FMO gene, ERCFMO_0001
ggtgactgggacttctggcttgactggaaagaccggcaatggtggccggtggtcacaccgattgtagggattacctactgcgcggccatcatgtattacctgtgggtgaactaccgcctgccctatggcgcaacgctttgcattgtctgccttttggtaggcgaatggctgacgcgtttctggggcttttactggtggtcgcactaccccatcaacttcgtatttccctccacgatgatacctggggcgctggtgatggacaccgtcatgctgctcacgcgcaactggatgatcaccgcgctgtttggcggcggagcatttgggttattgttctacccgggcaactggccgatttttggccccacccacctgccgctggttgctgaaggcgtgctgctgtcgttggccgactacaccggctttctgtatgtacgcacgggcacccctgagtacgtacggctgatcgaacaaggctcgcttagaacctttggcggtcacaccaccgtg

SEQ ID NO: 9 - DNA, 507 bp, Acidimicrobiaceae bacterium A6
  misc_feature (1)..(507): FMO gene, ERCFMO_0002
ggtgactgggacttctggactgactggaaagaccgtcgtctgtgggtgactgttgcaccaatcgttgctgtaactttcccggcggcagtgcaagcttgcttgtggggccgttatcgtatgccttggggcgctactatgtgcgttctgggcttgttgttaggtgaatggatcaacagatatttcaacttctggggctggacatatttcccagttaacttctgcttcccttcacaattgattcctagcgctatcattttggacgttgtgttgttgctgtctaacagcttcaccttcaccgctatcgccggcgcgatgggctggggtctgattttctacccaagcaactggccagtaattggaccattgcacgtgccggtagaatataacggtatgatgatgactttggctgacttacaaggttaccactatgtaagaaccggtactcctgagtacatccgtatggttgaaaaaggtactttgagaacgttcggtaaagacgttgctccg

SEQ ID NO: 10 - DNA, 507 bp, Acidmicrobiaceae bacterium A6
  misc_feature (1)..(507): FMO gene, ERCFMO_0003
ggggactgggacttctggtccgactggaaagaccgtcgtctgtgggtcaccgtcaccccgatcgtgctggtcaccttcccggcggccgtccaatacttcctgtgggaacggttccgtctgccgtggggcgccaccgtgtgcgtgctggccctgctgttcggcgaatgggtcaaccgctacttcaacttctggggctggacctacttcccggtgaacttcgtgttcccggcgattctgactccgggcgccatcctgctcgacaccgtgctgatgctgtcgggcagctacctgttcaccgccatcatcggcagcatggcctggggtctgattttctatccgggcaactggccgatcatcgcgccgatccacgtgccggtggaatacaacggcatgctcatgtcggtggcggacatccagggctacaactatgtccgtaccggtacccccgagtacatccgcatggttgaaaaaggcaccctgcgtaccttcggtaaagacgttgctccg

SEQ ID NO: 11 - DNA, 501 bp, Acidimicrobiaceae bacterium A6
  misc_feature (1)..(501): FMO gene, ERCFMO_0004
tgggacttctggtccgactggaaagaccgccgtctgtgggtcaccgtgaccccgatcgtgttggtcaccttcccggcagccctccaggttctgctgtgggaacgcttccgtctgccgtggggcgcgaccctcgccatcctgtctctgctgtttcgcgaatgggtcaaccgatacttcaacttctggggctggacctacttcccggtgaacttcgtgttcccggctattctcattcccagtgcgatcctgctggacatcatgctgatgctgtccaacagcttcctggtcaccgctgtcgttggcggcctggcttggggtctgatgttctatcccggcaactggcccatcatcgctccactgcacgtgccggtcgaatacaacggcatgctgatgaccctcgccgaccttcaaggctaccactatgtacgaaccggtactcccgagtacatccgcatggttgaaaaaggcaccctgagaaccttcggtaaagacgttgctccg

SEQ ID NO: 12 - DNA, 510 bp, Acidimicrobiaceae bacterium A6
  misc_feature (1)..(510): FMO gene, ERCFMO_0005
gactggcatgttcgaccaatcgttgctggcatcgaaccctgtacgctcgataccgactggaaagaccgtcgtctgtgggcaactgttgggacatgcgagcctgcaccatcgtggctgtactttccctgcagctgtgcaagcttgcttgtggggtcgttcaacttctggggctggacatatttcccagcttacttctgcttcccttcacaattgattccttgcgctatcgttcctcaccgtactggatgttgtgttgttgctgtcatgcagcttcaccttcagccagacgctcctacccgctatcgctggcgcaatgggctggggttcttgttttctacccaagcaactggccggttatcgcgccattgcacgtgccggttgaatataacggtactgatgatgactttggctgacttacaaggttaccactatgtaagaaccggtactcctgagtacatccgtatcgtcaagcgaagctccctacgatttagtgggaaagacgttgctccg

SEQ ID NO: 13 - DNA, 507 bp, Acidimicrobiaceae bacterium A6
  misc_feature (1)..(507): FMO gene, ERCFMO_0006
ggggactgggacttctggtccgactggaaagaccgtcgtctgtgggtcaccgtcaccccgatcgtgctggtcaccctgcaggcggccgtccaatacttcctgtgggaacggttccgtctgccgtggggcgccaccgtgtgcgtgctggccctgctgttcggcgaatgggtccaccgctacttcaacttctggggctggacctacttcccggtgaacttcgtgttcgcggcgattctgactccgggcgccatcctgctcgacaccgtgctgatgctgtcgggcagctacctgttcaccgccatcatcggcagcatggcctggggtctgattttctatccgggcaactggccgatcatcgcgccgatccacgtgccggtggaatacaacggcatgctcatgtcggtggcggacatccagggctacaactatgtccgtaccggtacccccgagtacatccgcatggttgaaaaaggcaccctgcgtaccttcggtaaagacgttgctccg

SEQ ID NO: 14 - DNA, 506 bp, Acidimicrobiaceae bacterium A6
  misc_feature (1)..(506): FMO gene, ERCFMO_0007
ggagactgggacttctgggttgactggaaggatcgtcgtatgtggccgacggtcgtgccgattctcggcgtgaccttctgcgccgcggcgcaggcgttctggtgggtgaacttccgtctgccgttcggcgcggtgttcgcggctcttggcctgctgattggcgagtggatcaaccgctacgtctacttctggggctggacctacttcccgatcaaccttgtgttcccgtctgcgttgatcgttccggcgatctggattgacgtgatcctgcttctgtcgggctcctatgtgatcacggcgattgttggttcgctcggctggggtctgttgttctaccccaaccactggccggcgattgccaagttccatcaggcgacggaacagcatggtcagcttatgacgcttgaggatctgatcggcttccacttcgtccgcacctcgatgccggaatatatccgcatggtccagcgcaccttccagccaccttcggtaaagacgttgctccg

SEQ ID NO: 15 - DNA, 506 bp, Acidimicrobiaceae bacterium A6
  misc_feature (1)..(506): FMO gene, ERCFMO_0008
gactgggacttctggaccgactggaaagatagacgtctatgggttactgttgtgcctatagttggtattacttttcctgctgctgttcaagcttgcttgtggcggcgttaccgtttgccttacggcgcggtagtttgtgttttgggtctgcttttaggtgagtggatcaacagatacattaacttctggggttggacttatttcccagtaagtttctgcttcccttcacaactagtaccaggtgctatcgttcttgatgttgtgttaatgctgtcaaacagtatgacaattacagcagtaatcggcggtatggcatggggtctgttgttctatccaggcaactggccagttatagctccattacatgttcctgttgaatacaatggcatgatgatcgcactggctgatttacaaggttaccactacgtaagaactggtacacctgagtacatcagaatggttgaaaaaggtacattaagaacatttggtaaagacgttgctccgga

SEQ ID NO: 16 - DNA, 509 bp, Acidimicrobiaceae bacterium A6
  misc_feature (1)..(509): FMO gene, ERCFMO_0009
ggtgactgggacttctggactgactggaaagatggacgtctatgggtaactgtagctccaatcgtttcaatcactttcccagcagctgttcaagctgttctgcggtggcgttaccgtttgcctttcggtgcggtagtttgtatcttaagtcttctgttaggtgagtggatcaacagatatatgaacttctggggttggacttatttcccagtgaatttctgtttcccttcaaacctgatgccaggtgctatcgttcttgacgttgtgttaatgctgacaaacagcatgacaattacagcggtaattggtggtatggcttatggtttgttgttctatccaggcaactggccaatcatggctccattacatgttcctgttgaatacaatggcatgatgatgactcttgctgatttacaaggttaccactacacaagaactggtacacctgagtacatcataatggttgaaaaaggtacattaagaacttttggtaaagacgttgctccgga

SEQ ID NO: 17 - DNA, 467 bp, Acidimicrobiaceae bacterium A6
  misc_feature (1)..(467): FMO gene, ERCFMO_0010
ggtgactgggatttttggaccgactggaaagatagacgtctatgggtaaccgtagctcctatcgtttctattacattccctgcggctgttcaagcttgcttgtggtggagataccgtttgccagttggcgcaactttgtctgttgttgctctgatgattggtgagtggatcaaccgttatatgaacttctggggctggacatacttcccagttaacatttgcttcccatctaacctgttgccaggtgccattgttcttgacgttatcctgatgttgggtaacagcatgactctgacagctgttgttggtggtttggcttatggcctgttgttctacccaggtaactggcctgttatcgctccattgcacgtgcctgtagaatacaacggcatgatgatgactttggctgacttacaaggttaccactatgttcgtacaggtacacctgagtacatccgtatggtaga

SEQ ID NO: 18 - DNA, 506 bp, Acidimicrobiaceae bacterium A6
  misc_feature (1)..(506): FMO gene, ERCFMO_0011
gactggcatgttcgaccaatcgttgctggcatcgaaccctgtacgctcgataccgactggaaagaccgtcgtctgtgggcaactgttgggacatgcgagcctgcaccaccgtcgctgtactttccctgcagctgtgcaagcttgcttgtggggtcgttcaacttctggggctggacatatttcccagcttacttctgcttcccttcacaattgattccttgcgctatcgttcctcaccgtactggatgttgtgttgttgctgtcttacagcttcaccttcagccagacgctcctacccgctatcgctggcgcaatgggctggggttcttgttttctacccaagcaactggccggttatcgcgccattgcacgtgccggttgaatataacggtatcactgtcgctttggctgacttacaaggttaccactatgtatgaaccggtactcctgagtacatccgtatcgtcaagcgaacctcccgaagaagtgggaaagacgttgctccg

SEQ ID NO: 19 - DNA, 508 bp, Acidimicrobiaceae bacterium A6
  misc_feature (1)..(508): FMO gene, ERCFMO_0012
cgagactgggactcctggaccgactggaaagatagacgtctatgggtaaccgtagcacctatcgtttctattacattccctgcggctgttcaagcttgcttgtggtggagataccgtttaccagttggtgcaacactttcagttgttgctctgatgattggtgagtggatcaacagatatatgaacttctggggctggacatacttcccagttaatatctgcttcccatcaaacttactgccaggtgctatcgtactggacgttatcctgatgttgggtaacagcatgactctgaccgctgttgttggtggtttggcttatggcttgttgttctacccaggtaactggcctgtaatcgcgccattgcacgtgcctgtagaatataacggcatgatgatgactttggctgacttacaaggttaccactatgttcgtaccggtacacctcggtacattcgtatggtagagaaaggtacattaagaactttcggtaaagacgttgcgccgg

SEQ ID NO: 20 - DNA, 468 bp, Acidimicrobiaceae bacterium A6
  misc_feature (1)..(468): FMO gene, ERCFMO_0013
gactggaaagatagacgtctatgggtaactgtagctccaatcgtttcaattactttccctgcagctgttcaagctgtgttgtggtggcgttaccgtttgccttttggcgcggtagtttgtatcttaggtctgctcttaggtgagtgggtcaacagatatttgaatttctggggttggacttatttcccagtaaatttctgcttcccttcaaacttgatgccaggtgctattgttcttgacgttgtgttaatgctgtcaggaagtatgacagttacagcggtaatcggtggtatggcatggggtctgttgttctatccaggcaactggcctgttatggcaccattacatgttcctgttgaatacaatggcatgatgatgacacttgctgatttacaaggttaccactatgttagaactggtacacctgaatacatcagaatggttgaaaaaggtacactgagaactttc

SEQ ID NO: 21 - DNA, 387 bp, Acidimicrobiaceae bacterium A6
  misc_feature (1)..(387): FMO gene, ERCFMO_0014
acgttgacgccgatcctgatgatcaccttccctgcggcgacgcaatatttcatgtgggagaagatgcggcttccgatcggcgccaccttttgcgtgatgacggttcacttcggccaatggatgaatcgggtctttaacttctacatgtgggcctggttcccggtcaactttaccacccctggtttgctgatacccagcgcaatcttcctggacgtggtgttgatgatgacaggaagctacatgtttacggcgctgttcggcggcatggggtggtccctgttgttctatccgtccaactggacctggcttgccccgtttcacttggctgtgaagcatccaagcggaccgctcatgtcgatcgctgatttgatggggatgggtatgtgc

SEQ ID NO: 22 - DNA, 508 bp, Acidimicrobiaceae bacterium A6
  misc_feature (1)..(508): FMO gene, ERCFMO_0015
actggcatgttcgaccaatcgttgctggcatcgaaccctgtacgctcgataccgactggaaagaccgtcgtctgtgggcaactgttgggacatgcgagcctgcaccaccgtcgctgtactttccctgcagctgtgcaagcttgcttgtggggtcgttcaacttctggggctggacatatttcccagcttacttctgcttcccttcacaatcaattccttgcgctatcgttcctcaccgtactggatgttgtgttgttgctgtctaacagcttcaccttcagccagacgctcctacccgctatcgctggcgcaatgggctggggttctgattttctacccaagcaactggccggttatcgcgccattgcacgtgccggtagaataatgcggtatgatgatgactttggctaccttacaaggttaccactatgtaagaaccggtactccatggtacatccgtatcgtcaagcgaacctccctgagaagaagtgggaaagacgttgctccg

SEQ ID NO: 23 - DNA, 508 bp, Acidimicrobiaceae bacterium A6
  misc_feature (1)..(508): FMO gene, ERCFMO_0016
tgggacttctggcttgactggaaggacagggaattttggccaacctttaccccggtgctgttgatcacctttccggcggccgttcaatacgtgctctggacctacttccgtctgcctatcggcgccaccctttgctgtcttggactgctcatcggcgaatggatcgtcaggatccacggctttcacatctgggcgtggttcccgtttacgctgatttggccggcgaccatgttgccgggcgccatcgcactcgatctggtcctaatgctcagcggcaatttcattatgaccggcatattcggcggtatgcttttcgcactgctgttctatcccggaaactggccgatgttggctgcgtaccgtttaccgcttgagcacattggatcgcttctcacggtcggagatctgatcggctacgtctatccgcgcagcagcatgccggaatatctgcgcatcattgagcggggtaccctgcgcacctttggtggtcattccgcggtggttgctg

SEQ ID NO: 24 - DNA, 509 bp, Acidimicrobiaceae bacterium A6
  misc_feature (1)..(509): FMO gene, ERCFMO_0017
gactggcatgttcgaccaatcgttgctggcatcgaaccctgtacgctcgataccgactggaaagaccgtcgtctgtgggcaactgttgggacatgcgagcctgcaccatcgtggctgtactttccctgcagctgtgcgaatggcatgcgcggtcgttcaacttctgcggctggacatatttcccagcttacttctgcttcccttcacaattcattccttgcgctatcgttcctcaccgtactggatgttgtgttgttgctgtctaacagcttcaccttcagccagacgctcctacccgctatcgctggcgcaatgggctggggttctcattttctacccaagcaactggccggttatcgcgccattgcacgtgccggtagaataatgcggtatgaatcgtccctttggctgacttacaaggttaccactatgccggaaccggtactcctcagtacatccgtatcgtcaagcgaagctccctacgatcaagtgggaaagacgttgctccg

SEQ ID NO: 25 - DNA, 507 bp, Acidimcrobiaceae bacterium A6
  misc_feature (1)..(597): FMO gene, ERCFMO_0018
gccgactgggacttctggaccgactggaaagatagacgtctgtgggtaaccgtagcacctatcgtttctattacattccctgcggctgttcaagcttgcttgtggtggagataccgtctgccaatcggcgcaaccgtttctgttgttgctctgatgctgggcgagtggatcaaccgttacatgaacttctggggttggacatacttcccagtaaacatttgcttcccatctaacttgctgccaggcgctatcgttctggacgtggttctgatgctgggcaatagcatgactctgaccgctgttgttggtggtttggcttatggtttgctgttctacccaggcaactggcctatcattgctcctctgcacgttcctgttgaatacaacggcatgatgatgactctggctgacttgcaaggttaccactatgttcgtaccggtacacctgagtacatccgtatggtagagaagggtactttgagaactttcggtaaagacgttgctccg

SEQ ID NO: 26 - DNA, 507 bp, Acidimicrobiaceae bacterium A6
  misc_feature (1)..(507): FMO gene, ERCFMO_0019
ggcgactgggacttctggtcggactggaaagaccgtcgactgtgggtcacggtgaccccgatggtactggtcaccttcccggcggccgtacaatcctacttgtggaaccggtatcgtctgccttggggagccaccgtgtgcgtcctgggtctgctgctgggcgagtggatcaaccgttatttcaacttctggggctggacctacttcccgatcaacttcgtgttccctgcctcgctggtgccgggcgccatcatcctggacaccgtgctgatgctgtcgggcagctacctgttcaccgcgatcgtcggtgcgatgggctggggtctgatcttctacccgggcaactggccgatcatcgcgccgctgcacgtgccggtggaatacaacggcatgctgatgtcgatcgccgacatccagggttacaactatgtgcgtacgggtacgcctgagtacatccgcatggtagagaagggcaccctgcgtaccttcggtaaggacgttgctccg

SEQ ID NO: 27 - DNA, 468 bp, Acidimicrobiaceae bacterium A6
  misc_feature (1)..(468): FMO gene, ERCFMO_0020
gactgggacttctgggcggaccggaaggaccggcgtttatgggtgacggtttatccgattgtgatgatcacgtttcctgcggcggtgcaggcggtgatttgggagcgtatgcggttgccctggggggcgacggtatgcattttaggcatcctgtttgaggagtgggttaaccgctacttcaacttctggatgtggacatatttccccattaactttgtatctccgacggcggcggttcacatggcgatctctttagacgttgtgttgatgcagtctgggagcttcttgtctacggcggtgattggtgggttaggctgggggctattgatgtatcctggcaactggtcgatcattgcgcccttgcccgtaccggtggaatacaatggcatgctgatgtcgattgccgacattcatgggtaccaatatgtgcgtacgggcgcgtctgggtacattcggatggtagatgac

SEQ ID NO: 28 - DNA, 514 bp, Acidimicrobiaceae bacterium A6
  misc_feature (1)..(514): FMO gene, ERCFMO_0021
ggggactgggacttctggctggactggaaagaccgtcaatggtggcctgtggtgacccccatcgtaggcatcgcctactgtgctgccatcatgtactacctatgggtgaactaccggctgccctatggcgccaccttatgtatcgtctgtctcttggtaggcgaatggctgacgcgtttctggggattttactggtggtcgcactaccccatcaacttcgtctttccctccaccatgataccgggcgcgctggtcatggacaccgtcctgctgctcacccgcaactggatgatcaccgcactgattggaggcggcgcatttggcctgctgttctacccgggcaactggcccatctttggcccgacccacctgccgctggtagccgaaggcgtattgctgtcggtcgccgactacaccggctttttgtatgtacgcaccggcacgcctgagtacgtgcgcctgatcgaacaaggctcgctacgaaccttcgggggccacaccaccgcgattggcg

SEQ ID NO: 29 - protein, 169 aa, Acimicrobiaceae bacterium A6
  MISC_FEATURE (1)..(169): FMO enzyme, ERCFMO_0001
GDWDFWLDWKDRQWWPVVTPIVGITYCAAIMYYLWVNYRLPYGATLCIVCLLVGEWLTRFWGFYWWSHYPINFVFPSTMIPGALVMDTVMLLTRNWMITALFGGGAFGLLFYPGNWPIFGPTHLPLVAEGVLLSLADYTGFLYVRTGTPEYVRLIEQGSLRTFGGHTTV

SEQ ID NO: 30 - protein, 169 aa, Acidimicrobiaceae bacterium A6
  MISC_FEATURE (1)..(169): FMO enzyme, ERCFMO_0002
GDWDFWTDWKDRRLWVTVAPIVAVTFPAAVQACLWGRYRMPWGATMCVLGLLLGEWINRYFNFWGWTYFPVNFCFPSQLIPSAIILDVVLLLSNSFTFTAIAGAMGWGLIFYPSNWPVIGPLHVPVEYNGMMMTLADLQGYHYVRTGTPEYIRMVEKGTLRTFGKDVAP

SEQ ID NO: 31 - protein, 169 aa, Acidimicrobiaceae bacterium A6
  MISC_FEATURE (1)..(169): FMO enzyme, ERCFMO_0003
GDWDFWSDWKDRRLWVTVTPIVLVTFPAAVQYFLWERFRLPWGATVCVLALLFGEWVNRYFNFWGWTYFPVNFVFPAILTPGAILLDTVLMLSGSYLFTAIIGSMAWGLIFYPGNWPIIAPIHVPVEYNGMLMSVADIQGYNYVRTGTPEYIRMVEKGTLRTFGKDVAP

SEQ ID NO: 32 - protein, 167 aa, Acimicrobiaceae bacterium A6
  MISC_FEATURE (1)..(167): FMO enzyme, ERCFMO_0004
WDFWSDWKDRRLWVTVTPIVLVTFPAALQVLLWERFRLPWGATLAILSLLFREWVNRYFNFWGWTYFPVNFVFPAILIPSAILLDIMLMLSNSFLVTAVVGGLAWGLMFYPGNWPIIAPLHVPVEYNGMLMTLADLQGYHYVRTGTPEYIRMVEKGTLRTFGKDVAP

SEQ ID NO: 33 - protein, 170 aa, Acidimicrobiaceae bacterium A6
  MISC_FEATURE (1)..(170): FMO enzyme, ERCFMO_0005
DWHVRPIVAGIEPCTLDTDWKDRRLWATVGTCEPAPSWLYFPCSCASLLVGSFNFWGWTYFPAYFCFPSQLIPCAIVPHRTGCCVVAVMQLHLQPDAPTRYRWRNGLGFLFSTQATGRLSRHCTCRLNITVLMMTLADLQGYHYVRTGTPEYIRIVKRSSLRFSGKDVAP

SEQ ID NO: 34 - protein, 169 aa, Acidimicrobiaceae bacterium A6
  MISC_FEATURE (1)..(169): FMO enzyme, ERCFMO_0006
GDWDFWSDWKDRRLWVTVTPIVLVTLQAAVQYFLWERFRLPWGATVCVLALLFGEWVHRYFNFWGWTYFPVNFVFAAILTPGAILLDTVLMLSGSYLFTAIIGSMAWGLIFYPGNWPIIAPIHVPVEYNGMLMSVADIQGYNYVRTGTPEYIRMVEKGTLRTFGKDVAP

SEQ ID NO: 35 - protein, 168 aa, Acidimicrobiaceae bacterium A6
  MISC_FEATURE (1)..(168): FMO enzyme, ERCFMO_0007
GDWDFWVDWKDRRMWPTVVPILGVTFCAAAQAFWWVNFRLPFGAVFAALGLLIGEWINRYVYFWGWTYFPINLVFPSALIVPAIWIDVILLLSGSYVITAIVGSLGWGLLFYPNHWPAIAKFHQATEQHGQLMTLEDLIGFHFVRTSMPEYIRMVQRTFQPPSVKTLL

SEQ ID NO: 36 - protein, 168 aa, Acidimicrobiaceae bacterium A6
  MISC_FEATURE (1)..(168): FMO enzyme, ERCFMO_0008
DWDFWTDWKDRRLWVTVVPIVGITFPAAVQACLWRRYRLPYGAVVCVLGLLLGEWINRYINFWGWTYFPVSFCFPSQLVPGAIVLDVVLMLSNSMTITAVIGGMAWGLLFYPGNWPVIAPLHVPVEYNGMMIALADLQGYHYVRTGTPEYIRMVEKGTLRTFGKDVAP

SEQ ID NO: 37 - protein, 169 aa, Acidimicrobiaceae bacterium A6
  MISC_FEATURE (1)..(169): FMO enzyme, ERCFMO_0009
GDWDFWTDWKDGRLWVTVAPIVSITFPAAVQAVLRWRYRLPFGAVVCILSLLLGEWINRYMNFWGWTYFPVNFCFPSNLMPGAIVLDVVLMLTNSMTITAVIGGMAYGLLFYPGNWPIMAPLHVPVEYNGMMMTLADLQGYHYTRTGTPEYIIMVEKGTLRTFGKDVAP

SEQ ID NO: 38 - protein, 155 aa, Acidimicrobiaceae bacterium A6
  MISC_FEATURE (1)..(155): FMO enzyme, ERCFMO_0010
GDWDFWTDWKDRRLWVTVAPIVSITFPAAVQACLWWRYRLPVGATLSVVALMIGEWINRYMNFWGWTYFPVNICFPSNLLPGAIVLDVILMLGNSMTLTAVVGGLAYGLLFYPGNWPVIAPLHVPVEYNGMMMTLADLQGYHYVRTGTPEYIRMV

SEQ ID NO: 39 - protein, 168 aa, Acidimicrobiacea bacterium A6
  MISC_FEATURE (1)..(168): FMO enzyme, ERCFMO_0011
DWHVRPIVAGIEPCTLDTDWKDRRLWATVGTCEPAPPSLYFPCSCASLLVGSFNFWGWTYFPAYFCFPSQLIPCAIVPHRTGCCVVAVLQLHLQPDAPTRYRWRNGLGFLFSTQATGRLSRHCTCRLNITVSLSLWLTYKVTTMYEPVLLSTSVSSSEPPEEVGKTLL

SEQ ID NO: 40 - protein, 169 aa, Acidimicrobiaceae bacterium A6
  MISC_FEATURE (1)..(169): FMO enzyme, ERCFMO_0012
RDWDSWTDWKDRRLWVTVAPIVSITFPAAVQACLWWRYRLPVGATLSVVALMIGEWINRYMNFWGWTYFPVNICFPSNLLPGAIVLDVILMLGNSMTLTAVVGGLAYGLLFYPGNWPVIAPLHVPVEYNGMMMTLADLQGYHYVRTGTPRYIRMVEKGTLRTFGKDVAP

SEQ ID NO: 41 - protein, 156 aa, Acidimicrobiaceae bacterium A6
  MISC_FEATURE (1)..(156): FMO enzyme,ERCFMO_0013
DWKDRRLWVTVAPIVSITFPAAVQAVLWWRYRLPFGAVVCILGLLLGEWVNRYLNFWGWTYFPVNFCFPSNLMPGAIVLDVVLMLSGSMTVTAVIGGMAWGLLFYPGNWPVMAPLHVPVEYNGMMMTLADLQGYHYVRTGTPEYIRMVEKGTLRTF

SEQ ID NO: 42 - protein, 129 aa, Acidimicrobiaceae bacterium A6
  MISC_FEATURE (1)..(129): FMO enzyme, ERCFMO_0014
TLTPILMITFPAATQYFMWEKMRLPIGATFCVMTVHFGQWMNRVFNFYMWAWFPVNFTTPGLLIPSAIFLDVVLMMTGSYMFTALFGGMGWSLLFYPSNWTWLAPFHLAVKHPSGPLMSIADLMGMGMC

SEQ ID NO: 43 - protein, 169 aa, Acimicrobiaceae bacterium A6
  MISC_FEATURE (1)..(169): FMO enzyme, ERCFMO_0015
TGMFDQSLLASNPVRSIPTGKTVVCGQLLGHASLHHRRCTFPAAVQACLWGRSTSGAGHISQLTSASLHNQFLALSFLTVLDVVLLLSNSFTFSQTLLPAIAGAMGWGSDFLPKQLAGYRAIARAGRIMRYDDDFGYLTRLPLCKNRYSMVHPYRQANLPEKKWERRCS

SEQ ID NO: 44 - protein, 169 aa, Acidmicrobiaceae bacterium A6
  MISC_FEATURE (1)..(169): FMO enzyme, ERCFMO_0016
WDFWLDWKDREFWPTFTPVLLITFPAAVQYVLWTYFRLPIGATLCCLGLLIGEWIVRIHGFHIWAWFPFTLIWPATMLPGAIALDLVLMLSGNFIMTGIFGGMLFALLFYPGNWPMLAAYRLPLEHIGSLLTVGDLIGYVYPRSSMPEYLRIIERGTLRTFGGHSAVVA

SEQ ID NO: 45 - protein, 169 aa, Acidimicrobiaceae bacterium A6
  MISC_FEATURE (1)..(169): FMO enzyme, ERCFMO_0017
DWHVRPIVAGIEPCTLDTDWKDRRLWATVGTCEPAPSWLYFPCSCANGMRGRSTSAAGHISQLTSASLHNSFLALSFLTVLDVVLLLSNSFTFSQTLLPAIAGAMGWGSHFLPKQLAGYRAIARAGRIMRYESSLWLTYKVTTMPEPVLLSTSVSSSEAPYDQVGKTLL

SEQ ID NO: 46 - protein, 169 aa, Acidimicrobiacea bacterium A6
  MISC_FEATURE (1)..(169): FMO enzyme, ERCFMO_0018
ADWDFWTDWKDRRLWVTVAPIVSITFPAAVQACLWWRYRLPIGATVSVVALMLGEWINRYMNFWGWTYFPVNICFPSNLLPGAIVLDVVLMLGNSMTLTAVVGGLAYGLLFYPGNWPIIAPLHVPVEYNGMMMTLADLQGYHYVRTGTPEYIRMVEKGTLRTFGKDVAP

SEQ ID NO: 47 - protein, 169 aa, Acidimicrobiaceae bacterium A6
  MISC_FEATURE (1)..(169): FMO enzyme, ERCFMO_0019
GDWDFWSDWKDRRLWVTVTPMVLVTFPAAVQSYLWNRYRLPWGATVCVLGLLLGEWINRYFNFWGWTYFPINFVFPASLVPGAIILDTVLMLSGSYLFTAIVGAMGWGLIFYPGNWPIIAPLHVPVEYNGMLMSIADIQGYNYVRTGTPEYIRMVEKGTLRTFGKDVAP

SEQ ID NO: 48 - protein, 156 aa, Acidimicrobiaceae bacterium A6
  MISC_FEATURE (1)..(156): FMO enzyme, ERCFMO_0020
DWDFWADRKDRRLWVTVYPIVMITFPAAVQAVIWERMRLPWGATVCILGILFEEWVNRYFNFWMWTYFPINFVSPTAAVHMAISLDVVLMQSGSFLSTAVIGGLGWGLLMYPGNWSIIAPLPVPVEYNGMLMSIADIHGYQYVRTGASGYIRMVDD

SEQ ID NO: 49 - protein, 171 aa, Acidimicrobiaceae bacterium A6
  MISC_FEATURE (1)..(171): FMO enzyme, ERCFMO_0021
GDWDFWLDWKDRQWWPVVTPIVGIAYCAAIMYYLWVNYRLPYGATLCIVCLLVGEWLTRFWGFYWWSHYPINFVFPSTMIPGALVMDTVLLLTRNWMITALIGGGAFGLLFYPGNWPIFGPTHLPLVAEGVLLSVADYTGFLYVRTGTPEYVRLIEQGSLRTFGGHTTAIG

The invention claimed is:

1. A medium comprising:
an ammonium containing contaminant, an iron component, an oxidant comprising elemental sulfur, and a Feammox bacterium and/or enzyme thereof capable of oxidizing ammonium coupled with reduction of Fe(III) to Fe(II), wherein the elemental sulfur regenerates Fe(III) via Fe(II) oxidation and, the elemental sulfur is reduced to sulfide.

2. The medium of claim 1, wherein the Fe(II) oxidation generates hydrogen ions.

3. The medium of claim 2, wherein the hydrogen ions are consumed in the ammonium oxidation.

4. The medium of claim 1, wherein the iron component comprises Fe(III).

5. The medium of claim 4, wherein the iron component comprises ferrihydrite, iron oxide, elemental iron, a goethite, a nontronite, an iron-rich clay or mixtures thereof.

6. The medium of claim 1, wherein the medium is aqueous-based.

7. The medium of claim 1, wherein the medium comprises wastewater.

8. The medium of claim 6 having a pH of 4 to 7.

9. The medium of claim 1, wherein the medium comprises soil.

10. The medium of claim 1, wherein the sulfide forms a compound with Fe(II) in the medium.

11. The medium of claim 1, further comprising at least one additional contaminant selected from the group consisting of halogenated organic contaminants, chlorinated volatile organic compounds, perchloroethylene (PCE), trichloroethylene (TCE), trichloroethane, dichloroethane, vinyl chloride, polychlorinated biphenyls, fuel constituents, benzene, ethylbenzene, toluene, xylene, phenanthrene, methyl tert butyl ether, tertiary butyl alcohol, polyaromatic hydrocarbons, and ethylene dibromide.

12. The medium of claim 1, wherein the Feammox bacterium is an Acidimicrobiaceae bacterium.

13. A method of environmental remediation comprising: providing a medium including one or more ammonium containing contaminants; disposing an oxidant comprising elemental sulfur and a Feammox bacterium and/or enzyme thereof in the medium; and oxidizing the ammonium with the Feammox bacterium and/or enzyme thereof coupled with reduction of Fe(III) to Fe(II); and regenerating Fe(III) with the elemental sulfur via Fe(II) oxidation and, the elemental sulfur is reduced to sulfide.

14. The method of claim 13 further comprising adding an iron component to the medium.

15. The method claim 13, wherein hydrogen ions are generated by the Fe(II) oxidation.

16. The method of claim 15, wherein the hydrogen ions are consumed in the ammonium oxidation.

17. The method of claim 14, wherein the iron component comprises Fe(III).

18. The method of claim 17, wherein the iron component comprises ferrihydrite, iron oxide, elemental iron, a goethite, a nontronite, an iron rich silicate or mixtures thereof.

19. The method of claim 13, wherein the medium is aqueous-based.

20. The method of claim 13, wherein the medium is wastewater.

21. The method of claim 19, wherein the medium has a pH of 2 to 8.

22. The method of claim 13, wherein the medium is soil.

23. The method of claim 13 further comprising forming a compound with the reduced oxidant and Fe(II).

24. The method of claim 13, wherein the oxidant is present in the medium in excess of the oxidant's solubility limit in water.

25. The method of claim 13, wherein the oxidant increases the rate of ammonium oxidation.

26. The method of claim 13, wherein the Feammox bacterium is an Acidimicrobiaceae bacterium.

27. The medium of claim 10, wherein the compound is iron sulfide (FeS).

* * * * *